United States Patent 7,625,699 (GENETIC POLYMORPHISMS ASSOCIATED WITH CORONARY STENOSIS, METHODS OF DETECTION AND USES THEREOF) - sequence listing, part 12

SEQ ID NO: 12574 - DNA, 156796 bp, Homo sapiens
taccagtgcccccagttctgatagtgtcttttgacaaacaaatgttttacattttcatacagtttttcttttgttgcctgtgcctttggtgtcatatccaagaaatcattgccaaatccaatgttgtgaagctcttgccctatgttttattgtaagagttttatagttttaggtcttatgatccatttgagttaatttctgtatatcgtctaaggtcagggcccaagttcattcttttgcatctgggtattccattctcccagcaccatttactgaaaagactgtctcttatccattgaatggtcttggcatccttgctgaaaatcatttgaccatatatgtgaggatttatttctggagagagggcattacattttgtagggcacaaaggtgcatcagagtgtagactgttctaatacatttgaattggtcagagggagattgtttagaatggagttggatctcatttttgtttcaaagaaaaaggagagagatttgacttggggggggggcggtaaattagctgacttaaagggggtttgagaccggcctgggcaacatggtgagacccccacctctataaaaaataaaaaattagccaggcatggtggtgtgtgcctgtagtcccagccactcggggggctgaggtaggaggatggcttgagcccaggaggtcaagggtgtaataaactgtgatcatcccactgcactccagtttgggtgacagagtgagatcctgtctcaaaaaaaataaaaaagaattggccgggtggagtggcttatacctgtaatcccagcactttgggaggctgaggtgggcagatcacctaaggtcaagagtttgagaccagcctggccaacatggtgaaagcctgtctctactaaaaatacaaaaattagctgggcgtggtggcgtgcacctgtagtcccagctactcgggagactgaggcaggagaaccgcttgaacccgggaggcagaggttgcagtgagccaagatcatgccactgcactccagcctaggcaacagagtgagattctgtctcaaaaaaataaaataaaataaaaaagaattacggatttttagactcctttcctgccctagtttatctggttcacacccttttctttctttttacatttaagagtcagggtctcactctgtcacccagcctggagtgcagaggcacattcataactcactgaagcctccacccccgggctcaagtgattctcccaactcggtctctcaagtagctaggactacaaacatgcaccaccattcctggttaaatttttaatttaatttaattaatttattttttgagacagagtctccctctgtcatccaggctggagggcagtggcatgatcttggaccactgcaacctccacctcccaggttcaagtgattctcctgtctcagcctcctgagtagctgggactacagtcgtgtgctatgcccagctaacttctgtattttttagtagagatggaattttaaccatgtttgccaggctggtctcgaactcctgattgccaagtgatccaactgctttggcctcccaaagtgctgtgattacaggtgtgagccatggtgcccagccaaattttatttttttgaagatggggtctcaccatgttgcccaggctggtctcaagctcctggccttgatcctcttgcctcagcctcccaaattgctgggattacaggtgtgagccatcatgcctggctccctcatttttatgtataaagaaggctgatgttattcctaaggtcaggattaccaacaaatatgtatcacagaaggaaaagtccagctctgttgaggaagtacttctttttcctggaacaggcagatttggtaaggaatgagctctctatagctatgaatgtacaaacagaagtcagacgaacacctgctgtataaggcaagtctgaacatctctctccttgtttacagatgttccatgattgcccattaacttcagaataaaaacttgcttttttaacaatgatgcggtcctagtctaactttatagcatcatcttctgccatgtatatatgttcttgatatctctaactttatgaacgctaatgtccttttaaattctaaaatcttattcacttaaaaaaatgccaccttaagaaaaactgactgtttctaatgtttcaatgaagtaagctgcagggtgtggctgtagtttaaaattccacgcatagaatcctcaggacagatgaaatggaatcaacaggtagaaagtacacacatgtgctagtgtgagtctaagggcacatgaaatccaaatggggcagatgagaagaaactaaattttaagaagaaagggaattcatttgtgtggaacatttactatgaaataggcatttttacacattttcatctcattgacttttaagaatgcaaacagacaaagagaagtaaatcctttacactatcttgaggtgagcacacacctcaagagctttggtattgtcatgatctttgcaagaatcacaaaaattttagacactgaccatatcttatgctttatagacaatttagagtgtcaacaagcaatttctgagtgctttctatatgtgtcaggattatgctgggtgctgaaaatacaaaggtaaaggagacttggttaggaccacatcatgggggtgatgcactgtttttcactagagatcattatcacccagggcctatagtctctctccttggagaaatcaagtacacaggaaaaaaaaaaatggggctcagagaaacagcttagcaggtctgattgtatttatctctgcttacaagtgatcagtgattccccaataactataatataaagcctgctttttttccagtggcatacagggccctttatgatcaaacagcaaaacttggtttgaacagacttaggcacctttcttttttcttgaaatggagtcctgttctgtcacccagactggagtgcagaggcatgatctcggctcactgcaacctctgcctcccgggttcaagcgattctcctgcctcaacctcctgagtagctgggattacaggcacccaccaccatgcctggctaatttttgtatttttagtagagatggggtttcaccatgttgcccaggctggtcttgaactcctgacctcaagtgatctgcccacctcggcctcccaaagtgctgggactaggcacctttcttgttataattttacttaccaagtcaccttttcattcaatattattagttttttactaagttttcttattcacctaggaagacaacagaatatgaatattgatccactgagtaattatattcctcatgagatacaatgaaataagatttttactgcaagttattttcacctgggtttggatgaaactaagttttcagaacttccagactggaggcttaaccacaatcatgagatttcccttgaaagtttaagtcctcagaggatttttacatagaaatcagacatttaccattttatatctcaaaaacctgtggttcaatgggaagaatacagggctggtattctagtccagcctgtgacttactgtatgaccctgggcatgaattaaaccttatactccataaatttccttattctttgtgtcagaaccatacttgctctagctgtgatgataaaattatagttgtcaaaattttcaactcgacaactatgtaggtatcagaaggaataccttgtaagtatctgtgctgaagtgtacaatctattggggtcacggaattcagagaatagagggatcacattcagtggagtgcagaggaggggtggtaatcaggaagatttaataaagaaggtagaggttgagctgggtcttggggaataagcaaggtagtagaagagagttatctggaggggataagggcagagaggcactgaaattttcagtctggccccagttttcttttccagattcattatcttctgcacactccagagtcaatgctgccctctgaatcacagacatgtgtctggcacacagcagacagatcttcaaggtccagcttttagttcttccacggaagtctcaccaaagtggaatttatcacactctcctctggatttgcccagccctttgttaataagacctgttgcttttattgtagctcacctgcttgctcaatggggaactttttggagacaggaagcaatgatttgtctttgtttccctaggcacctaacaacgctttgctcttaagtaattaggaaatgtttactcaattgaacttgttctaaggacactgctatcactgaattgaagggcatgtcggtatcttcttagtgtctctataggctttaggctttcagccgggtgaagtagggattttttctttgtttccaggctagtcaagcgaagcagggatacagattaagaatttgcagatgaggaaactcaagagggtacatttgctcaaaggcatcatgttgataaacgccaaaaccaggtagggctcttttgacttgaaatccagtcctctatccattatacctgggccttgtagcatcagccagattggggtaaaatgcactaactctgaaccctagttttttcatccgtaaatgagagcaacagtacgtaactcacagggctatcgtgaagtggagcgtccctctgtgacctctaaccagtcccagcctgagtcacattataagaaaatttataaggcactatcttgtaaatacttaagatttaacatcttcccttcacctctacgtccactcttttcatacctttttcctgcctagcatgtgtcaaactcaaaggactgggcacagagcacagaggttgtgtgctttgtccagctttgaggtcagagattggctaaataatctctgaggctggggtcttaaaaaaaaacaacaaaaaacaaaactaacaaaaccttaagtccgttccgcccgtgactttaaataattatgtagaggaatgtaatacgttaaaagcaaggggatgagggggcccattgatggtagatggttttatgcccgcctgcagctaaagaaatgatttctaaaacctcttttgggggtgggagatggagtgctccagagatttctcttcgagctccttcattcctgaactgcctgccttttcaaaggaaaaaaggtccagctgcggtgggctggaggccgtggtgagtgggtgggggtcgaccctggcggcttcctctgccccgctccctaccgttgctccgaagcccgcttgggcttccgagggtccgccgaggctcgggccacgcccagtccgagtgccaggccagagggtacccattccaggccggccttcctccccagggggagcagccttgggagcgaggcgccgaggcggccctcgggctcggcttccagctcgggggcctcggcagagactaggaaccagactggggcagcactggggcgcccgccacccccacccactccggcaagcgggcgaatcagcgcggctaacccgcggcgcccaggcgggctgcgggacctcgcgacctccgctcggcggccccgcccctgcccgcgagccccgggtggctccctcctcccctctgccagcggcccgccccctcctcgcgagctaacgagtgtctctcgcgcgctcccttccctccgcgtgggtgtgagtgcgcgatcctcctacctcggccttctccccattgtttcttcgcggccaccacgagacccctccccccagtgctgtttcccccctcccccgccccggtgtaaacggtgcctgtggggccccccgaacgaagggagggggcacccctgaacccttccctctgcgcgtagctcctcctctcccgggccaggaccccattacaggctctgtcctctcccctccccctctcccccggcaaccgctctccctcgccccctcccctcagcgggtcctcctctttctctccctctccctctccctcctcctccccctccccatcccttcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcaggtacgaggttccggccgcggggcagcgtcgggtaccgagggggtgtgctcgggaaggccgggcggcccccggttcgccctccccaggtgccgcgcttcgcaggtgtcgggggcctggcctgagagcgtctcagccgccccctgggggcctgacacttctttctttcctggaacgggcttcgggtgtcccaggggaaggctgagataagggaggtggggacggcggcctgggcggcctgaggagggcattggggcgctttggggacgaactccacactgtggctggggctcccggtcccggaccgaaacctgttgtagaccagcggggcggattttgagttaacgggattggtttgaacatttctgttgggtccagttacgattccctgtcatgtgtacctttttctttcacccttgcttagacataggtgactacataatgtatataaatgtatacacgcatataatacatactgaatgtttccccgggctcgtccttgtagggagaaggcagaggtgtctgtgtggattttgtttcttgctcgcccgccttctctctcccccgccccccagtcgaaaggtggtaatgcgcggttttgacgtgggtaactgagattcgtatttgtaaacagatagcgctctcctagtgtgttgcacgcctctgcgaagggtttcagactcctgttggtatctggattgcgaaagaatgagatgtttagacctgaaagaagcacatcagcgggatttctagtcgtacttgaatgggatgaattactgttgtattaacaacgttgattacacattttcttttcagaagatttcgaagtcttagatgaattttgcgtgagatcttagataccgtatatctgcttcttcattttgatagaagtagtagttccttacacatttgacctgccctatcgtgatcttaaattgtgtccagaaatgcaattcgaattgtgtattgttggcatgcatttagtaattagcccgagtggatcagatggccttttatttccaaagattttttccctccagtcttacagcagcgaaatgtttgtagcacttgatgaaacagaacatatcctgtttctgtttttaaagtaatgagaactgttagctaataaaattggataatcccagccagatatgataattyagagaataccaccgagaggtgttgaattgtgggatggtttaaaaagaaaagccgactttgtgtgtgtgtgtgtatgtgtgtgtgtgcgcgcgcgagcgcgctgaaattttctttaggcttagaactcatgtatgtcactacactgcatcgtagtactgattagtcacaactggtaaaatgaaatattgattctcttaaaaagctgtgcttaagataactcattagtgtctagtgtgctatgttgcttttataaacaaatttttaaagattgcttcttagaaaccatatactttggggaagataagaattttaagtcgttttatgctttaaaaatatttatatttaatataaacaaaagaaacttacttttaaaactcttagataaatttttctgctgcttgcagtttttcacttggctagtgtggaaaatgaaaaatgaagttttcttaaaataattcagaaatggaagtgaaagttaatgacatttgatgttttaaatccagcaaacatttaaatacagaaaagaaatttaaagtattttcattgtcataggccaagttgttagtacagataaattaacaaatattgtcatgcatataagttcaagtttataaattctaagtgacacctaaaattacatttatttttagttgctggagctagaacagtacagtgtctacattttaattttagaccttttagaatcaaaatgtataattataaatttctctgattaacaaagagctgtttaaagagaatttttattagctctcagcagattcattttagagtaagtaattagaattcttttttatctcaaagttaatcttgacataaaaataagtaccattaattatgttgtgttctctacagaatgtcaaatcaggatctgttgatcaagaaaggtgtttgaatttattcactgttaaagtttctagtttcagagaaacaaaataaccaacacttacctgtagggcctggccaggtggctcactcacgcctgtaatctyagcactttgggaagtggaggcgagaggattgcttgagcgtaggagtttgatatcagtctgagcagcatagtgagactttgtcactgccaaaaaataaaagaaattagctgggcgtggtggtgtgcgtctgtagtcccagaagctgaggtaggaggtttgcctgagcccagagttcaaggttgcagtgaggcacagttgcgccactgtactccagcctgggcgacagagtaagaccctgtcttaaacaaaaaaaaaaaaaaaaaaaagcaatacttacctgttaatgttgatgccagaacattttgtttgacaaaatagaactcaatgagttgtgttcctttttcaaataaattgcaaatacttgaattgattaaaaaatgttaaattcagttaaagccactgcagtaggatagaaatacgttctaaaaaagaacaattccagaaagacctaaaaaagtcaaaggaaagggacaccatactttaaaacaggatatgtagactttttgttattaatcttagagcaattagagttgtttactgggtactaactgaattgttttaattctagaatcctaaataattacataatttggggkaaatgtttaaaaaccatcatttctgcagagtatttttctttccttttttaaatctttattttattatgtacagactatattcaaataaaccacacactctgaaaaagcaggttccgacttttcctccggagtatttcttacaggcccaaggagaagaaagggtatataaatgcaaagattaatgttaggatttttcccccttaagtgagagatttgtgtggtgtcttatgttcaaattatttttatgtcacatcatctcattggatatctataattatgagttgagggagagagaagggaaccaaaactttttagagtgcctgttttgttccaggcactgcgctagacactgtttatgcatttttttttcactcgttcagtgtaacagccctttgaaacctgtttataggtgaggaatctttgagtcacagaggttagtgatttgctgaagatcatagaattagatttcaaagcagatctctcttcctaatataatgtatatgtgatgttgcttttcaggtgtattattttctcaattatttagaatgggaaactgcctaaggttgttcattcattcatttaaacattcatttcatcaaacatttgcatttgtatcagtctacatataatacagtaaattacaacacactagattgtgggagttgagagggaagaaactagctcttgaagggtgagtaggagtttgctaggtggagaggaagatggactggaggttggaggtcattccagacctagggaataacatgcaaagatgataaattgtaatgagccttggggagtgagggagagtgagaaattcagtgtggtaggaattgatatggatagaatggtgagataaatgattggaagtagcaaattgtgagggaccatttatgttgtattaaggtgtttgaatttttatcttgtgagatcaccaagtgagatagtggttgagctgtgattagaactatgttttctgactcctagttttgtatttttttctccttggcttcctagctaacagagtttacccgtttttagtggataggcaagccttcttttccgtaccactcttctctcctctccctatattctagacttttatcttgagaattctgtgatccaaatcttactgtccaagaacttttaattttttggaaaagtcttttgggatgaaaacacctctgggggagatcaccttgttatactacttaggaagttttttcacttgttggcttggattagttgactattttctagtttagctctagaaaacaatagcttaaggcattgaagagcatgggctggaagaagggagacgctattcatgcaagtttgatgttcaccactatagatgggcaaagtcctaatctttacataaggcatcttgtacttttaaaaagaaataggtatgtttgttaaccacacaacaatctgattgctttaagtggatatttgatttacaatgataatagataacttattgcatagttactatgagctaatttctttctcaagatctttgaagtgttaacttagtcttcaaaacaaccctttttatattattctcatttatagatgggaaaagtccatgtagaaggattgagtaccttggacaatatctcatagctagtttgctgcagtcaggatttgaactcaaagtgtctgagtctagagtcacagctctttgccactgtactgtgttgtaccttcaagtttagggtgtcaaaattttgtgtacagagagttaaattctgtagtcacataggttgttaaaaatattttgcaaatatgcaaagtatgaattatagagaatgactaagcctgattgcattttgtcagtgtgtagtttaataatataattattaaattaaatatttaactaacactatagtttaaataatttaattgaccagtcattaagtgttcattaagtgctagtcatgtgctgagtattagtttaggccagtggtattcaaactatggggaccttttggagaggggtgtctctgagtcaaactgttttcatggtaatattaagacacaatttgacttttcccttattctctggtctggggtgacatgtgaagactttattgctttgatggctaatgtaatgtgtaatagtgtatttttttccccttttttctttgagatataatttacaataccataaaattcacacttttaaaagatacaattcagtggcttttagtatatttataaggttgtgtaaccatcactatttaattttggaatgtttttatcccataatgaaacccagttcccattaacaatcactccccattccttcctcctccaagcctttggcaagcactaagctacgtctctagaaattatggacattacatatacaaggaattatatagtatgtggctttttgtgcctggcttctttcactgaacttaatgttttcaaggttggccatagtgtagcatgttttagcttttttctggctgaatagtattaccttctatggagataccacgttttgtttaaccattcatcatttgatggacatttgggttatttctactttttgcctataaggaatggtgctgctgtgaacatagttaaacgtttttgtgtggatgtacattttcatttctcttgggtatatacccagattgtaattgctgggtgtttcgataaacttatgattaactttatgaggaactgccaaactgttttccaaagttgtaccattttacattctcagtggcaatgtatggaaggttccaatttctctacatcctcactatcatctagtgggtgacacttcacccactatctcactacctcattgtgggtttgatttgcatttccctaatgattaataagatgttgagcatctcttcatgtgcctgttgtgcatttgtctatctcctttggaaagatacctattcaaatcctttacccgtttttaaaaattgttgagttttaagaactcaatatattctggatactagatgcccccacttttttttttgagacagtcttgctctatcaccaaggctgaagtgcagtggcgtgaacatggctcactgcagcctctgccttctggcctccacctcctgggcctcaagcgatcctcctgccttagcctcttgagtagctaggactacaggtgcatgccaccatgcccagctaatttttttgattgatttatttatttttgtagagacaggatctcattatgttgtctaggctggtctcaaactcctggcctcaaatgatcctccttcctcagcctccgaaagtgccaggattacaggtatgagccatctcgcccaggctagaccctttttagatatattatttacaaaaatgctgtctcattttgtggagtgtctattcaccttaaaaaagattctaaaaattgtgataaagtgtacataacaaattaaccatttaaacttgtttccaacttttaaaaattgcagtaaaatatacataacacaacatatcatcttaatgatttttaagtgtatcattcagtggtattaaatacattcataatgttgtgcagccatcatcaccatccatccctataacccttttcatcttataaaactgaaactctatacccattaaatgataatttcccgttcccttcttccctcacccctgacaaccactattctgtctttacgattttgactactctaaatacctcatataaattgaatcatacaatatttgtcttgtggcttatttcacttagcatagtgtcctcaaggttcatcatgtggcatattgcagaatttccttcttttttaaggctgaataacattccattgtatagatatatcacattttgcttatccctttgtctatgagtagacacttgggttatttccatgttttagctattgtgaatgatgctgctgtgaacatgagtgtacagtatctcttagcctgctttcaatttttttggtatatacccagaagtgaaattattggatcatatggtaattttattcttcttcttctatttatttatttatgagacaagatctggctctgtctcccaagctggagtgcagtggcatggtgttggctcactgcaacctctgcctcctgggctcaagccatcctcccacctcagcctcttgagtagstgggactgtgggcgcttgcgaccacacctggccaatttttttttttttttttttttttgkatttttgtagagatgcagtttcaccatattgcccaggctggtctcaaactcctgagctcaagtgatgtgcctgcctcggcctcccaaactgctgggattacaggcatgagccatcgcgcctggcctattattattattatttttgacaccttagcatcattgagtatatttttaattttttgaagaactgctatattgttttccatagtggctgtaccattttacgttcctaccaacagtgcacagaggttctgatatttccacagccttgccaacacttgctattttctatttatttaatagtagtcctgtcctatgggttgtgagttggtatctcattggagttttgatttgcatttccctaatgattagtgatattcagcatcttttcacgtgcttgtggccgtctgtatatcttctttggagaaatgtctatgccagccctttgcccattttcaaatcaggtcattttttgttcattttttggagttgctatatattctggatattagtcccttatcagatacatgatttataaatattttcttccattctgttctgtggggttacttttttttttttttttgagacagagtcttactctctgtcacccagactgtagagcagtggcgcaatcttggctcaccacaatctccagctcccaggctcaagcaattctcctacctcattctcctgagtagctgggattacaggcgcttgccactactgcccagctaaattttgtatttttagtagagacggaatttcaccatgttggccaggctggtcttgaactcctgacctcaaatgttccactcacttcggcctcccaaagtacraggattataggcatgagccaccatgcctggcctttactctgtttcttttctggcttttttttttttttggggacaaggtctcactctgtcccctaggctggggtgcagtggcgcaatcatggctcagtgcagccttgacctccctgggctcaagagatcatcccacctcagcctttggagtagctgggactacaggcacatgtcaccacgacactcgaattttaagatttttgtagagacagggtctcactatgttgcataggctggccttgaactcctgacctcaagtgatcctcctggctgggcctcccagagtgctgggattataggtgtgagccaccatgcctagcctggccaccattttactcagttgatagtgtcttttgattaacaaaagttttaaattttcagccagtctagtttgtccattttttcttttgttgcccgtgcctttggtgtcatactcaacaaataattgccaactccagtgtcatgaagcttttcccttttgttttcgtctaagagccttatagttttatgtttcttagttatggttttatagttacaagtttaggtttcttaggtctttgatccattttgagttaatttttgtttatggtcaaaattcaatcttttgcagatggattaccagttttcccagcgccatttgctgaaaagactgtcctttccctattgaatggctttgtcatccttgttaaaaattatttgaccacatatgtgagggtttatttctggtctgtttgattccattggtctgtctgtatgtatttatactaataccatactattttgattactgtagcttttttttttttttgaaatggagtctcactctgtcgcccaggctgaagtgcactggcacgatctcagctcactgcaagctccgcctcccaggttcatgccattctcctgcctcagcctcccgagtagcctgggactacaggcgcccaccaccacacccggctaagtttttgtatttttagtagagacggggtttcaccatgttcgccaggatggtctcatctcctgaccttgtgatctgcctgcctcggcctcccgaagtgctgggattacaggcatgagccactgtgcccagcctgattattgtagctttgtagtaagttttgcgactaggaagtatgagtcctccacttttgtttttctttgtcaagacttttggctatttggggtctcttgagattccatgtgaattttaggattgattttggtatttctgcaaaaaatgtcattggaattttgatagggattgcattaaatgtttagattgctttgggtagtgtggacattttaacaacagtaaggccaggcacagtggctcatgcctgtaatcccagcactttaggaggccgaggctggtggattacctgaggtcaggagttcaagaccagcctgaccaacatggtgaaaccctgtccctactaaaaatacaaaaattacctgggcccagtggcaggtacctgtaatcccagctactcaggaggctgaggcaggagaatcgcttgaacccgggaggcggaggttgcagtgagctgagattgcgccattgcactccagtctgggagagagagcgagactccatctcaaaaaaaaaaaaaaaaaaattaagtcttttggtctgtggacatagaatgtgtttctgtttatatatttctaaatttctttcagcaatgttttatagttttcattgtacatgtctttcacttctttggttatgtaattccttagtactttattctttttgatggtattgtaaatggaatttttaaaatttccctttagattatttattgtgtttagaaatgcagctggtttttcgtgtgttgactttgtgtcctgctactttgctgaatccattttttagttgtgtgtgtgtgtataatctttagggttttctacatataaaatcatattatttgcaaactgagataattttacttcttcttttccaattgagatgcgttttgtttcttttgcctaatggcgttggctagaacttccagtactgtgttgagyagaaatggtgaacacaggccgggcatggtggctcacgcctgtaatcccagcactttgggaggctgaggtgggtggatcacctgaggtcaggagttcgagaccagcctgacgaacatggagaaacgctgtctctactaaaaatacaaaattagctgggcatagtggcctgtaatcccagctacttgggagggtgaggcaggagaatcgcttgaacctgggaggcggaggttgcggtgagccgagatcgtgccattgcactccagcctgggcaacaagagtgaaactctgcctcaaaaaaaaawaaataaataaataaataaaaagaaatggtgaaaacagacatctttcccttgtcttgatgttagaggaaaaggttttcatttttatcattgagtatgatgtctactgtaggttttccttagatagcttttattatattgaagtagtttctttctattcctagattgttgagtgtttttatcatgaaagggtattgaattttgtcagattcttcgtctgcatcaattgagatgatcatgtggtttttcgttttgtttggttaatgtgtgttacattgatctgttttcatatgttgaaccatccttgcattccaggaataaatcccatttgatcgtggtgtacaattctttaactgtgctgctgatttcagtttgctagtattctgttgtggatttttgcatgartgtttatactattttcattttaagcctcagcctcccaggtagctaagcatacattcagtgacattaaatttatttacattattgtgcaactatcaccaccatccatttccagaacatttccattttcccaagctgaaactctgtacccgtcaaacaataaattctcattttccttgcttcctaacctctagcaaccaccattctactttatttctctatgattttgactgctgtaggtactgcgtatcagtagactcatataatatttgttgtgactggcttctttcatatagcataatgtcttcaaagttcatccatgtcatagcatgtgtcagaattgtctacctttttaaggcagagtagtagttcattatatatatgtcccacattttgtttatccattcatctgttggtggatacttgggttgccttcacattttggctatcgtgaataatgcttctttgaacgttgatgttcaaatacctgtttctgcttttggttatttgggtgtatacttagaataggaattgttggatcattctatgtttaattttttgaggagttgtcatactgttttttcattttcttgagtgtgctcattgaaatacaaaagttttaaatttgatgaagtcccatttatctcttttctttagttttctttgctttaagtgtcatacctaaaaaatcattgttgatccaagattatgaagatttactcctatgttttcttctaacagttttacacttttagcttctacatttaggtctttgatccattttgagtttttttttttaatgtgatatgatgtaggagtttctttcttttttttttttgagacggagtctcgctctgtcacccaggctggagcgcaatggcgcgatcttggctcactgcaacctctgcctcctgggttcaagcgattctcctgcctcagcctcccaagtagctgggattactggcgcctgccaccatgttcagctaatttttgtatttttagtagagatggggtttcaccacattggccaggctagtctcgaactcctgacttcaggtaatccactgccttggactcccaaagtgctaggattacaggcgtgagcccccgtgcccagcctgatgtagaagttttacttcttctttttttttttttttttttaagacagagtctcgctctgtggcccaggctggagtgcagtcgcgtgatcttggctcactgcaacctctgcctcctcctgggttcaggcaattcttgtgcctcagtcaccctagtagttgagattacaggtgtacaccaccatgcccagctaatttttgtatttttagtagagacagtgttttaccatgttggccaggctggtccctaactcctggccttgggtgatctgcctgcctcggcctactaaagtgctgagattacaggcgtgagccactgcgtctggccagtgtattcttgtatttgaaaaatttctcagttttaataatcttaacgatgcatgtatcaatagatataacacacaaagacaaaggttctttggatcctcagtattttaagagtataaaggtattctgagaccaaaaagtttgagaattactgatttaggcttagagacatactctagtacataaacttggaccaaaaattgggagtcatgtttcttgtagtcatataccagtcccatttgtgttatcttaggcaagtcataaacagggtgcctcattaatgtataaaatggaaatactgcaagactctaattatagtaacttcacaaatgtgtaaggataagtgaatgggcatgctagacaggtagtgtttgtcttttttttctttctttctttctttttttttttttgagtcggagtcttgctctttcgcccaggctggagtgcagtggtgcgatcttaggtcactgcaatctctacctccccggttcaagtgattcttctgcctcagcctcctgagaagtcggactacaggtgcatgccaccacaccctgcaatttttttgtctttttagtagagatggggtttcgctgtgttgcccaggctggtcttgaactcctgacctcgtgatccacccgccttggcctcccaaagtgctgggattacaggcatgagccaccgcgtccggccatttttttttttttttgagacagagtctcgctctgtcacccaggctggagtgcagtggcatgatcttggctcactgcagtctctgcctcccgggttcacaccattctcctgcctcagcctcccgagtagctggtaacacaggcgcccgccaccatgcccagctaatttttttgtatttttagtagagacagggtttcaccttgttagccaggatggtctcgatctcctgacctcgtgatctgcccgccttggcctcccaaagtgctgggattacaggtgtgagcctgtagtcccgcgcctggcctgttttttttgtttttttttttttaagacggagtcttgctcttgtcacccaggccaaagtgcaatggcataatcttggctcactgcaacccccgcctcctggttcaagtgattcttcttcctcagcctcctgagtagctgggattatagacgtgagccaccactcccagctaatttttgtatttttggtagagacagggtttcaccatgttgtcaggctagtctcaaactctgacctcaggacctctgaggtcatgagcatttcaggccgcctcggcctcccaaagtgctgtgattataggcatgagccaccgcgccctgcactgccatctttttttaaaactgaaaatttgtaagagctccgggactttttgtaggaacttgtggcattgttaatgtgtcttgaacattgctttcccccccatacctgtttcctcaaagccaggaaattatatccatagtttactacctactgtctattcttcgttctcttgtgagactggtgtcctgctggctatatttcttatctgtcattgtcatttcaatctgggaatctgtaggtcacccctttatattcactgatactttggtgtaattcctgacatccatattgggcagtgggaagcataacattgaatgttatctgacactttatttccttaatttctatcttctagtgatattcaactctactttccttgatagctcctattcatatcattcaaaatgattcttcccaccaaaattttctgaattatctgtatatgtatttttaatgtttctttagtttttttaatctatccctaatttcactgtaaagcctctttttggctttatcctttcccttcatcggcatgattactgttgtgttccttaccctattgaaatagtgattctgtaacttcgcaacccagtacaaattatctccaaattgtataactagtggtggttcacatctgtaattccgggattcctttgggaggctgaggtgggagaattgtcttggtgcyctaaagtgttgggattacaggtgtaagccactttacctggcttcaacactctctttaacttggtggtaagtaaggcaggaatgaaaggaaaaggagatatgaattgcactatctttccctttccttctgcatcatcatttttagaataaatgtttaattcagggaagtaatattagtaaggaaagatatgataggattctttgatcattcatgtttttttaatcttctttttcatttttcttttttttttttcttttcttttctttttttttttttagacagagtcttgctctgttgcctaggctggagtgcagtggcatgattgcagctcactgtagccttcacctcccaagtgcaagtgatcctcccacttcagcctcctgagactgggactacaggtgcctggctaattttttatattttgtagagatggagtctcctgtgttgcctaggctggtctaaaactcctggactcaagcggtcctcccagcttgtcctccaaaagtgctgtgattacaggcatgaaccaccgcacccagctccctttttttttctcagttgccaaaacaagagcatttatttgtctttcatgttacatgcccattggggatagaatgtatattctgctgatgttggatagagtctttatatatctgttaggtctaattattttattttatttttttgagatggagtcttgctctttcgctcaggttggagtgcagcgatgcagtcttggctcactgcaacctccacctcctggattcaagcggttcttgtgcctcagcttcccaagcagctgggactatgggtgtgggccaccacacccggctaatttttgtatttttagtagagacggggtttcaccatgttgcccaggcttttcttgaactcctgacctcaagtgatctgccccctttggtctcccaaagtgctgagattataggcatgagccgccatgcccagccagtctaattagtttgtttgtttatttatttatttattcatttttgagacagttttgctcttgttgcccagactggagtgcagtggcccgatctcagctcacagcaaactgccttctcggttcaagcgatcttcctgcttcagcctcctgagtagctgggattacaggcacgcgccaccatgcctggctaatttttgtatttttagtagagatgggatttcgccatgttggccaggctggtcttgagttcctgacctcaggtgatccacctgccctggcctctcgaagtgctgagattacaggcatgagccaccgcgctgagccagtcaaattagtttatagtgttacacaaatcctctgtttcctttttgattttctgtctggttgttctgttattgaaaagtggggtattgaagtctcctaagtatgattatagaacaatttctcttttcaattgtgttaacttttgtttcctgtattttaggtcactgttgttaggtgcatatgtttataactgttatatgtccttgctggattgaaccttttatcaatatataatatctatctttgtgttttgtaaccttttttgacttaaagtgttattttatctggtaataatttagccccagctctctctttgttactctttgcatggagtatctgttttcattttttcttataacgcctttgctctttgtatctaaagtgaatcttgtagatagatgatagattgtgttttccaatttgccaatctctctcttttttttaatttttatttatttatttattttgagatggagtttcactattattgcccaggctgctggagtgcagtggcacaatctcggcccactgcaacctccgcctcctgggttcaagcgattatcctgcctcagcctcccaagtagctgggactatgggcgcacgccaccatgcccggctaattttttgttagtagagacggggtttcaccgtgttagccagggtggtctcgatctcctgacctcatgatccgcctgccttggcctcccaaagtgttgggattacaggcgtgagccaccgcgcccggcctattttttaaaatttaatttaatgttacttttttgagacgaaactcttgttgcccaggctggagtgcagtggcacagtctcggctcactgcaacctccacctcctgggttcaagtgattctcctgcctcagcctcccaagtagctgggattacaagcacccaccaccacgccctcttattttttcgtatttttagtagagacagggtttcaccatgttctccaggctggttgtgaactcctgatctcaggtaatccacctacctcggcctcccaaagtgctgggattacaggcgtgagccaccacgcctggccaatctctctttttaattggaaagtttaattcatttacatttaaagtaattactggtaaggatggatttacttctgccatttagctctttcttttccatatgttttttatgccttttgttcctctaatgctgcctttttatgtatttagttgattttttatagaattataatcctgttttgattttgtgtgtgtgtgttactttcttagtggatgccttggggataatgatgtaattaacatcttaaatttataacaacctagtttgaataatgccagcttagtttaaatagtacgcaaatactctgctcctactcatctttctctcctcctttatatttttattgtcacagattacatctttatatagtttgtgcctattaacagaggtttgtaatgaatttttatgcatttgtcttttaaatcatgtaaaagggaaaaacccaagagttaccaaaattacaataacattggcttttatatttacctatgtagttatttttactagtgttctttatttcttgttatggatttgaattattgtctaatgtcttttcatctcagcattaagaatttcttttagcacttgtacggcagaatgaactttctcactttttgtttatctggaaatataatttctccttcattcttgaaaggcggttttactggctagagaattcttagttcacagcttttttcttttaggacttcaaatatgtcactgcattgccttctcatttccatggtttcttatgggcaatcagctgttaacttttgtttgatgagttaaattttcttgcttctttcaaagttctctttggttttgacaatttgactctgtctcagtgtggatttctttgagtttacgctgcttaaagtttattgagctttgtggaggtatatacttgtgtctttcatcagattggggaagtttctgaccattgtttcttcaaatattttttctacacccttctctttcttctttctgtgactcctattatgcatatgttggtacgcttggtagagaagaaaatgaacagtattgcccagggaacaaaatgccagagaacaaaaaatacagagggcagaaaaaagtttgagaaagaattttagtgttctgaatattagtggtctttagaaatatgagattataactatgaaacaagatcagagtgctgtgaaaaggaataattagagagagttcttagaaataaaaatatgatagaagagttggaagatagagttgaggaaatcacctaggaaggagaacaaaaagaaaggtggaaaaatggagagaaaagataagaaaattggagaatcaatttaggaggcccaagtctaattaataggagcaatagaaagagaacagaaaagatgaaaaggaggaatttatagtagatagaagaaaaaaattttacagaagtgaatgatgtgaattactgatgaacagagccagctgactatgcaacaagatgactatgcaacaagatgaatgaggagatatctacagcaggcttattgcttggaaatttcagaataccaaagcaaagagatcatcctagaagttttcttagagaaaaaaacaggtcagtaaaaaaggtaaagaataagaatggcataattttctcagtgctagtcccagaaactagaaatcattgaaaacattttgaatgaataatttctaacctagaattttattttatttttttggggacggggtgttgcactgtcgcccagcctggggttcagtggtgccatcacggctcactgcagccttgacctcctgggctcaagtgattcttccacctcagcctcccaagtagctgggaccacaggcatgcgccaccacatttggctgatttttgtttgttttttttttttttgtagagacagggttttgccatgttgcctgagctggctttgaacttctgaactcaaatgatcctccygcctcaatctaccaaagtgctgggattgcaggcatgaagcaccgtgcctggccctaacctagaattttatacctaactaaatgaggtgtgaagatacaataaagatatttcaaatatgcagttttataaaatttacttctggttggagtttacgggggtccaataaatagcaccccttttgctttcctgaattttcaacaaattgggtgaaacgaaggaagcatatggagaccagaagataattttatttttatttagtttttataattttatttttgatcacgttcagtttggagaaggcggcttatactttcaactggtttactgataccgagtgccagaattaggcagacttagccctcaggaactggcagagctgaacaactgcaggccctatgtgagccttacacctgtaaatgttagagtatgatggaacagaatgggaaggagaggggacggggctaagttttgtctggattattttcccaaactcactgatgaagtaagttacctcttctccttaggcaaggaatgaatgaggggagtggaaagaggtcagggatgttatgataacgggtatccgtctacatagaatgaaatatcgaaagtgggacataattattttcttcaatatctttcatgttttcttcctttttttgagactgagtcgcacactgttgcacaagttggagtgcagtggtgcaatctcagctcactgcaatctccgcctcccaggttcaaacgatttttgtgcctcattctccccagtagctgggattacaggtgtgtgctaccacacctggctaaatttttttgtattttaatagagacgagatttcgccatgccaggccagtcttgaactcctggcctcaagtgatctacctgccttagcctcccaaagtgctcggattacagccgtgagccactgtgcctggcctcatgtttcctttcttagaaagctgctggagggtatgttccaccaaaaacaagggaataaatcatggaagagctaaaaagaagagtcagcatgagagagcgtaagggaattggtaggatgatagtgaaaggaactctcagtataacgacaactgtagtgaaagtatagtaacgaccagaaagctcccaagaagggatatccaaggagagaacagcaacaacaaaaccaaattacttgatgtgtttgatcttactgagaagatatttatagttctgtcaatgaattattgataggtatgtagaagaagcttaagaaaaatgaagtgattaatttcaggtaaaactgaaaagtataccaaaagggaaatgtgattaagtatatatatttcttaagtcaaaagctagatccagtaatagagtggcttaaaaaacaaagagttttattcctttctcatataatagttgctgggtaaatggtcaggaaatctagatgagtagtttgttccatgtggtcattcaggggcctaagttacattgatcctgctgtctcaccaaaagtatggccaaggactagctgagtggacatgacctgggtttgtttgaaatgcagaatattggaacccactcccaatctactgaatcagaatcgcatttagttgtttattcctatacacaaaagtttgggactcactggtctggattagaacatgatggttgaatgattgaagcggggcagttgaaaattttattcagtgagaagagaaagagagcatgaggaagtgagaactttatcagaaggccacatcagactgcagagaagtttgtgaaatgtagactagtcatgtgctcaggaaaaaggagaaagttaatttttagggacatttaggaaactctgtgctacagtatagttggcttaactgtgaataatattggcatatcttattaaaatcatcctaggaggatggtggtagggtggggaggtacttacgttgcacagttatgtatgtttttaaggggaatatttgagatagctaaatccatacctttcatgtaggaagttagcagataatagstaaggccgggcatggtagctcatgcctgtaatcccggcacttgggtaggccaaggcagcaggatcgcttgagcccaggagttcgagacagcctgggcaacatggtgagaccctgtctccataaaattttttaaaaaattgccaggtgtggtcgtgtgtgcctgtgaggctgaggtgggaggctygcttgagcccaggggtcaaggctgcagtgagccatgactgcacgccactgcactccagcgtgggtgacagagtgagatactgtataaaaaaaaaaagctaaaacaaaacaagaagtattatcttaagcatgttatttagaaatatggagataaataaaaataactgaaagtaggtagttgcttctgaggagagaaattgggagttggcaagagagtactgtttttcaaccatgtaaatgtatttgttttattaaaaacagattagaggcaggsgtggtaatcccagcmctttgggaggccgaggcgggcagaacatgaggtcaggaccatcctgaccaacatggtaaaaccccgtatytgctaaaaatacaaaaattagctgggcgtggtagcacacgcttgtagtcccagctactcaggaggctgaggcaggagatttgcttgaacctgggaagtggaggttgcagtgagctgagagtgcactccagcttggcagcagagtgggattctgtctcaaaaaaaaaaaaaaaaaaaaaaaaaaaaagatgagaaaagacagtctctactgttcagataggaagtaaaaacataaataggtttaagtgctaagtgctgtgagaaaagtaaaaagagttcattaagaagaggcatacttatctgagcccaccctgggtaagagggtggaggagtaggttatggaaagctttctgaaagagagacatttcctagttatattgtagacaacataaagtatgatgcaattaaacatcttttggatttcatgtatttttaaagtgtgaacaattaaaaataattcagattactttaaaaaaatccatttaacccatttattgggtgcctrctttgtattaggcactgtggtatgcccagaagatgtaatgataagcaaaatcagaaatgatttcttacctcatagacttgagaatctcatggggagactgacacgaatcagattgttcactgtaagactgtacagaagtcccttcatttctgctttcaggatcactttcaggatcacttyttacagccatggttcattaagtgtggccccccagtccagccacatcagctgggaggatcgtcttagcccaggaattygaagctgtagtgagttagaatggcatcactgcaccccagcctgggtgacacagggagaccctggctytgaaaaaaaaaaaaaagtactttttcttgataattattaagatatagttggttatttaaggttagaatttcatttaatacccatttaccacattctaaaaatgtaaccaagaactagaggttagttctgataatatttttttccatgatttgaggttatttgaattctattatttttatttgtttcaaccaagtaaagtgtgcaggggaagcagtgagccttcatttcttttctttttttgagacaagttctggctcttatcacctagcctggagtgcagtggtgctatctcaggtcactgcaacctctccctcctgggctcaagccatcctcctacctcagcctcccaagtagctgaaactacaggcgcataccaccacacctggctaatttatgtattttctgtagagacagggttttaccatgttgcccaggctggcctcgaacttgcgagctcaagcaatcagcctacctcagcctcctatgcagctgagattacaggtgtgagtcactgttcccagctgagccttatcttcaaaatactctctcctccgagagaacttcgtttctaggaattacatctttttggggaaaattttgtactcttgatagcttcaaagaaaaaattgaaaatagcaattttgtgataaaatttttgaggcaataagacattggctactcttacaagaaaagatgtgggggtgattatcgttaattataacttaattgtacttttacaaataaagagtgtaattggattgtttgtaactcaaaggataaatgcttgaggggatggataccccattctctatgatgcgcttgttttacattgcatgcctgtactggaacatctcttgtaccccataaatatatacacctactgtgtacccttaaaaagtaaaaaataaaggtgaggaagatgagaaaatacagtctttttcataacacatattcctattagcaattttttttttttttttttttgagatggagtctcactctgtcacccaggctggagtgcaatggcgtggtctcggctcactgcaacctcctattagtaatttaaatgtatttttagttatatgaaaaattactcaaagtagctgacgcagtgactcatgcctgtagtcctagcagtttgggaagccgaggcaggaggattgcttaagctcagggcttcgaaaccagcctgggtgagatagcgaaatcctgtctctacaaaaaatacaagaattggcttggcatggtggcacacacctgtagtcccagctagttgggtggctgagatgggaggattgcttgagcctagggaggtcaaggctgcagtgaaccgtaattgtgccactttaccccccaacctgaacgacagagcaagaccatgtctcaagaaagaagaagaagaaaaagattactcaaaatgaaaacctgtcaattttctgagcctgggactctccgggtacattgatctatattaggtacattgatttttttctttttttaatctttgtagcttttgtttatgtatacaaacttgatttatggagtattttttaagtggatgaataaattgtctaaaatgttttacaagcaaaattgtgaatcagcattgttatttcaaatctttgttgttttatggcttttgtcagatgacatctacaaaattattaaagaatcgttatagcagactagcattaaaaatttaaagatattttggttactagacaaggtaaaactaatcttttagaaatataactcattttaatttttgaaacagagctcattttagttgttaaagtgaggaacctgcagcagttctcacaagaatttagaaatagtcatatgttttgacaacttttctgacagttatgtaaaacaccttatcaagaataataaaagcaaaatgtattaattaaacaaattcatatgtataaaaattaggagcaaaagcattcttttgcagttgtaagtttctatagcttttactggaaaatgttagtcaaaatattaatggtgaaaatgtagtgtggtttaaaattttttttaattaaaaaatttttaaatatactttgctagactccaactgacaccatatctagtgtggttttgactttagttttcattataataatttagaaagaagaacctaatacatttttaaagtaaaagacagtattactctggaaaagcaaggcagagaatgtagaggactgcactataaagaagaattattggccaagtgtggtggctcattcctgtaatcccagtgctttgggagactgagatgggagggtcacttgaggccatgagtttgagacaagcctgagcaacatagtgagactttgtctctacaacaaaaaaaaattagccaggtgtggtggtgtgcgcctgtgttcttagttgcttgggaggctgaggcaggaggatcatttgagcccaggagttccaggctgcagtgagtgattattaaagagtgaactctttattttaggtaggatttttttgtttatatgatgtaaagttatatgatagagatgtttacctaaatttgtaatttagtaaatcaaccaagtaaaatcaaagatggtacattttaattctatgcagtttgcttttgctggcagaaggactctaatttttattcatattattaatgtttgtttagaaacggatctgaatttaaggtgtatagggcaaagtgaatagtaaaaaacatcctgattttttaataaaatcactttttttttttttttttgagacagggtctcactctgttgcccagactggaatgcaggaatgcaatcttggctcaccgcaacctctgcctcctggtctcaagcgatcctcccacctcagcctcctaagtagctgggactacaggcgcatgccacagtggccggctaatttttgttttctttgtaaagatggggtttcaccatgttgtccaggctggtcttgaactcctggactcaatccgccagcctcggcctcccaaaatgttgggattacaggtgtgagccatgtgcctggccttgacattattattattattattattwtttttttcgagatggagtcttgctctgtcacccaggctggagtgctgtggcgcgatctcagttcactgcaacttccgcttcccgggttcaagcaattctcccgcctcagcctcttaaataggtaggattttacaggcgcccaccactgtacccggctaatttttgtatttttagtagagacggggtttcaccatgttggccaggctggtctcgaactcctgaccttgtgatctgcccacctcggcctcccaaagtgctgggattacaggcgtgaggcaccatgcctggctgacattattttttagaacacttttaggttcacagcaaaattgagcagaaagtgcaaagttgccatatataccctgcatccacacatgcatagcctcccccactttcaacatctggcaccagagtagcatgtttattacagtggatgaacctacattggcccgcattgataccttatcacccagtgtctatagtttactttagggttcattcttggtaatgtgcattttgtatcattatacaaatgtgtaatgacagatattcactattatagtgtcatagagattattactattacttttgtttttttttaaactcttaagttcctttttgttgttgttgtttttgagacagagtcttactctgtggcccaggctggagtgcagtggtgcgatcttggctcactgcaacctccgcctcctgggtcccggttcaagcaattctcctgcctcagcctcccgagtagctgggattacaggcatgtgccaccacgcccagctgatatttgtgtttttagtagagacagggtttcactatgttggtcaggctggtcttgaactcctgacctcgtgatccgcccgccttggcctcccaaagtgttgggattacaggcatgagccattgcacccggcccctgttggtttttaaagtatacttcagcgaattcatttgaacccgtttttacttcaaggtggagaaagtctattgttttcccatatttagagagtcaagtttgaggtaagttcgaggtaggctagaggtacaaatagatgctagttggtggtaaagtcttgtgggcaagattttaccatttaggattccataaacggattcatttatagcacataaagattgggattctccatctttgagatggagtttcgttccttcttgttgcccaggctggagtacaatggcatgatcttggctcactgcaacctctgcctcccgggttcaagtgattttcctgtctcagcccctgagtaactgggattacaggcgcacgccaccatgcctggctaatttttgtatttttagtagaggtgggattttatcatattggtcaggctggtctcgaactcctgacctcaggtgatccacccaccttgacctcccaaagtgctgggattacaggcatgagccaccacacccagccaagattggaattcttgtgttttctttattctgtttcctttcatgttaattgtgatacattcaattgcaagttttagttttctattgaaattcttaaagaaatatgagacaacctttacttctaaaattctttattttggtgctgttttaccacaattacattagaattcccttgatgagcatttggctatttacctagtgcactgtaactccttctcatatagttttctgagttttgtctttttttttttttttaacaatttcttcagtttttagaacaagtttaaaaaattgttttttaatgtctaaccataaaaaattgtttttgcattttaaataacagatttttctcttttttttaacccaatagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccrgtgaaagccgaaaaggcaaccatttcacaggcaaaatcagaaaaggcaaccagtttacaggcaaaagcrgaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaartgtgctctgcaaaactcaccacgatctcagaagcaacagacatgtacagataatactggtgattctgatgatagtgcttcaggaattgaagacgtatcggaygatttaagtaagtcattttttggagggatttttgtatattaatgttctttagattatccccggkttaaccattttaattacaaaaagtcatgtttatacataattgttyagcacttttgttcccgtatgaaaacatccacattaataatacttgcattaatggtttcttactagattgatccttggtgaagctaaaaaaaaaaagccttttcatttattatggtaggtacaaagactgtgcaaataaaaatttagtatcttctttagttggtacacacatgctcgtacacatacacactcttgtttaaatggtcttgataaggtattgctcattcattcaccaaatatgtatgtattgagttcttcttatatatatatcaagcatttgtttacaatggaaaaccaaaacaaacaaacaaaaaaacccatagccctaaacttcaaggaagcttccagtctgataggagggtggtacagataaacaatgattttcagtgccaaaaacttaattgaagttgagagagcacatgattaaatagtgagatttagactttgggcagacaaaataggtgatataaattgtgagactgagtattactgagacttagtacggctggagcagaaagttgaggttgagaacggcaaaagatgcagctgaaagggaacacaggaatatcagggccttctaagccatgccagaaagtttggactttatcctgagtattttcagaagccattgaagaatttttttttgttttttgttttctgagacagagtcttactgtgttgcccaggctggagtgcagtggtgcgatctccactcactgcaacctccgcctcccaggttcaagcaattctgtctcagcctcctgagtagctgggactataggcacgtgccaccatacctggctaacttttttatttttagtagagacgggatttcaccatattggccaggctgttcttgaactcctgaccttttgatctgcctgccttggcctcccaaaatgctgggattacaggcatggaagagtttttttttttttgagatggagtctcgctctgtcacccacgctggagtgcagtggcgcaatcttggctcactgcgagctccccctcccgggttcacgccattctcctgcctcagcctctccgagtagctgggagtacaggcgcctgccaccaagcctggctaattttctgtatttttagtagagacggggtttcaccgtggtctcaatctcctgacctcgtgatccgcctgcctcggcctcccaaagtgctgggattgcaagcgtgagccactgtgcccggcctttggaagagttttaagtaaagtaatgctgtgatcagatttttaaaaaaatccttttgagtataatgcaggaaattctttgataggaacaggactggaagcagggattggttaggacacttagagtttactttgagaactgttgtaaaattcattttgttgtgggatcctgattttagttttaattgtttagaaatattgtctatgtcttttgagtaactttaatcctgattttgtttaaattaaataatttcttttataatctttttttcctagtgttttcatggctggaaaaatacagcgttatcttgatgtagaaataaaaagaacctatttctgaatcattatttgccacactttgagaaacactggtaaagaattctgaaatagcttgtttttatttcttgtggtacacagatgatggtatatcgacagacttaaaagaattttaatagagttgactttatgtgtctcagtctcaattgtatattaaggctgagggcaaggccaaatttaaaaactaagtcagtttagagacagaatyaaataagtgataatactggtaatgtttagatatgggaaaaatgtaaacatcatggtacttgaatgattcaggaaatagtggtggtttttttttttgttttggtttggttttgtttttgagacagggttttgctctgtcaccccggctggagtgcagtggtgtgaacttggctccactgcaacttctgcctcccacgttcaagcaattctcctgcatcagctgggactacaggtgtgcgccaccatgcctggctaattctatatttttagtagagactgggtttcactgtgttggctaagctggtcttgaactcttggcctcaagtgatacccccaccttgacctcccaaagtgctgggattacaggcatgagccactacaccgggccagtaaatagtggtgtttaaggtcacttaattggccaggcgcggtggctcatgcctgtaatcccagcactttgggacgccgaggtgcatggatcacctgaggtcaggaggtcgagaccagcctggccaacatggtgaaatcccatctctactaaaaatagaaaaatcagccgggtgtggtggcacatgcctgtaatctaagctactcgggaggctgaggcaggagaattgcctgaaccaaggagatggaggttgcagtgagccaggatcgcgccactgcactccagcctggatgacagagcgagagtctgtctcaaaaaaaaaaaaaaaaaaaaaaagatagttaagggtcttgttatttgaattggtgaaaaacatgatttaaagattatttattttttgagacagagcttcactctgttgtccagggtggagtgcagtggtgtgatctaggctcactgcaacctctgcctctgagttcaagcgattctcctacctcagcctcccaagtagctgggactgtaggcgcctgccaccacgcccagctaatttttgtatttttactggagatggggtttcgccatgttggccaggctgatctcagactcctgacctcaggtgatccgcctgcctcagcctcccaaagtgctgggattacaggcatgagccactgccctggccaaagattattttcttttaaagtcaacaaaataattgagatgacatagagagatagttaagaatatgggctctggagtgaaattgcatgggttttgaattccagcttctttacttactttgtaaccttcaataaactgcttatcactgaaaaatatgttttctcatttttaaaaaagtggagatgctgctgcctatgttatgaagattaagtgaaataatccagtagagggtttcatgtagtaccggacacgtgggcatgcaatggcaatgactatcacttattatattactccaattaaatgcagtttttacttgttaacatggagaatgagttgaactagtttcaggaagctagcttaaggaagctagtagaccaagtagaggttcttttgggaaacttggtataacaaattaataaaaatgatttgtagtatacagtcatttttcataagtaagtgcttctcatgttttaaagaattctctttaaattcatgtataatatgatatgtatagtattagccttgaagtcatgtttatacgtaattgtttagcacttctttttttcccatatgaaaacatccaaattaataatgtttgaattaatgatttcttattagattgattctcagtgaaataaatacagtaaaacctttatatctagatcattatctttttttttggagacagagtcttgctcttttgccctggctggagtgcagtggtatgatcttggctcactgcaacctccacctcccgggttcaagtgattctcctgcctcagcctcctgagtagctgggatttacaggtgcatgccaccacacctggctaatttttgtatttttagtagaaatggggttacaccatgttgatcaggctggtcttgaactcctgaccttgtgatccacccaccttggcctcccaaagtgctgggattacaggcgtgagccactgtgtccagctgtcttttttttgttgttttttgagacagagtcaccctgtcacccaggctggagtgcagtggcgcgatcacagctcactgtaacttctacctcctgggcttaagtgattcttgtccttcagcctcctgagtagctgggactgcaggcgtgtaccactacacccggctaatttttgtatttttagtaaagatggggtttcaccatgttagccaggctggtcttgaactcctgacctcaagccatctgcctgcctcggcctcccaaagtgctgggattataggcatgagctaccatacatggctagatcattatctatttggacttgataggttatatagaaatttgattgatctcagtcttctccattaggcctaacttyagctcccacctggcacatcatttttctttttgtcatttattcattcattcaataaaattttgttttttggtgtccactacatgccaggaactgaactagtcattaggaatatataagtgatggaaccgataattccactcttatggagttaatcttctagtgggatgaaacagataacaaacacaataaataagaaaaatatgtagtaagttggccgggcacggtggctcacgcctgtaatcccagcactttgggaggccgaggcaggcggatcacctgaggtcaggagttcaagaccagcctggctaacatggtgaaatcccgtttctactaaaaatacaaaaaactagccaggtatggtggcgtgtgcctgtagcaccagctactcgggaggctgaggcaggagaattgcttgaacctgggaggcggaggttgcagtgagctgagatcgcgtcattgcaccccagcttggacaccaagagcgaaactccatctcaaaaaaaaagaaaataaaatatagagagtaagttaagtaaggtggttttaaatcctttgagaaaaatgaaataggaacgacatagggaatgatgctactgttggtattggtggagttaaagtgtcaatgagaaagtgacattagagcaaatacttgaaggaaagaggtgaaccagccaggtgaatatttgaggagagagtgttcttgatctgggtttctcaaactttaatgtgtatatgaattgtttgggattcatattaaaatgcagagtcttgggtctcatttccagagtgttttgattcagaaagcctaggataaggcctgataaattggatttctaataagctcccaagtgatgctgatgctgctggtcaagataatgctttcaagcagcctgcaccaactcatcttactttcacttacatcacccttcattgtgttttcagtatagtaagcagaatgatcctgttaaaatgagtcagatcacattactagtatttagagtgtttcagtggctttccatccatcagagtaaaagctagtgttcttacagtggctagtagagccttacacgatctgtgacactcccctatttctctgccttgccctcatttgtttacttctcaccctttctctctgctccatccgcatagttttcttgaatttcctcaactgagaagatagatatccatatgaggaactttgcatttgctttttcctctgcgtcaaacactcattccccaaatgtccatatggctagctctcttaaacttcctttgccttctttttttgagatagggtctcactctgatgcccaggctggagtgcagtggcgtgatctcagctcacttcaaccaccgcctcccgggttcaagcaattctcctgcctcagcctcccaagtagctgggatttatatgtcataaaattcatccttttaaagtatatacttctgtcttgctgttgggtcaattttttttatttaaaaaatctaagtattcaaggccaggtgcagtggctcgcgcctgtaatcccagcactttgggaggcagaggcgagtggatcacctgtggtcaggggttcgaaaacagcttggccaacatggcgaaaccccgtctctactaaaaatacaaaattagctgggcgtggtggcgcatgcctgtaatcccagcttcttgggaggctgaggcaggagaatcgcttgaacctgggaggcagaggttgcagtgagccgagattgcaccactgcactccagtctgggcaacaagagcgaaactccgtctcaaaaaaaaaaaaagaatattttactaaaaatctaagtattaagtgttcagtagtttttattatattcacaaaattgcgctgccatcactatctaattctgaacattttcatcactctacaaagaaactccatacccattagcagtcactattcattacccgctcctcctccccactgacaaccatgaatctactttctttctctttagatgtacctattttatataaatgaaataatacaatatgtggcctgttgtgcctgccttatttggcttagcatatttttttcaaagttaattcatgttatggcatgtattagtacgtcattcccttttattgccgaatagtattgcattatatggatatattacattttgtttgtccattcatcagttgatggatatttggattgtttccatcttttgattattctgaataatgctgttctgaacatttgtgtaaaagtttttgtgtggatgtatgttttcattttttcagtatatatatttagaaatggaattgctagttgtatgctaactctatatttaagttttttggtgataaatacatgtaagattttaccatcttaaccattttaaagtatacaattcagtgacactaagtacattcacagtgttgcacagtcataactagtgtctaatttcatcatcccaaaaggaaaccccatgcccattaagagttactccccattccccactttccccagcctctggcaactactaatacactttctgtttctatgtatttgcctattctaaatatttcatagaaatgaaatcatacaatatgtggtcttctgtgtctggctttcatttagtgtcatgtttttaaggtttatccatgttgtaacgtgtatcagtacctcattcctttttaaggctgttgttatggactggattatgtcccctcccaaattcatatgttgaggccctaacctccaacataattgtatttggaaacagggctttgaggtggtaattaaggttaaatgaggtcataatggtgaggtcctaatctggccttataaaaaaggagaagagagaacctctgtcctataaggaaaggccatgtgaacacacagcaagaaggtggctgtttgcaacccaggagagagccctcaccagacagtgaccttgctgacaccttgatctttgactttccagtctccagaactatgagaaaataaatttctgttgtttaagccacccagtctgtagtattttgttgtggcagcctgagctgactatgacacctgaataatattccattgtataccaatgccacattttgtttatccattcatcagaaatgggtttttggattgtttccatctttggctattgtgaatattctatgaacattcatgtacaagtatttgtgtggatacaggttttcaattcttgttttgtgagagtattaacatgtaatgaactattgtttttggaacacaatttaggacgttctgcctggtattattttgttttatatgttgattccagaaaattaaataatttcatatatttctgacttttgaagaaaggcagctttctctaattctttgtgttagcagaaacgatacttttacaagatttgctgatgttggttaccttgtcacacaaggccagttataaatatggaaaagagaagaaggttacattattagattgtcttcttaccatcctttttcatgaaaagtagaaataatactaggatttcatcttttcttctacatttccataataaaatggttactaaaaaactaaatcatttttccaaatattagtacataattgcaagttgcttatagtgcatcaatattcctccaactgtaatttaagaaacacttatgtaacctagccatacttctcatgtttgagtcctttttataacatccttatctgagtttgccttcctagtctagaaactcctgtgctcttgtggtaggaaatgcaccatctccagaggcataccatttctttgttcagaaaattagtgctatcaaaaggtaggcttgactgtcagggttcctctagatgccatgcaattttgaggacagaatgccatgcaattttgaggacaggcttttgaggacagaatggagagatttgttgatgatctatgagcatttcttttttgaaatacttgtagatacatccagattcatttatttattcaacatgacacagagcattagctcagatctaggcattgtattaaaatctgaaggtaaaagtaagacccyggtcattagcatcaagaaatccgtcatctaatgtaggggacagatacatgaatacaaattccattactctgtaaatgtgagataatagagggtaatagaacaagagaatgtcagactggcttatggaaacaagtggtgcttaagctgaattttgaaggacaggtaaatattaatgggggagcatcaatggagaagggagtagcatatgtaaagatattgagacttgaagcagctttggtgattaattctggcacatttaatatgaagtgaaaagtgtcgtggcaagatctgaggttggagttacaggtaagttagctagatttttttctttaggttttggcttaaatgataactcctcagagaagccttctctggctcccatatctaaagttggtctccctctcagttccttgcttttttcctttgtaacatttattacaacttggaattattctgtttactgccttcatgaggtcaagggactgtgcgtaatatgctagggagttaaaactttattctgaactcttcaaaagccatttatgtgttttaagcaagagaataaggtgatttggtttatattttaaaaatcgcgctggtgggagaacctactgtaggttagatacatactgctagatgctgcagatgcaaaggtgaaaacatagtctgtgcctcaaagagattacaatctagttaggaggcagagaagcaaaggaaaaccattaatgtagtggagatatccaggagttctgtggaaggaaagaagaaggagccttgtgtgggtttgtggtctggagtatacatatgttgttttaattgctagtgaatttagttcagtgactaatcttctttgagtgggactccaaacagtttttttatcagattgacttcagagattctccaagatgattatgttatattagctttgtgtaattagctttgtgtaatgtaagtctcagttatgtatctcttgatggatagattggaagaacaagctagtcatttgacccataaaggtttttctttgtgactttggataccatgtctacctcttacctatattttatatatgcataccaacttgtatactttcctaaggaaaatataaggaaataatattttttctgtgtataaatttaatgtctgttttccattaaaaaatttaaaaatttaccagttctgatgataactgagtgattgctttcttttctaggtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaagtatactatgttgttttagttatttggggggaaatgtgtgtttcataactgttttccccaagtacagctttttttatttttcttttattcataagacagaggttgcattcatctttccttacttccctcttctctacctttcttcttctttccctcttttcttccttgcctctctttttcagcagttacttattatctgtgagtctgacttcattcatcccaagagttggcaaactatggtctatcccttgcttttgtttttgaatgggttaaaatacacctagtctccccaccgtttttggtaaacattttattggaatatagccatgcctatttgtttacatgtcgtttatggctactttcatgctacgatgggaaatttgagttgagtagttgtcacagagcttatatggcttgaaaagcataaaatatttagtctttgccaaagcataaaatgtctaccaaaatatttattcgcccctttatagacgaaacttgctgacctctgatttaggcactcatcaaatagacactgagcacttgttttgtgccaggtattctgataggcactggggatgtattggtgaaaatggcagtttcttcccattagaagttaaaagtccattcagattgatggaaataaaatagcattttatttattgaacctgtatttattgaacattaactgcgtaataggaactatcctagccattggtatcttattcctgtgtattaatttcttaatctagaaatacacattcctggcctcaataaaaacactgctaggttttgaaggaaagaatcacaaatcacggccaggcccagtggctcacgcctgtaatcccagcattttgggaagccgaggtgggcaggttgcttgaggtcaggaattcgagaccagcctgaccaacatggtgaaaccccgtctctactaaaaatacaaaaattagcgaggtgtggtagtcggtacctgtagtcccagctacttgggaggctgaggcaggagaattgcttgaacccagggggcagaggttgcggtgagccaagattgtgccactgcacaccagcctgggcgacagagcaagactccatctcaaaaaaaaaaaaaaaaaatcacaaataaaactattgacaaacagatacttgggttatttgtaaatatgcttacaaggaaataggtcatcattcttgataaataaggaaagaaatggtatgattttgtatagtttagaaaaatgaaattatatctagattgaacaagacaatcctgggttattaatagaacttacagcagagtagtcgccacatgaaaagagaaaggaatatcaagaagtagaggaccataatacaggagagagtttgggttgtatagttagtattacaagatcctagttaaaaggaagtcttttttgcaatttgctcttatactttttgttttgttttgttttttgagacagagtctcgctctgttgcccaggttggagtacattggcatgatctcagctcactgcaacctctacctcctgggttcaagcaattctcctgcctcagcctcttaagtagctggtattacaattgtgcgccaccatgcctggctaattcttgtatttttagtagagacggggtttcactatattggccagtttggtctcgaactcctgacctcaaatgatccacccaccctggcctcccaaagtgctgtgattataggcaggagccaccgtgcccggccttttacttagttatgtctttacttagttctttcacttttcctctggaattagtaaatttctggatgacatctcaactgaccttggataaatctctatcactggaacctgattctatctccttatttataatataataaagattgacctacctggtaaaataattcaattctgttcatctttatttagtacttaatacatagcagattttgtgccaaaaactttacttgtgttatttaatcctcataacagccctatgcgctaggtgttataattttgtccattgtcagaataaatattgagtgccttttatgtgccatgatctagtacctgacgttttaaaaaacgtgattgcttttctaggagttcactagagaaagacacataagcaaataagaaaataagcagagaactggttgggaagttacataggagtgaagcaggaaaggtcagttgttattgaaagaaggaagaagttgggatgcaataggtatttgatggtagtaggaaaaatggcctggggtgaaaataaagcttggaagcattggaaaacattttatttgttgttcaatttatatagtcagtaatgatgtaaagttactgtgccagtaccagcgtagatatttgtaatcccttttctttctacctctttatttctcatgccctccaaacttattttcaattcattgtactcttttttttttttaaattatttggcctcttgaacttggtacaattcattgtactttttttttttttttttttttgagacagggtctcattctggttgcccaggctgaattgcagtggttcagtaatggctcattgcagccttgacctcccaggctcaggtacctaagtctcccgagtagcttgggactacaggcatgtgccaccaagcctgctagttttttgtatttttttagagatggtgttttgccaggttgcccggactggtctcggcctcccaacgtgctgagtttacaggtgtgagccacagtgctcgggcaaattcattgtacttttttttttttttttgagacagggtctcattctgtctcccaggctggagtgcagtggcgcggtctcggctcactgcaacctctgcctcccagtttcaagtgattctcatgcctcagcctcccaggtagctaggactacaggcatgcgctaccacaactggcttgtcctcttaagtaacatttttctttatcaaatttagacactcattaagaatattcccaggtttttgttttttttttatttcttcaggtcctttagttcagtgtttccatagattatctaattgaggaataaagatgtagactgtagacttttgctctgtaccaaagaagaaataagtccaaaccattagatcagaaggctaaattttcctatggttgaatgttaaatattgagttggaaatacccagaaatctttgttctagcttgtttgcagaaaggtaaagatttactagttggtttatttaacagtagaataaaatataataaacagtgtttaactttttttatgtattttttttctgtgaaactagaaagtttatgatgatgagagcagttttgtctgatttgatgttgtgcccaatatgtgccttgcacgaagtggttggttggtaattagactgtgcacagtggtcaagtgcgtggattttggagtcattgggtctagctctgccacttattggttggataaccttggataaattatttaaattctttaaacatcagtttactcatcagtaaaatgggattgataacaattataacacctagctcataggactattatgaggattaaataagataatacaagtaaagtttttagcacaagtcctggtatgtagtaagaaataaagatgagctacttgtagaactgaattatttttaccaggtggggcagttttctattataaataaggagatagaatcaggctgtagtgatacagctttatccaaggtcagttgagatgtcctctgatgccttctgactccccattctgtgtaataccaagattttcttggtagacttgtctttggtctgctaacattttacaattgaaaagtttatatgattgatttcatgacttccttagtgacctcatcagtacacagggctttaggtattctgtatgtatgctttcaactcctgaaagcaactctttttaccaccttcaccactctcaccttgaactaagccaacataatctcttttttggattattgaattatgctgttaactgcaatagcctttcctgcttctattctcaatatagaaagcaaatgatccttttaaaatataaattagatcttgtaattctctgctcataaaccttcaatggctttccctcatacttagaataaaagccagagtcttcacaagggattttgtgatctgtcccctattagctctctgttcccagttatgctaacttttttgtagtttctcaaatattttaggtaccttcctgcctcagggccttggcattcacttttccctctgcttgaaatgtgtcttttcagatatccacacagcttaatccttcacttccttaaagttactttatcaataaggtcttaagtgatgtctctacttttaaaaagcagtaactcccccgaccccaggcatatttgtgcatttgtttattacctgtctccttacactgtaacgtaaattcatatagacagggatttctattttatttactgctcttatccccagctcctagaaaaatgtttgctgtataatatgagctcaatatatttgatgagtaaagaagtagttgttttgaaactaagaggtagcgttttctttgaggacttaattcattctccagtaggaactgatttgacagaatttttatgctagagaattgaaataactagattgagccaacttttcttatttacttgttgccwtgggcaaattaatccctgagatttagtttgccaataaaatggggagttctgatagggttgttgaaaggttaatactctataagggatggctatatttatttttagtctgtagcaggattgttgctaaatttggagcaagtttctcatttaaaagaaattatgtaattttctgaggtgaaagaatctttttgtcagaagctgaagcctgttgaatatcataaatcaatctgaaataaaaactaagcattgctaaagtttcagtgtaaggcattagaaacttttaaaattccacatgtatttattgtgtgtttgtaattttttattgtgtaatctgcgtagaatgttgacttcagattcaggtgtacaggaatttaaattcagtgtcttccacttaatacttgctatatccttgtaaaaggtgcaggttctatgggcttttgttttcacatctataagatgaaaataatgtcaatttaatcagatgattaggggaattaaaatgacaaattgtatgttaaacacctagcatagtgcctggcacataacaagtattcagtaattactaagttttattagtattttgagaatacatacacgaagtatgagtgacgttctgtgactgatagtttagtgtgttagaattgttattcccttcagttgtgacctcaagaggttattcatttatccccatgatactgtgattggagtgtttttcgaactcaacttttgaaatttcttacatgtttgtggcccattcttttgaaatccccaattcgagggcagattttatttttttatggtaatcaaaatggctgcaagttaaatttgaaatcagttttggggacaacattggaataagactaaatagcaagaccacttttcttttttttttttttttttttttttgktaatacgaagtcttgctctgttgcccaggcttgagtgcagtgatgcgatctcggctcgctgctgcaaactctgccttctaggctgagacaattcttccacctcagccaccagagtagctgggattacaagcctgcgccaccatgcacggctaaattttgtatttttagtagagaatgggtttctccatgttgtccagtcttgtcttcaactcctgagctcaagtgatctgccagcgtcgtcctcccaaagtgctgggattacaggcatagccaccacactcagcccgactgcttttcttacattggattctaaagatgatagtaggtgaatattaaacataatttagcattaccatgatattgttagatatcgtattaaagttagtatgtaatctcctatgataactattttgaaaaaggactactatctcttcagtatataagtttattaaaaactattactttagaagaaggaaaggataaagaaaaaaccttcagtgcttatttctgtctacttacataattgtattattcacttatatagtcaatagtttactcctctgttttctgaataaagtgcatttttaaaatttgtctcttcagcgatcaccagaatataccaattgtcggtatctatgcaaactttgcttaattcacattgaaaatatccagggggctcataaacatataaaggagaaacgacataagaaaaatattttggtaagttctttttaaaaaatacttttatttatttttcaagttgtaaaaccatattgaatattttttatttgtgaaactaaaaatgaaatatttgtccaatcttatattggtaactgaagtgatagctttggaagcaattgttgccttccttatctgagataatcaggaaggaaccttgttgagaccggtttgctcatcctttagaatgttgattcctaagtttagagctgttaggtacaattagtccatccaactgatgtttattgagttcttgtgtgctasttctaggcagtggtgaataagatagttgtggttcctgccctcagattttctaagaattgatgagggcatgcgttgaataaagatttaaatataatgagtcttgttagggggggaagattgtgctaaggaggtgtatgaagatattttacttgatctagaacaggggaggtttctctgagaaagtgacttttgaatgaagtagtagtttaaatggcaaaaaggtgagtggcctagaagggtaagtgggagagcattttacacaaaaagcagcatgaattaaaagtctttaggcaggaaaaggcatggcatatgagtaactttaagtctagtatgattggaacaaagagagctgggggaaaatgatgtgatgtgaagctggagaagtgcagacaattaagaaacttataagcttcgggaatttgtaatttttcagttatttctattgaaatatcccatagacatagatatgaatagagggcttttaaaaatgtattagtaaattagctatttaattttttctttttaaagttacaacagcagtaataatactgtgtaacctcttatctctaggtcttagctcatgtatcttctttaagaaatattctacctgaccctctcagcaagtctgggttggatactccttctctgtgcccccataacaacttccacatattttgatcagaaaatctaacacattgtattctggctgtctaccttctcttcccttctagacttcaatatgcagtgttctagaaggcatatttagttatttttgtttctgagttccttaggacagtgtctgacaacagtaggtgctcaacatagttttcttgaaaacaacaaatgaactgaagcagatagaacagggacaagggagtagtttaggtgataataattaggaattttccagaaatgtcagaagatgcctatcattagttccaggaagctcgggcttgcaagcaagaaacctttttttttttttttttggagacagagtctcactctgtcttccaggctggagttcagtggtgcaatcttggctcactgtaacctctgcctcccaggtttaagcgattaccctgcctcagcctcccaggtagctaggattacaggcataccatgcctggctgatttttgtatttttaatagagacggggtttcacctgggcaagcaagaaacttaaaaagaaaatcatacctaggctgggtgcagtggctaaggtctgtaatcccagcactttgggaggctgaggcaggtgagttgcttgagcccaggagtttgagaccagcctgggcaacgtggcaaaaccctgtttctactaaaaatacataaaaattagctgggcatggtggcatgtgcctgtaatcccagcttcttgggaggctgaggtataagaattgtttgaactcatgaggtggaggctgcagtgagccaaggtcacaccacttcactttagtctgggcgagggagcgagactctatcacaaaaaaaagaaaaaggaaaactatacctatacacattacagattgagtataccttatcctaaatgcttgggaccaaagtattttggattttttcagattttggaatatttgcattatactttaatgagcatttcctttgagcatcatgttggtgttctaaaagcttcagattttggagcatttcacattttggattttcagattagggatgctcagcccgtatagggaaactttagaacattatagaaatgaacaaaaagaaagcaaacttgaatgcagccatataggacrtatacttttggtgaagttagagtaacagtggatttacttttcccttgaaatgacaaacaaaaaaaaaatacagaaatatgaagcagtggttttcaggcgacagagtcaatgaatgaaaaacaaatggcctgagcccaatgttggctccagcttgagagtttctaggttgcactatagggaagggaacccagtggactctcacagttgaagagagagaccttagagtgcactaagtccaagatagctaaaattcacaggacagtgtaactaaaatgagaaaactgcacaaaaagaaatccagagaactgtggatgatcctcttaaagtattcagcacaatgctgattggtgcatgcatatgaaaaagcttcctgaacccagggaaagaattgtcagaggaaattagaccagtgattggtgctcatacaggacttcttcctatccagactggaaagcctcgtgcttcatgggacactgggtagagtactcagaagaatcttgtttcagtagtagggatatttagccctaaactaaatgtggtctggtcctacataaaatattttaaaggcaacattcaaaatgataaatggtttccaagtatttaatgtcattacagaacaaagcttaggaatattacagaaatacaaaaatactcatcactgaaaaaagttcacataatgtagcatttagtcaaagattatcaggtatgcaaagaggcaggaaaatacaaatcatgatgaagagaaaagtcagctataataactgaccttgaactgacgcctttgttaggattagcagagaaggacagtaagacagttaatataactgtattcttgatgtttcagagatgaagtagagacatggaaaatataaaaaagatatgaacaggactattagaaacgaaaactacgacatctaagattaaaactatattgggtaggaataatagtacatcaaacattgcaaaagaaaaggttagtgaactcttgaagataagcagtggaaaccaccagagtgaaacacagaaagaaaaaattaaacaaaaagaaaaaagttaatgagctctggataattgatcaatatacatgtacttgttctgtacaaatttttccagaacactgaagaggagaaatacttcccagttcagtctgtgaatatgaggtccacgtaactctgatattcaaaccagagacatattgcaataaaggaaaactttattcttaacttgttgactccgacgggagaaaaaaaaagaaagaaaactttaggccaaaactcctcatgaacatagatgcagaaattctaaatataactttagccaattgaatccaacagcatattagaggaatgaatgtgtcatgatcaagtggggctttattccaggagtgcagtgttagttttacattaaaaaatccctcattggccaggcgcagtagctcaggcctgtaatcctagcactttgggaggctgaggagggcggatcacctgaggttaggagttcgagaccagcctggccaacatggtgaaccccgtctctactaaaaatacaaaaattagctgggcatcgtggctcatgcctgaaatcccagctacttgggaggctgaacccagaaagttgaggttgcagtaagctcagatcgtgccactgcactccagcctgggcaacagagcaagacttcatctcaaaaaacaacaaaaacaaaaaaaaccccgctcattgtgatttaccatgttagcaaacagagaaaactatgtgattatctcagtagatgctgaaaaagcgttttcaaaaatgctttgataaaaagtctaagcacagccaggtgcggtggatcatgcctgtaatcccagcactttgggaggctgaggtaggcagatcacctgaggttgggaattcgagaccagcctggccaatgtggcgaaaccccctctccactaaaaataygaaaattagccgggcttggtgacccacacctgtaattccagctactcgagaggctgaggcaggagaatcgcttgaatcccagaggtagaggttgcagtgagctgagatggcgccactgcactccagcctgggtggcagagtgatactctgtctcaaaaaaaaaaaaaaaaaaaaagtctaagcaaactaggagtagaagacgacttctataacatgataaagacatctacaaagctgggtgtgttagtcccagctcctttggttgtttgaacctaggagtttgagatcagcctgggcaatataatgagaccctgttaaaaaaaatctacaaaaaactaacagttatcatcatacttaagtatgaaagactgaatgctgtccccccaagattaggaaaaaagacaggtatgaaagtagtgtagctgccatggaaaagagtacggtggttcttcaacaaattaaaaatagaactacagtatgatccagtaatttcacttctgggtatacacttgaaagaattgaaagcagggtttcaaagagatatttatacaaccaggttcatggcaacattattcacaatagctagtatgtggaagcaattcagatatccattgatggatgaatagataagcaaaatgtacagtattcatacaatggaatattactcagccttaaaaaggatggaaattctgcattatgcaacaacatggatgaaccttgggaaattatgctaagttaaataagccttttagaaaacgaaaaatagtgtgtgattccacttacatgaggtttttagagtagtcagaatcagagacagaatagtgcttgccataggtttggaggaggggaaaatggggagttattgcttgatagatagttttgattttgcatttgtgttctgtgttatagtatttggtttttattttgagcattatggagtttaataacatgtttgttttttttcaagatagagtcttgctctatcgcccagactgaagtgcagtggcgctatctcatctcactacaacctccacctcctgggttcaagcagttcttctgcttcagcctcccgagtagctgggattacaagtgcatgccaccacgcctggctaatttttgtatttttagtagagacggggtttcaccatgttggccaggctggtctcaaactcctgacctcctgatccacccgcgtcagcctcccaaagtgcggggattayaggtgtgaaacagtgcacctggccataacatgtatttttgcaaggtcactcaccctggcttctgtgaaagaagcctgagaagggtctgtttggggagaccagttagcctttcataataatctagttaagctgtgatgaacactgacctgaagtagtagttagtgagaatggaattgagttttaagagagattcaggatgtagaattgtgggagtacaggcctaggatgtcttgaatgatcataaggtgtctgatttgatatgttatcatagtttgtggtgccatttacttagcagaaataaaaaatgtttcataacattctgagtttgagacacttacagaacatttcaagtagagatgtcccacagtcatttgaatataaggatctggaacttatattagcagttggagattcaggtttggtaaacttcagcagttgaaatcatagttgtggatgaggtcaccaaatgagtaaggacagaatgtcaaggaatacaaacatttaagggactagtagaggaagaacagtgaatagattggtgaatgagtagaataataggaaaaatagagaaaggtgttagagaagctaaaagaaaggaaagtttcaagatggtagttgaaaatgtgataatatagataaaaataatctaaaagcttaaaagatgtctgatttggtgcctgtagtctcagctactcaggatgctgaggtgggaggattgcttgagcccaggggtttgggtccatactgggccacgtagcaaaatcctgtcaattaaaaaataaataaaaatttaaaatgtcagatttggcaactaaggaggttttgataatcctgggaagaacagtttctgctttagaactaaaaaagacatagttttgagtgagaagggataaggaaataaaaggagaatagactcaactttcaggaaacttcattgtgcagaaaagaagggaagattggtagtagctagactggcacacagttttttttttcttttaatttggcagagtaaagttcttatcacagttttaattttttaatttaaataatcatttaattaatctttctctcttgactgtaagctccatgagggctgggattatatgcattatttttttcccatcttagcacagtacctggcatatagttgttccataaatatttgttgattaatgatttaaatggagtggaaagagcatacgggttggagttagaactagatttaattctcagttccaccttgtagttgtaggacgatatttaacatctgtaagcctcagtattcttatgtataaaatggttttggtagtatctatctggggagtaatattgtgagaattaaatgacataacatctgtaaagcacttggcacggtgccaggtccatagtgggtactcaataaatgatagttgttgctgttagtgtagaggcgaagagtgcttacttaatgtgccaggcttggtggctcacgcctgtaatcctagtactttgggaggccaaggaaggtggatctcctgagctcaggagtttgagaccagcctgggcaacatagtgaaaccccatctctaccaataatacaaaaaattagctgggcgtggtggcacgtgcctgtggtcccagctacttgagaggcttaggtggaggagcgcttgtatctgggaggtggagattgcagtgagcagagattactcaattgcacgccacgccaacctgggtgacagagggagtgagatcccatctcaaaaaaaaaaaaaaaaaaaaaaaagagggctaagagggcttacttaatgaaaacacagactagtagattgtgtaatgtttaaggagaaggagattattactgagtgggtaaagaaggatggaattcagagcacaggtgatagtattaatcatgatttaaatggagcatttcattatgttggaaaagaaagatattaagggttcgctgaatatttgacttttaagctgtaacttgaaggatgattagttttaccaggtggatacacataggggacaaaatgatttaaaggcatggagacccaatggcacatagagtatttggagactggtgactgtttaaatgtggatgtctgtcaaaaatattggagagggtggagggaatggttggaggaaggcctagaaatgcaaattgagaccaaaatgctttatattccatgttaagaacatgttgcattgtcttaccggcgcattgaaggttttttttttttttgaaatttttttattgtggtaaaatatatataagataaaatttaccattttaaccatttttaagtgtacagttcagtgacattaagtacatttacattgttttgcaatcatctccactgtccaccttcattcagaactttttcatcattctatactgaaactctgtatccattaagcaataactccccattcccctctccctgcagcccctagtaaccaccattctattttctgtttctatttgcttgtctattgtaggtaccccatataaatggaatcatacattatttatcctttagtgttatttcacttagcatgtcttcaggtcaaccgcgttgtagcatctgtcagaatttctttcctttttgaggttgaataatattccatcgtatctgtatgccatgttttgtgaatcatttcatccatggatggacacttgggttgtttccaccatttgactgttgtgaataatgttgctgtgaacatcgatgtacaaatacctatttgagttccttttttcatttgttttttgtatatacccagaattggaattgctgggtcaaatggtaaatccatgtttagttttttgggattgccatgctgttttccacagtggtgacatcattgtacatctttaccagtaatgcacaagggttccaaattctccacattcacaccaactcttgttttctgcctccccccgcccccccataatagcaatgctgatggatatgaagtggtatttcattgtgcttttgatttgcatttctctaatgattagtggtatttagcatcttttcatgtacttatttggcatttgtatatctttggagaaatgtctattcaaatcctttgttcacttttgaattgggttgtttgttttcttattgttgagtttaagggattatttatatattctggatattaatcccttattagatacatgattgcaaatatgttcttccattttgtgggttgtctttttactctgtcagtagtgtcttttgatgaacaaaagttctaaatttcgtccagtctaatttatctgcttttacttttgttgcctatgtcttttgtgtcatattcaagaaatcattgccaaatccaatgtcatgaaacttaccttctgtttttttctaggagttctatgattttacatttcttagttacggttttatagctataagtgtaggttttagtatctttcttttctttttttgtttttgaaatgaggtctttgttgcccaggctggagtacagtcatggctcgctgtagcctctacctcctgcactgaagtgatcctgcctcagccttccaagtagctgggaccacaagcatgtgccaccatgcctggctaattttttatttatttttatttttttgagacagagtttcattcttgttgcccaggctggagtgcaatggcacaatctcggctcattgcaacctccgcctcctgagttcaagcagttctcctgcctcagtctcccaagtagctgggattacaggcatctgtcaccatgcccggctagttttttgtatttagtagagacggagttttgccatgttggttgggctggtcttgaattcctgacctcaggtgatccacccgcctcagcctcccaaagtgctgggattacaggcgtgagccaccgtgcctggcctaattttttatttttgtagaggtggagtctcaactatgttgcccaggctaatctcaaatttcttggcttcagcagtcctcctgccttggcctcccagagtattacaactgtgagccactatacctggcctagttttagtttctgacatttaggtctttgatccattttgagttaatttttgtatatgatctaaggtcagagtccagcttcattcttttacatgtagatattcagttttcccagcaacatttgttgaaaaaactgtcctttccccattgagtgttcttggcacccttgtcaaaaatcattagaccatacatgccagggtttatttctgggcactctgttctttttttttttgagcagaatctagctctgttgcccaggctggagtgtaatggcatgatctcagctcactgcaacctccacctccctggttcaagcaattctcctgcctcagcctcccaagtagctgggattacagacaggcatgcaccaccacacccagcttatatatatatgtgtgtgtgtgtatatatatgtatatatatgtatatatatttttttaatttagtagagacggggtttcatcatgttggccaggctggtcttgaactcctgacctcaagtgatccgcccacctctgcctcccaaagtgcttgtaggcatgagccaccacgcctggcctgggctctctgtttgattccattggtctacatgtctgtctttatttttattttatttttttgaaacaaggtcttgtttgttgctcaagctggactgcagtggtgcaatctcatttcactgcaacctccacctccggggctcaagccatcctcacctcagcctcctgagtaggtgggactggaggtaggcaccaccatgccaggctaatttttatattttttgtagaaacagggtttcaccatgttgcctaggctggtctcaaactcttgggctcaagtgatcctcccacctcagcctcccagagtgctaggattactggcatgagccaccatgcccagccatgtctgtctttatgctagtacacatagtggtttgttttgttttcttttgtgttttgagacagagtcttgctctgttgtccaggctggagtgcaatggcacgatcttggctcactgtaacctctgcttccgggttcaagcagttctcctgtctaagcctcctgagtagctgggattaccattgtgtgccaccatgcctggctaatttttgtatttttagtagaggtggggtttctccatgttggcctgtctggtctcgaactcctgacctcaagcaatccacctgccttggcttctcaagttgctggaattacaggtgtgggctacctgacctggccatgttgttttgattactatagctttgtagtacgttttgcagccagtaagtgtgaatcctccagctttgttctttgtcaggatcgttttggctatttggggtcctttgagagtctgtgtacatttaggattgatctttatatttctgtgaaaaatgtcatatatatatatatatatatatatatatatatatatatatatatatatatatatataatttttttttttttttgtaatggagtcttgctctgtcacccaggctggagtgcagtggtgcgatcttgactcactgcaagctccacctccgaggttgaaacgattctcctgtctcagcctcccaagtggctgggattgcaagtgcctgctactatgcccacctaatttttgtatttctattagagacggggttacaccatgttggccagggttgtctgcatctcctgaccttaagtgatacgcctgccttggcctcccaaagtgttgggattacacatgtgagccgctgcatccggccttttatcattttttcattaagtctgttgctattagttctttggatggatcctaagtgaaacggccgggcgctgtggctcacgcctgtaatcccaccactttgggaggccgaggtgggtggaccacgaggtcagcagatggggaccatactggctaacacggtgaaaccccatctctactaaaaatacaaaaaaattagccaggcgaggtggcgggtgcctgtagtcccagctactcggaaggctgaggcaggagaatggcgtgaaccccgggggggcggagcctgcagtgagctgagatcgcgccactgcactccagccggggcgacagcgagactctgtctcaaaaaaaaaaaaaaaaaaaaagtactgaaacttagatgcttatgtaagacttagatacttagattataattaagaattgcagaaatgatcacagagacttagaaaaatgagtttgacttacccctcatgtttgataattccttacctgaggtaagctttacttaggttaagtctgaatatggtaacagttagtgaaaatagaaatggaccaaagtctttaagtatatttgattgggtagggaaaccaactagctttggctattatatctgatgggagcgtcatgtttcaaaagataagagatggtttcttgagtgaaaaatgttaatagaaaatgcctgtgtggggaggggatgtgttaataatactaaataaaagagaatgattgtggctcagttgtgttaaagaatgaaggagatagtaggatatgaaattgtgggttattttcttctttgtattttcctgtgttttatgtagcttttgtaattaacattttttaaatcagaaaataattaataaaagtcattgcatatatatagcaaagtgtctttttagctcctagatttaaattggctttaaaacttttagcagaatagaggttttttgaacatttcgcatagcgttggataaaatcacaaagagaaatcactggtaaatagtaggcaggaagttttcctgtgaccatttaacttgatactgtatatgctgattagataggattcaagacttttctgctacatctaagacaatctgccttggtgcaacaaaatcgtcaagttagtattgtacttaaggtaccttggctttaatgtagcatttcagaatttatgcagacagtacagtggaacaaatttttaaaaacttagtagcatcccctccccacacagtacctctcattctcaaaaccctgcttcccaaaggcagaagtcttttgttcacttccgtattgtaggtatctggtagatggaaggtgaatatttttgttgagttagtttatttctgtctttccctgctaaatataagaacaattaaaatagaaactttttttgtttttattgttgtgaatcattacattaataggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccaggtagaaatacatttcatatttgattttgaaaatcacaaaactcttcccttgctcctcttgaactagagtacatttcttaatgtttttcttcccttttctccttaaaagtagataaaatttattgttttatgaatgaatttttgagggaaatatttcacacaaggaaattgagaattatggcacagcacacttttgtactaagaaaaaaagattttaaaaatgccagatgtagaactatttcttggcggtcaaatattttagtttttcaatatcactgatttctgagtggactattttgttatattattttcagtataaacatttcatccagtcactgaactaaatttctgttgcctgatggtggggaaaaattaatttactttaatagggcctttagaaaaagcttattgtttggtacaagggagtgtcagatttattttagatatttatatatggactatttgcttagcccatatcttttttgcatcagtatagggttaaagtaaatgtatctgacgtaagacttatttcttcccaccaaagggattttggaaagttgataaattatactttcatatagatccattttgagatttataagaaagaatataaaattgaaatttaaaaatggaatttttaaagtatttatatcataatatggctttctacctaaaatacattgaatccttgtttaagttacatgtaaaaattatttactatgataagaaaaggaatgaatttttatgggtttagtgacttgaatgactttcagacattttatgaacttgaraagtagacttttatatatacaactgaggatgaagttaaactttctaagaaactaaatcttcttgatctgtcccaatcatattattttcaaattggcctctggtgagatccttttaacatttgccttattatgatttttggaataacatgtttcatagtctgggaaagctgtaagtagtgtgttactgcttttcttttttttctataaactcttgagaaccacagtgttttgggttttaggtttacagaattaactgacttggcttcacttcgtattttataaaagcattggcattgaatgtttatgatcctttccccaaagtgctcttacataaatatttaagagtaaataaatgtagtttgtgacagtagccatagctaagttggtacattagttactgttatatattgaatgctaaacatattgtcagtcatttctaaatgaactattactaaaattttgtttaaacagtaagcttctgtgagtagtttctctctcccttctctgttcctacactccataactgggaaccatttttttattctatagatcagttagaaagggtgttcttcttgtataattgtcttactagaaatggaagacgtagaactgaagtgtgtgaaattttccyrtcgctgtttttttacatctctcatatttgcatgctatttcatgctttgatgtttttcctttattccagaatgttcacttaggttgtatggctcatctctgactagatttgctctgaaaagtagtgatgttaatatagatataaaatttcctcccaaggtaagtaattagaatctttcctgtgtggttcttaactagtacttagtaatttttatggattatctttgtagagaaaggatagggaaatataaaactctggtttgtatagtgttaccatcgtgactaaacagtgcttttggaaattactattagatttcagacaaaggcaggataaaagaaataagggacaagggcaaaaggaagcagaagaggaaagctggaaaaaggaaaaatgtttatatttgaacatgttgaatagttaatacttctggtaagcagtatagaaggtgggaagagttttgaaatcagatacctagattcagatcttatctgtgataagcaagttgcttgaactttttgagcttcagttttctcatttccaaaacaggaataataatttttatattaaatgagataatattaatatatgtcaggtgtcttaatatagtatctggtacatatgggtacttttaataagtagtacctagaatcattagaacaatattgatattgttctaatattgttatcagtattagaacaatattgtttagcactgctgacattctttattgacatatcaatcttttaaaataagtcaatattttatgttttaaattgaataatatgtttatgttcagggaggtttgatttgggtgaaaatttggtgtttgtagggtgatacatttactttataattaatgtatggttattaaatatttttgttgtttgtttttgagacataacctcactttgtttcccaggctggagtgcagtgatgcagtctcggctgactgcaccctccacctcctgggttcaagcgattctcctgtctcagcctcctgagtagctgggattacaggtgtgtgccaccatgcctggctaatttttgtatttttagtagaaacggggtttcaccttgttggtcaggctggtgttgaactcctgacctcaggtgatccgcctgcctcggcctcccaatgtgctgggattacaggtgtgagccaccgcacctggcctaaatattcttaaatagcaaaaaacactttaaacatttgacaagcttgttacataaaatagtattttattctaagccttttgactaagcttccagttgtctatatcccttaaagtttttatctcaacaatttgtttttcacagtcatctggtcaactcatttctcttttgttttgatgggaaattccagaaccttttcttgctttaagaaaccattaattctaagagtgtttctggaataaaagtgctatatcatttattagattctacttctttgaacaakatttgttgacataaaagtaaaacatggccaggtaaggtggctcatgcttataattcccgtgctttgggaggcaaaagtaggaggaatccttcttgccaggagttcaagaccagcctgggcaatatagcaagaccttgtctcttaaaaaaaaaaaaaaaaaaagtattagctggatgtggtggcacacacttacactcctagctactcgggatgctgaggcaggaggagtctttgagcccagaagttcaggctgtagtgagctatggtcatgctgcagcctggacaatacagggaaacctcatctcaaaaaaaaacaaaaaaaaaacacgattctgttttcactatttaaaacacaaagcatgattatatttaaatgttattctttaatgaaattgagttttccttaatgttctgctgtccgaactttgaaattagtatatcgatttatttttgaaacttttttagatgaatcatccagatcttctgataaaagtacttgggattttaaagaaaaatggtgagtttcttttctttttcttttcttttttttttttaatttgtctttctaaaggtacatgtgttgtttatatatggctaaccaagttaaaactaaactgctggcatagttgagtcattgcattacaaatggagatacatacacacacttgtttatagatatactagaaaatataatttaactgtaacttaggtaaaaaaaaaaatgccatattaaaattgatatgtaggctgggcaccgtggctcacacctgtaatcccagcactctgggaggctgagatgggtggatcacctgaggtcaggcgtttgggaccagcctgactaacatgctgaaaccccgtctctactaaaaacacaaaattagccaggcgtggtggcacgtacctgtagtcccagctactcgggagactgaggcagaagaattgcttgaacccgggatgcggaggttgcagtgagctgagattgcgctgctacactccagcctgggcggcwaaagtgaaactccgtctggaaaatacaaaaacaaaaaaccttcatatgcaaaaaactactgccttttgggtaattaaaaaatatttgctttgaatattatgggcatttcttatgtaaaagaagacaaaacctataatcattatgaggtcattactgaaagaagattaaggagagacttggaataaaaatgtatgcatgcattgagtaaatatgttttttcccacctaaagcatctatattaatttaatcatttatattacatcagttgaatcatacctagttgagtttttcatgtgtgctttttctgtctggattgcctttgtaaacacatcattcatataggtaagaaaaatttaaaaattacaagattctcaaaccaggctccaggtcatgtgttacaatcttcaagatttgcttggtttttacttactgtttttcttgttacaaagtgaatgcttaagattaagcttgggagctggagctagactttctgggctcagattttagttctgccacttactggttgtgtgtcctttgacaaattatttgtgttaataccttagctttcccatctgtaaaatggtaatattacattgtatctttttgatgagaaagttgttgtaagaatgagataggctaaactatagtttagaaaagtgtgggatatacaataacttcttattacgtttttgctgttgtgattgttattattaccctaaattatatgaatcaaaagtatttgcaatttgggttagaagagagagcttttttttaaagccatactctctcattggctttaatatgaattctaaatttcttttttctttctgtccacacaatcagctcttatcagtttcctgttggccattgtcttgggaaaatagttttctaggaatgagtttggtacagtgtatcatataaaggtattttaatacagttttctttcttcaatacttgtttctaattgccgaaaaacttttaagtttactacagataagaggtagacatagcatttacctcttcagacttcctaggtagtatcatcctagcacaaatatttaatatatgccttttccatccaagatatataagtagattatcttaagtcatacaatgtaggcttataaaactcagtctgattgtaaaattgattatttcttcctttatgttcttactgtatcttctacaggtcacctacaggatttatatgtttatatatttgtgtcccaaaccccttattgaccttttttgtgttttactcattgtcatattgaccctgcttaatgcagtttctgacatataggtcttcagcacgtgttttttgactaaattaataattacaacaagtactattgagaaattttctttgaattacaartgatgttaatctatctggtttttttttgttgttgttatttttgttttgtttattttgagatggagtctcgctcaggctgaagtgggaatgtagtggcacgatctcggctcacttcaacctctgcctcctgggttcaagcagttctctgcctcagcctcccgagtagctgggattacaggcgcgtgccaccatgcccggataatttttgtatttttagtagagacgaggtttcaccatcttggccaggctggtcttgaactcctgacctcgtgatccacccacctcggcctcccaaagtgctgggattacaggtgtgagccaccatgcccggccaatctatctgtttttatttagattagacatttatggcatggggcttacccttggagatacagagaaagatttcagggtagaaatgtgcttcatccggttagtccttccttagcagctttgattaggcaaactcttcatatactaacgggaaatgtggcctgaagagttaggttgtaattacattggtaatttaaaagaactaaactgtcaaagcatgataggtcctcctttcatggctcctgtggaactagctctcaggagtaaggggtgtcctctctttgctgttatctatgaaggtttaacaactttgactagattatctacttacttggaaatattaaaacttttagggatgttaagacctttcttaaggtgattataatttttggacagtatttggggctgtacctgtggtttgtgatatacagcaaatgacaccaggagaggtaagagatttcgctgggttggtgctcataatgagaagagtggattatcccacagaagcaatgagaataattttcagaaggaaactgttacttaatgtttactgtagagtacgtattttagagatgttgacattagcttacttttttttttccttattagtattatatgtagatgtggaatctgattttcacgctaaagttcctgttgtggtgtgcagagatcgaaaaaggttggtaacaatgaagataaaatatttaaaaaaacaaaccccaacaaccaaatttgtagtgaatgatctttaagagaaaaagtttttgttttagatttctccttggatgaatatgactaagctagtttctattcattaaaaatagcaagcttaccaaatgcatgtgaacaagaaatatatagaacatcagacagttgaaaataaaatactctaggcaaaacttcaattttttttttttcaagtcattcactcacccaagagtattgcatttacttatatgcaggtactactttgctctatggatacagacataaagaagaaatagcctctcttcagtcacttgagcccaggaattcaagactagcctgggcaacatagtgagaccttgtctccmcaaaaaaaataaaaaaatcagccaggcatggtgggtgtgtgtgcctgtggtcccagctactcgggaggctgaggtgggaggatggcctgagcctgggaggttgaggctgcagtgagccgtgattgtgccactgcactccagcctgggtgacagagtgagaccctgtctcaaaaaaaaaaaaaaaaaagcctctcttctcaaggatctcacaatccattagaatttagagtttagtttttatttcacttacattgaatgagttgatttaaattgaataaactcaagatcagtcctaaattgaagactgatcttgcctttctagttagatgtctataagtctaagagatcaaagtgcctttgaaagcagaaactaaatcctatttgaaagtagtgtgggagacatggaaacaatacagaaatgatattcttttattgattattaacttgtattatattttaagatcaaggtattttcttattcaaagctagatgagtctatggcgatctagttcagatttattttctaaactagaaaaatgggacctggagtggtttatcagtttgtctagattcacatcattgagggggaaactataattggaaaatggaggcaaagtgacctttagtgttttttctgccacattgtgttaaattgcctgtgtgtgacacctcagatttattcttctccctgctttcaaaatatcttcactacacttctgtcatcccatttaaggttgctgctattttcacttacacagaagtataatttgtgggttaatctgcaaatcctgtctaatctttactctgaaaataacatattagtacaattgtgaaagcttggataggaaaaattagagtcaagaagtatagccagtcagttaagtattcattttttgctattatcatgtagaaagcaagaggattgaactaggaaattaccttgcactatttgacattgaagagatcagtgccctgtctctcatgtatatcagttttgataattcataatgctgcttttgaaattaatttctcattaacttaaatactaagtttggttgamatttatttctgaagtacaaatgaatgttaaaaacatctttctttaattcgtatggaactctagttatggaatgacatgtagttttcagttagctctaaatttattaaaacatttgtttttattagggctttwacggtactatgttacaatatgataactagaaagaaaatagccacaggatttgaagtattctgcttttaagggtattaatacaatgaaatttgtttctttctcattcacagtggtttactttgtagagtgagtgcaggaaacgatatggcatgtctcactactgatttacttactgcccttggcaaaatagaacctgtctttattcccttggtgttagcctttcgctactgggctaaggtaagtgaaagagaggaaaactacttatttatatttttagaaggaaatgtatttaatcttcaaaattaggccttttcttgtactgacatgtaacrtcaatcataacatgtgggagaaagtagttttctgtgctagacagaaagttggtgtggcaggttgtaatttatggacataaaaataaatttttgtagacacacttatggatatattttagaatttttaattgtcatgctatattctccttttatgtactatagaaatgttctctttcatatcagcatatgaggctcaagttttcactcttactgtaagttaaacttgtaaggttttaagatgtatatacattaagattcttttgttggcatatttttttccccagtctctaagaatgctattctctttcctctaaatcattgataacatgtaccaatttctgattgggcaactgctgagcattagttatttaagtttcctaaattagtcttaatttgtatgtctaaaggctgtggttgccctgtgtttatttctttgatgtggggatagggagtagtagttaattatcaatatcagtccaaatgactagagagagagattttagccttttgtttgtgtattcctgccctatcggtagagtattcatcacttgttagactggtgagtaaattctcagtcatatacaaagaaaactggttaaggggatggtgttagagtggtaacttcatagcaaaaatagagaagtctctggaattttttgtctgggctctgtttagagaattgcccccatgcttggagcagcaccagctggctgagtacgaaacagtcagaaagcctaaggttggggcttctttatactcaaggcctttgtatttgctgtttccttcatctagaatgttcttaccttaggtatttagaatgcttcactcttacttttttcaggtttatgctcacattgattaccagctgccatacataaatttgttgcagtctgtactgtgaaattgtaaactctttgagggcagggattttaatgttttatgtattcacggctgatccccacttccgcttattttactgtgtcagcacatagtaggcactcagtaaatatttgttgaataaatgacctagtttcttcagaaaggagttgtgtttttttttgtttgtttgtttaagtagagatggggtctcatgatgttgcccatgctggccttgaacttctgggctcaagcagtcctcccaccttgccctcccaggtgctggaattatgggtgtgaggcactgtgcctgggccagaaagatttttaacccatggaagagagtggaggcagtaaaataggttgagggagggtgactacttcctctcatttatcttatactctatgcctagcatactataggaaatcagtgtatggaatggagtaaaccaattccaggtatggttttttttactaagtttttttttgttttttgagatgaggtctctgtcacctagtgctggagtgagcgatcacggctaacagtagcctcgacctcccaggctcaagcgatcctcctgccgcgggcttccagagtacctgggaccacaggcgtgtaccaacgtgcctggctaattttttattttttatttttgtagagatgggttctcattttgttgcccaggctggtcttcaactacagggctcaaatgatcctcccaccctagcctcccaaagtgytgggattacaggtgtgagccacagcacccagctttgctaagtcttcaagcaaggtacttcacctatctgagcttcaatttttttcacctggagagaatattttggtaatgctattagataattcatgagaatatacttcaggctcgaaaatactacagaaatataaaggatgatggaatacacagttgcttctttgttggtacttttaaattatgccctaattttttttgtggtcataaagtcatgtcagttttctcccagacattgttctactcagtaaaataagtagtctgtgttagaagattataaatgatactcagatacattctttttattttggaaaaaaatatggcccataaatattgtttcctaaagtgactcttggaaaaggttgctcatggtgttttagtagttgatccatgtagattctaaatatgccagtcaatggacactgaaacatatattacaaaactggttgtagaatggtttctttctgtttccaacagaataacatgtctcgtttttgtcatttgtgttagttgcaaagaaagttttttcatggtattcattttcttaagaaacttagaaataattcctagtttatttttcttctaaaagatttttttaaaatagctttgtttttcttgaagttttaagccatattgtacattatctagttaagcacgcatttttccatgatttgggggttcaggacaattctagtatataatttactcttataactgtgatatgagattgcagttgattattctctggctgtcttaagtagttatagtctttgmattttagtaatgggaaatagttttctagataaagcttcttaactctaggtggcagaactctttagccttatcatcagtacattattagtcaagttacctgacttagagccacttgtcgtggttaatgtaagaattgcattttagcactatttgtcatctgaaagagatatctgggttttaagagctctctcttaaactgctttaatcttgtttatctgtgagatgtctggtaatgttagcagaatatattgacagttctttatagttgcaaaggaatttttggttaagttgacttattcattaggcagtttacccttgtcttaatattttggataagtgagagtttattctagtggaatgtttcaaattcttttttgacaagtgtttttagttgtcttttattttgagttgcaatcttaaatgtaccaagatattatgctacggtataattactctatattattattattatcctaaatcttcattgtctacagaagaaaacaatgatttaaaaatgaatccaaccaatccagtatagaccaatcgtatatagatgctacaatctaaatgaaatataagcaaatgaaatatatccatgtatcaaaggttaatatgccatgatcttgcatgatttacttcaagattataagaatggtttaatatcaggaagtctgttcacataatttattatattaacacatgaagcagaaaaaaaaatcctagatgctgaaagggcatgttctccctaacagaaacttttaagtcagctagaaatggaagtttatgatgaaaaccatttattaaaaacacacaaaaaacaaaggcaaaacaataagaaacatcatttaagccatatatgttaagataaagaatattgcagagaagttcaccattgatgttgtacattgttttgggattttaggaaatgcaataagaaaatgaaataattgaatgtaaatattgggaaaagtataaaattatctctttgtgcgaatgatatgattgtacacctagaaaaccctagtaaaaaactactaggattaataagagaatttagtaagataactaaatacaagataaatatacaaaagtgaatggccattctctgccataaaaatagcctgttagaatggaaatggggaaaaatgtgtacctttatgacagcaacataaattataaaacactaaggaagagatttaataacaaagatataagaagaaattatattattgaaagatgaaagcaaaatctgaacaaatccatgcattcagcaaacattcgttaaatgccttctgtgtgtcagacactgttctagaggctgggaacatctaacaggacatacagagtcctgctttcatggtgctcacatacttctggaagagtcaaacagtaaagaaatacataaataataatatctgctagagcttagtgctacaaaaatgaaatgatagaatgaatgacattactctgaatggtcaggaaaagactctgaagagatgatatttaagctcagacgggtaatagctagccacatgaaaatctgatggaaaactctccaaggcacagttagtccaaagcttccaaggtgggaatgaactcaggaggagcaaaaaggaaggctgtaaaactgctttaatcaagagtatgctattggcatagaaatagaaaaatagatctgtggaacagaatagaatgctcagatgatctagtgtacagattttattaaatagtgctttcacaactgtatcttactggaagaaaataatgttggactcagcatgctaaatgcaaaaataaattttacttaaatgaaaatttaaaattttagaagaaaaatgtaggagtatgtatatgtaaataatgggatggggagatcttttactatgataggatacctagaaggtgtatagttgtcctcagtatccagtggtagggggattggttccaagacccccaaggataccaaaatttgaggacgctcaagtcccttatacaaactgtgtgttatttgtatctaaccttcacatagactctaacatactttaagtcatcactagattacttataacatctaatacagtataaatgctctgtaaatagttgtactgtattttttaatttgtattttttattatattgctatttttagtttttaaaatttaacattttaatttttttcagagacagagtctcactctgttgcccaggccagagtgcagtggtgccatcatagctcactgtaaccttgaactcctgggctcaagggatcctcccacctcagcttcctgagtagctaggactactggtgtgtgccactgtgcctggcatatttttgttttgttttgttttgctttttcaagaggcaaggcctttgcacctggcgtttaacaaatttttcaattatatatatttttagagacggaggtcttgctatgttgtctgggctggactcaaactcctggacttctgcctctgcctcttgagtagctagctgggactacatcagctgcaggtgatatgtgtccatcaccacaccttgcaataaataaataaataattttacttaatgaagaaaatgtatatataaattttttgatggggtgttgcccaggctggagtgtagtggcgcaatctcagctcactgcaacctctacctcctgggttcaagtgattctcctgtctcagcctcccgagtagctgagattaaaggtgcctgccactgtgcctggctaatttttgtatttttagtagagacagggtttcactatgttggccaggctggtctcgaactcctgaccttaagtcatccacccactctgcctcccaaagtgctgggattacttgcatgagccagtgtgcccggcctaaaaaatattttcagtgtgcagttgattgaatgtgcagatgcagaacccattgatatggagggctgagtgtctgaaataagcatatttaaactaaagcatagtgaaaataaaaaattttatatggtaagatataaataatatcaaaagaaaaatagtagattgggaaaaataacatctttcaaatgcatatatcagacgtaaagggttattatctataattaaaactcttataaattgatgtattggatgaaaatagaaaaactggcaaaatatttaataggcaatttagaaaagaataaatcccaaatggttagtaaacatacacaaatttcataatctctttagggtcaaggacatgcaaattaaagtaaccatcagatactacatttcacccatcccattgaaaattattgaaaattattttttaagtgataatacctagtgtttgaaggggtgtatgcacaggataatacctagtgttcgaaggggtgaacacacctgggttcctagtggaaaatacgaatttttgtagtgattttggaaaaacgattcttaacaatatattttaagattaaaatatatcactcattttttaatttaacaaacattcctaggcatacagctcatagaaataagcaccaatacttaggaaacatgtataaggatgaacattacagcattatttgaagtggcaaaaactgggaacaaaatgtgaatgttcttgaatgggggaactgttacgtaaccatccatatcatagactataatttaagcatttaaaagaatgtgttggctgggcatggtggctcatgcctataaatacccagaactttgggaggccgagcggggagatcttttgagcccaagggttcgagaccagcctgggcaacgtaagtaaaatttgtctacaaatagtctacaaaataaaaaaaattagctgagcatggtggtgcatgcctgtagtcccagctatgtggaaggatcacttgaggctgggaggttgagcctgcagtgagtcatgatcatgccactgcacttcaccctgggctacagagcaagaccctgtctcaaaaataaaataacgtgttagatcttgctaactgacttaaagggactttcttgatatattgttaagggagaagagtaatatacagagagatgtctataatatactattttggtaaaataatgttgaaaaacttaaacttctccctatacctatataggaaatagaaatgtatgtgtatttgtatatgagtatagaaaaaggcctagaagaagacatagaaggttgttaattgaagtagaagtagaggcaagatgaaaaaatatttttaaaatgtgtccacagtaaaataactacatgtaatattattccttttaacaaaaatatgtatctttgtatgaattttaaaaagartgaaaaaaaygatcatcaacattttaatggttattttagagtgatgatatttcaagttattccttatrtttttcattgtcatttgaactttttacaatgattagggtaggaaaaagcaagctacttttatcatgaaaattaagaaagctaaatggtagtacttttttccccttcattttgcagttgtgctatattgactcccaaactgatggtggaatcccttcttactgttttgctttaatggtgatgttttttctacaacagagaaaaccccctcttcttccttgcttacttggaagttgggtaagcatgaatttgtgacatatatatgcatatatatatatagtttgctcttgcagagaactctgctcaaacattttaagctggaattctggtttgtctgtttgtccatctttttttttttttttaaataatttttccactaccaatttggaatgcctttttatatagattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaagtaagcctttttgtttttgttttttggcttttctatctgtagaatttgtratattcttcgattgaagctattttaattgtagattgactgaccttgagcaagcctcttggcctcattttcctcatctataaagtgaggggttgatctggtttagtttttcagtaccaagattctctaatgaatttatgccttattttggaaaacttgtgttgtttgaatcatgtcaagataaatctgtcatttttcatctagacaaggaaaatttcctttaagagttgggctctgaccagacttcagcatatgggaattttgttgccaattgggtggagaaataaagcccctgtgctctaagagagggtagctttgcttatttgatcattcagcattcatttttaaggacctgctatgtgccaggcattatcttgagtgctagagaaccaaaggtacatggattatgtccttcagaagcttgtagtcttctaaatggacagatgcattattacagaaatctgaacatttctgaaatcattgctctagctatattgaattatttgtagtttcctgatatacttgactattgtattcaactcttccactttcctgtactactgtatactctctcctcaaaccactaatactctcagccaatgcttgcttattacttcactgggaacttgccatgttcttatctaaagtcattttcttcacttgcgtattcagtctcatcctttcttgtcttttccagaatatcactctagcaattattccctcataaattgccaatttttcattccctacaaaatcaaacatgctcttacttctcccactgtaagaaaaatctgacatcacttcccctcccagctattcctttgctcccttttgcagcgaaacttcttaaagaaatgtctgtatttactatttttgatttctctgtttccccttaactcacactaatcaggctttgatgtcaccccatcagtttgccaaaacttgtatcatcaatgtcagtaacctccacattactaaatcccgtggtcatttctcagtttctgttgtttttgatttattagcaacacttgccagttaattacttccctctctgaaaattttattcacttgactttcaggacaccagacccgtgtctggttattccttctcagtttcctttgctggtttcttttttcctctgtaatctcttaaagttgaagtgctgtagttcacgatcccttttttcttgtgtatgtacattcccttggtaatcccatctaatcctgtggattttaagtactgtctgtatgatgatcactctcaaattcaaatctccagccagacctctctcctgaccaccataattgtataaccaactgcccatttattgtctctacttagatatctaatagtcttttttttttttttttttttttcctgagacggagtctcgctctgtcgcccaggctggagtgcagtggcacgatctcagttcactgaaacctctgcctcccaggttcacaccattctcctgcctcagcctcccaagtagctgggactacaggtgcccggccaccatgcccggctaattttttgtatttttagtagagatggggtttcaccgtgttagccaggatggtctcaatctcctgatctcgtgatccacccgcctcagcctcccaaagtgctgggattacaggcgtgagcctccgcgcccggccgtctaatagatgtcttaaacttaatgtgtctaaactgaattcctgatcctcccctcaaacttgctccacacttagttttttcatcttaattgtttgcactgcatcctttcagttgctcaattaactgaaaggatgttcctttcggttaaccttggagtcatcctttacttctctttcataccctatatcaagtcttgtcaggaaatcctgtcatctctacttcaacatgtatccagaatttgattacctctcactacctccactgttaccttcctggtcctagccaccatcatctctggcctgggatactactatagcctcctaacaggtttccctgtgtctaccctttcctcttatggtctgttcttaaaaatcagaacagttcttctaaaacttaagccagatcatgcccttccctctcgccacactcaaatgcttcagttgttcctcatttcatttagataacaagccaaacagcccttcctggctctttgctttctttcctcttctactcttcctctcactctatcttggtttgctttttaaaactggtctcattctttgtgtgtttgccctgtttcccattcctgtagcacccttccctcttcttaaaccgtaccttctcaataattcttatcctgactactctattgaacactgtaaccttctcctgcttccacactcccatcctttttagcgtactcaactctttttttttctgtagtacttatcttttaagttactatgtaatttacttactaaagatgtttgttgtctttccatagaaagtaagatccatgaaggcaagatctttggggttttttccctcaaagatgtatcccgagtgcctggaacactgccttgcacaaagtaggcactcaatgaatagttgtaaaatggaatgtgagaatgattgtttcattgtgtttatgctgcctagtggttacttttagccaggtttcatctagctaattctttggaattcaggtgttacctcttctgttatgattcccctgattagaggcccatcttagcatgtagcccttactataattgttaaattgtctctcccctcctaatagtctatgaagtaggaccttatttaggtggcagtatagtatagggattcaccgcatggacccagtggccaggtggtcttgagtcaaatccttgacctatagtatccacttcatggaatagttagaattgttaatatatgtgccgcttttagaagagtgaatggtacatggtaaaccttatgtataagtgtgagctttctttattttatgatattcctaacaatgtcagggacataggaggttctaaagaaatgtttgctgaatgaaggaattagtttttttgaaagccagggcatttacttatattttaaaattaattattggaaaaacgagttgtagtagttatgcagtggtttgcagctttggctgcacatgaaaattacttaagggagctttaaaaataccattgcctaggctgatagcctagtcagttatcagaatcttgggaggggtgtagaaggtggggttggtgtggaattcaggtattggtgtattttactgctctccacatgattctaatgtgcagccaaggttgagaatcactggttcagtggaaagaatgcagaattcctaggagtcagtaaactgggactttgttcccagctttgcttcaaactgactgctttttggcaaattactccttcatgtctcagtttttgaaaacgtgatctccaaggtcttctctaactgaaaatttgttgatttttatggttttgttaagcttaaatgaaaagtattttttcttttccagtctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaaggtgagatgatatgttgtatttcatttggagaatattttttatgtgctactcattatctaattcagtgttaataatcctttggctttgtggcactatatatatatgtcactagattgtcattctttatttttaatttttttagagacagggtcttkccctgttgcccaggcagaagtgcagtgataggatcatggcttactgcaacctcaaactcatgggttcaagggatcctcagcttcctgagtagctaggactataggcttgtgctaccatgcccagctaattttttttattttttgtagagatgggggtctcactgtgttgctcaggctggtctggaactcttggccccaagtgatcctcctgcattggtctcccaaagtgctcggattataggcatgagccaccgtgcatggccttcattatttatttagattctttgtcaagtctattatagttttatagaattagtatttatttaaagatttctgccatatatggttaaggtcagtaattagcattttttaaatgttgaaaattttattttttaattatgcaaacttgcagaaatacagaaaaatatgttatgaataatataagatctttttgaataaatttgtgtcataagattatgagaaagttttcattgtcttttaaagtacctcacctaataaatgtggcttcgctaaaggagaaaaataaaaactgatgttgacaaagtttcacatcagatcccaagaccattaagatctttggagatacagaaaacaatagagtggctcctcaattcttaatcaaaaatttaaatttcacagcatgtcacttaccttttgtagataagaaattgaatttatgtccgttttagtctgttcagcctacatattattccattccctcacacctgctggccttctctactgtgagttcaacccagaaatattctgaaatatacatgcaaacatttatacacatcttgtactcttatatatagtaaataaatgagctctgaagcctgccagccataatttatctctttttttttctttcttttccccccctctttcattttctttgggaagtgaggaagaaagtagaaaaatctttttaaagcctgtggatttagatagcagcaaaaagtaacagatgccccaactttaacagtttgaagcctggcctgttaataccaaaagatcttcagtagtggagagcatatgtattgtctttttggtgcactgttcttttttcctgggggttatctatatttaaggcttacagatattttcagaaatctgtcatgttattaataataaggatgcagctgtgtcaagactttacagggtagttatttttgactggatcaaagtttaaatattggtttaatttttacttttttaggtttcttgcttttttgctctttcttcctactactgtcttttactttttaatctcactaaagttaaatcttaaaatcagttttttttcaagttgaagccttgagagttttaagtttgttttacttgtttatattgcaaagagcatataactatattaaaaaacactgtgacccgggtgcagtgcctcatgcctgtaatcccagcactttgggaggctgaagcaggcggatcacctgaggtcagaagttcaagaccagcctggccaacatggtgaaactccatctctactaaaaatacaaaaattagctgggcgtggtggcgtgtacctgtagtcccagctactccggaggctgagtcaggagaatcgcttgaacctgggaggcagaggttgcagtgagctgagatcatagcactgtactccagcttgggggacagagcaagactccatctcaaaagaaaaaaaaaaactcctttttccacaatttcatcattgaaactaattacttagttggccttctcagccatcccattattagtgaccttattattagtcttgtttatttttccttttagctttttattttatgagagaaagaaaaaaatgttgcaattgtatttcctcccattttcaggaactttcactgggagtctagcttagaaaaaccccttgggaaaatgtattctcctgacagtttatcagttaagatctacttgtatgagcttggaaatgtagtttgttagtagagacttagctatttaccattttctcttttgctagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaaggtaggatacagtttgtaaatgatctgtaagattttgtggttgttgtatgactatgtatattttttagattagaaatgtaaaaatagctatataaagtggtgacttgttttggaatgatattttggtatgtattttaccttttgtgtttttcatatagttgcctttaaataatgtatataaagcctcaaaaggtttcagcattctattaccagttgrtttcctttactttctcatatatgaaaggattcatctgatatttcatgaaaatcttagcaaaggtagcatgcattttaaatgttgcttattttgtatttttttccccaacaaaagccacattcaagcttatttttatacataaaatttttcttccccccccaaaataaaaggtttgtaaattctaatagtattctactttaaagatatttttagaggggggaaatataagcatactaaaggtagttgagggaaactaagattaatagtcaaaaaaatgaagaatccagattctgtttctgctactgagcctctggatttcggcttatcctatatgaattacaggaatccaaacttttctactttttcttttcaagtaagatagtatgaacttattactactattattttgagacaaggtctggctctgttgcccaggctgaagtgcagtggtgcaatctcagctcactgcaacctctgcctcccgggctcaagccattctcccacctcagcctcctgagtagctgggacaacaggcgcatgccaccatgtctggctaatttttgtatttttttgtagagatgggatttcgccatgttgcccaggctggtctcgaacttgtgagctcaagtgatccgcctgctttggcctcccaaagtgctgggattatagatgtgagctactgcacctggccagatagtctgaactttaactcataaaggaaatcatttaaaatcataggaaaaaacccattgaacaggaagtaagcgataactgctttgtgaataaaacaaagttttaaccgaatcacagtacttcaagtgcattccagataattgcaatatcattattagtatccatgtgaaaaaatgattatacagatcatgcataagccaagtagaatattaaaaaaaaacaaaaggaaagtcatctagccttatccaggcttattgttttatcgtagttattgacaagctttaagatgtttaacctaattattaaatagtattgcctgttttttaaaaatctgctttattaaggtatggctagcatttaaaaagctatagatatttaatgtctacaactggatgtgtttgaacttaagtatatatattattatcactgtcaatgccacaaacctatccatccatcagctccaaaagtaccctcctcttcttttccttttgttgttagagaacttaagaggtaccttattagcaaatttaagaatataatacagtattattaatctgtacagatctccagaactactttgtacagatctccagaacttatttattttgcacaaatgaaactttgtaccctttgaccaacacctccccattttcccctcccaataagcagtatttcttcattctatgtaaatatacatctgttgcattttatctaggttgcagtatttaaggcacatgcactattgaaagcatcaaataaatggcaggtttttagaaaacttaattatataacttcagtttacatgtcttatgctttatactttttttcctggaaacttagggtaagtactgttgttccagttttcatttttactatttaaagagtttcctgcctaaatatgtcattttttaaaaaaagctttgaaaaggtgatagagattcttgtagtactgttaattagcccacagtgcatcattcttacaaagagagatttccttatataatttgtatcagaatttatggctatataaatgtccaggctaacattggagaaagacactttaggatgtaggcatattacaataaagaaaagagtattggtgttttttaaacatatgtgtttctttctttgagttggcataaatttttgtgttttaaccacttgtttggtgtccattgaaatacatttaaaatggttatatagggtttggagttcattttgtggctattggataagttactcttcgtatgaagctaatttatttttagtgttcagtctgcagtttggtctcttgagcaactaatttagtaaattagtttaataatttattaaatattaaataatttaataataaattagtttaattaatttattaatttaataaaccaactaagtgagggttctgtgattgattcagaaaatagaaaatgtttggagtgaaatgaaaggtgcaccttaaaatttctttataacctattttgttagatctcagtaagttaaaaataaatgcatatattttcctttgggagctgtttgaatgaactcatactttctgcatctcctggcattttctgtatcttccattttcaggttaatttaatccttgatataattttagtggggaagaaaaagtggttgactcaaaaaacttttttgtagctaatactgcattttaacaacatgtttttttttttaattacctcctgaaagcacaggttatcaaaactgagttacataaaagatttgttttgaattcacttcctaagtgatgaagtccctcaaargtttattagattagatttctttttatytttgtgtagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttggtaagtctttcattactacaactattgggactagattccttcttagatattaaatattaattttctgatttaaaaacagtttgtttacgttttgttttgctagaggtttttgaatagatacccaagcacagatatttactaaatgactattatgtgcagggcatcatggtaaatgccaaggggaattgagagtccatatatattgcttttaaggagcttaaaatatggatatgagctgtctaacatggtagcttctagcctatgtggcttttaactttaaatcaattaaaattaaattaaaaaccaagttcttcagttttatactagacatatctcaagtactcagtagctacatgtggctagtggctgctgcattggacagcattgttgatagagaacattttcatcactgcagcgttcttggataacactatagatgagttaatatggcatttatgtaaattgccataattggaaatagaatgtgttacatgctatagtagtggtaaacaaaacgcagtgtaaacacaattttatctggggtggattagaggaatcaggattaatgatgtgatatttgagatgaaccttgagctgcatttttaaacgtcaaagattatgcataaaagcatagagtggccgggcgcagtggcccacgcctgtaatcccagcattttgggaggccgaggtgggccgatcatgaggtcaggagttcgagaccagcctggccaacatggtgaaaccctgtctctgctaaaaatacagaaattagctgggcatggtggccggtgcctgtagtcccagttactcgggagtytgaggcaggagaatcgcttggacctgggaggtggaggttgtggtgagccaagattatgccactgcactccagcccgggcaacagagtgagactccgtcttaaaaaaaaaaaaaaaaaaaaaaaaaagcatagagtgcataatttgtttgggggaataattgcctttgatttggtagggtataagaaaggcaatagagagagataagcctataaacatattttggggaacggcttgcatgcctttattcagcaaacgtttacagagtacctgggagtcacctttactcagcaaacatttatgaattacttccagtgtccaggtaagataaaatttctggtcataacatttagtgcttcattgtaatcgctcccttcttccccatttctgcctcccaccaggcaactacttttctgcttttgtcactatagatagtttgcattttctagagttctgtataagtggaattatacagaatgtattctttttttgtctggcttttttcactcagtataattactttgagattcatttatgttgttgtgtatcggtggttaatttcttcttgtatctgagtagtgttccattgtatggttataccacaatttgtttatccattcacctgttgataaatatttgtctcatttcaaaattttggctgggtgggtctgggtatggacatatgcttttatttatcttgactaaatacttagaatggctgggtcatggcacgtgttttttagcagctttattaagatacaatttacatttatttttacttagtaatttatttacctcaatgtgggctcatagatatttgatgccttgggttataattgaatataattttcttttgttcagattattctagctttggccattgggaactcttttacttgactacctggtcccttttatatatatccatcagtgtgtggttttttttgtttgtttgggttttaacacttccatactttctggcactacaagatgctcctggcactgcatgtatattttgtgccctactcctagaattaggcatttgtccaaggagctgtggttccttttattggagaatgagattagaaaccaagacctgaacactagatgtgcttgctgttactgggctgtcactgctttgaggccatctcagagcaacaaaatatgtgtgtatatactaacctatgtatataaacttactataaagatttctatatgtagccgtctttttttttttttttttttggagactgagtctcgctctgtcgcccaggctggagtgcagtggcgccatctcagctcactgcaagctccgcctcctgggttccagccatttctcctgcctcagcctcccgagtagctgggactacaggctcgtgccatcacgcccggctaattttttgtatttttagtagagacagggtttcactgtgttagccaggatggtcttgatctcctgaccttgtgatccaccctcctcagcctcccaaagtgctgggcttacaggtgtgagccacggcgcacagsctgtatgtagccatcttatctgtattaaaccaaacatgatttcataatggtatatccaactcgaactcattaccacatggctcgttttagcccccactccaacagtgagaaacctggttcccaccatctattattcattttttaaattgttccattttagtacatatgtatagcagtatcagaactgttaaccaatacccctgtgggaaacaactttattaactagagtaccgtgcttatgtatggtttcttttgcccttagtcttatcgattccactcattttcaaatttacttaggtcagcacctttccccccactccctcatgtgaagttgtttcatacatttataatatagttagattattttgtcacagtctacattacatcctgagatcccctgacctcctagatgatttttttaaaattgcatacattaaggctcactctttgtgctgcaaagttctgtgggttttgacaagtgcattgtgtcatgtatccaccattagagtgtcatacagaatagtttcactgccctaaaacaagttaacgaattacattaattttwtttaactccccttcttctgtaagcactgataactgcatttgtttttaaaaagctgaatattagtttaattcattataacaaattcttaataaattactgctttgtttctgttactgtgttaacttttggggataagtctggaagagatagggaaaaaaagactttgttcttaagaaatatatggacttatttggaaaaataagatgaatataaatgaaataactagaaaaccaaaaggacaaaataaattaggtaccagactgtggcacacagtttgaagaactaaagaagtgtggaactaaggagagatcattgaaggctgtggttaggcaaaacagtttatagggaagatagaaattttgaccaggcatttgagggaactgttaaatttgagtgggccagatgcctagtatagcaacatgaatacagatcttaacaaatgggaaaataagcatggatatgggggagagtgaagaagtaaataggtttgtagatatacggaaaatgatcatgtgaaatgtacatatatcttaaaaattatttttctgtttcatttattttcgtttcttcccctgggttgctaaaacagaaaaacagtttttttccttctatctcccagacccttccccagtaacatttatggttttaaagtcagagaagtcaacaaataatgaacaaactgtaagtaaaatttttagggtaaaaacttgaagatgttttcagattctgttttccttacttttctttttccttttttcttctttttataaacccagatgagttatcaccaccttgttctgaacaacacaacagggagcaaattttaattggcttggaaaagtttattcaaaaagaatatgatggtatgtcataggttaaaaaatttattgcgtttttgctgtagtcatgtagtcttgagtttcatttatttaaaaatatttattgaatgctatgtgttaagtactgttctagttgctgggaatacagtgctaataaaagagatgaaacctcatgaagcttatgtttcaaatggggagacaaatagttgactaataaatatataatattatatcagcaaataatacatgctgttaaaagtataggagataaaagaactgaagtgatggagtgttatgataggcctctctcataaggtagcatttgaggagaatcctgaataacatgaaggagcaagttatataaatatccaaggagaaaacattgttgatggaacaagaatagattatgtttggcatatttgaggaatagccaggaagtcagtgtggctggagtggagtattagaggtagattgtaatgtatagaagaggtcagagagggggtctagggattaagtcattagtgccttatggatgttggtagaaagcctttgaattttattttgagtacctaatgagaatcttttagaggatttttagttaataaatgacatgatctgagtgaatggtttgctgggctataagactggaagcaagcagaacatttaggaggctgttgtgtgagtccagagtagatgagaagtggtcagatttgggatatattttgaaggtagaaccaataggatttgctgatggaaaatgtgaggcatgagagaaagaaagaaatcaaggatggtttcaaggtttttgctataacagttacagtaggtggtcctatataactgagatggcaaagagcaggaagagtaagttttgggcatggggatgaagaatcaagatttttgtgactaaatattttagaaaaggataaaagttgactttaatcagaatgaatttgtacttttacaagatgacccattatgtgctacatattacaattaaaagtatttgaaaacaaatattttttaaattaaaaaatcatatcatcattattgttttttagagacaggttctcactctgttgcccagactggagtgcagtggcatgatcatagctcactgcagcctcaaacttccgggctcaagcaatcctcctgccttagcctcccaagtcgttaggactacaggtgtgtgccaccatgcttagctaatttattttttattaagaaatattttttttggccaggtgcggtggcttacacctataatcccagcactttgggaggctgaggaaggtggatcacctgaggtcaggagttcgagacgagtctggccaatatggcaaaacccgtctctactaaaagtacaagaatttgctgggtgtggtggcacacgcctgtagtcccagctactcaggctgaggcaggagaatcacttgaacctgggaggcagaggttgcagtgagccaaggtcatgcctttgcactccagcctgggcgacaagagcgaaactctgtctcaaaaawatatatatatatatatatatatttttttttttttttgaaataggatattactctgtcacccgggctcaactgcagtggtgcaatcatgtgatcagggttcacttcagccttgacctctgaggctcaagcgatcctcctaccttagtctcctgagtagctgggaccacaggtgcgcgccaccacacccagcacattattttttgtagagatggagtctcaccatgttttccaagcaggtctcaaactcctgaactcaagtgatccacccacctcagcttcccagaattctaggattacaggcatgagccaccgcacctcgccttcttttttatcttaaaaaatttttgtaaagacaaagtctcaccatgttgcccagcctggtctcaaacgatcctcccacattggttggcttcctgaagcgctgggattataggagtatataaagtattgaccaaatctaagtctctattatataaaatcatgctcagttttatttgctgatgagtatagcttcttttttgcctctcagctatcattgaaatttcaagtagagcatcagaactggatgggggtatgaagttttgaaagtataaagtgtcctataaatgtgtagtctactttagaattaataggaagagccaggcccagtggcacacacctgttatctcagccacttgggaggttgaggtgggagtattgcttgaggcaaggagttcaagactgtagtgtataatgattgtgcctgtgaatagccagtgcactctagcctgggcaatatagcaagaccctgtctctaaaaaaaaaaaagtaataggaagaaaaatccaattctgttaaaccacagcttatttgaaatggtagctgttattggatgacactgagtctgaagggttaaccctatcataatttatatcaagtggactataatcactcatttttggaagagcatcgtatactaaggtgatatttgtaaacctacatgaattgtgctttgaaagaactaatttatttttaagagggcagtcctcaaatattgatcttaactattggtagtgatgttgagaatgtataaaagcagatggatttattatgtaagtcggaaaaagctaaaagtctcaatgattgtttggatgtggacattgagagacagatattaaggattgcacctgtrtttctgatgtgggcatctgtgtacatgatggtactatttgctaagaacagggataatagaaatagtaatagatttggggcaaagttgatagttcagacgtgttgaatgtatgatgtctgtggaaaattggaaaaagcagttgggtacatgggtatgggaacttgggcaaaagcttgggctcaagatgttttggaatttctcagtatttcttccagtggtaggtaatttaaatcatagaaatggacaagagcatgttgtattaggtcatcagcagatagcagaagactcctcctctctgcttataataaggccttggactttgttttcctttgcttagaaaaggcaaggttgtgcttatttggctcttctaagaatggatttggatttcgtgatagtgatctggatatttgtatgaccctggaaggccatgaaaatgcagaggtaagagtgtttggaaagcgttatgtaagtttattttctcccaatgacgattctatgtttatttttgtatgtgatattgataaaaatgtggtatcactctttgtataaatatattagcaaaataagtgtttgaaatatgaaaacagtagcattttcagtttagaagacattgaactcttaagtaaaagtgtttcagtaattttatgatacaaaaaccatgtcactgagagttacagtgatttgtaatgaattttgggaaaaaatatatcacgaagttggaattttttcactagaaccaatgggaagctgatgcatcagttttgtagtgaacattgatctttcatactttgtcttctcatatctctttcattagatgatgtctttgtgttactataggtagtaaatataggtggtcatctaatttataattggttttgttctaaaagttagttataatttttgaccactcacataaaattttttccatagaagcaatgttacagatgatatgctaagggctgggcgtggtagctcatgcctgtaatcccagcactttgggaggccaaggtgggcggatcatgaggtcaagagatcaagacactcctggccaacatggtgaaaccccgtctctacgaaaaataaaaaaaattagctgggcatggtggcacgcgcctgtagtcccagctactcaggaggctgaggcaggagaatcgcttgaacccaggaggcggaggttgcagtgagccgaggtcacgccactgcactccagcctggtgacagagtgagactccgtctcagaaaattaaaaaaaaaataaataaataaaatgctaagatagcttttagaaactcattttgggcggggaggagaactaacatttattgagttcccagtatacacttttacatacattatctcatttcattcttacaaccaccttcgaggtaggtattatttcccccattttacagatgaggaaactgaggctttgaaagataaactgacttgtccaagttcacacagctagtaattgttggagccgggattcgtaacccaggtctgtctgactccagagttcatgctctttccattgtatctcactgcctctctgtaatttttttaacccataatgtwgctgaaatatagtactaatagtactgtagaacctaaccactgctttctgaaactgatagctttctgagttccaccgtgagatgccaggagcagaccttccccaagtgcaatttcagcagtaagagtgggtacttacgctttccttttttgtataccaggccttaatagtgggaaggagattgtccaagctccagggaagaaaaagactgattggacagggaagaagtgtcccaggccttctcaacagcaactagcaaaggagggtatcyttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacrggagaatggcatgaacccgggaggcagagcttgcagtgagccgagatagcaccactgcactccggcctgggcgaaagagcaagactccgtctcaaaaaaagaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtatgaattttraatcttatctgtaaaacaaaataaatttttttagcatatatgaaaattatttaacctactgaagtcttttttttttaaattaggtttaagaaacattttgcctataactactgccaaagtgcctatagtaaaatttgaacacaggcgaagtgggttagaaggcgatatcagtttatataatacgttggtaagtttatctttataggccatgtatatacttttcattttaaaagtttacagattactgactctatgtttaaaactttcaaatgtgaacagtataaggaaaaagtattttactagttatcttgatagttccttcagattgaaggtcagtttttgtttgactcattaataggtgttttacattttacatttatatattttgtatttggagtgtattttacttttaaatctgatttgtagtttaattttacgaaatttgaaatcctttcaaatatgtaattatttttcaggctcaacataacacaagaatgctagctacttatgcagctattgatcctagagtgcagtatttgggatatactatgaaagtgtttgctaaggtatttatgaaaaaattaatgatctgctttgttcatgataattaaaatgaaacataactaatgtcagatttgtgaaaaattttgtctcagttttgtttatctgagcttttaaaaaagaaactttcagtattatatagcttgaatagatacctatcagagtagggtggctctgtctttttttcctgtatgtattctattcccatgtgcaactgactagtcagtttctcagcagtaacatttctcaatgcagtgatttyagccccaggcatgggagttggcatatcatcctagttaagaatttctgagttaagaaatcttatatttgagtttagtgataagtttttctgacccagaaaacaaaacaataccaataataccttacgcttctcctattataacacttgttatgacattgaatttagttttctcattcttttgctaattgtgtaaactaggtgagaacaggaacctctgtttctctagttcattgtagtgcctgctttgtggtagctgctcagtggaatgattaattttattaatgtgttagtggaagagttttagtaggggagaaagttggtcagattttcatttcataaagcttcctctttctaataggaaggctattgttgttgttgttgttgttcctgttgttgagatggagtctcactctgtcacccaggctggagtgcagtggtgggatctcagctcactgcaacctccgcctcctgggtttaagcgattctcctgcctcagcctcccaagtagctgggattacaggcattcaccaccatgcctggctaatttttgtatttttagtagagacggggtttcaccatgttggccaggctggcctcaaactcctgacctcaagtgatcctccagcctcggcctcccaaagtgctgggattattgtgcctgactggaaatcatatttttaaagatattcctgtacatgtctttctagacaagagtgtatcttagaaaagcatagaggcacatactacatacaagacttgatatgcctacttttctagattcacctaacaaggtaactctaacatgacagttttgttataactacatagaattctgttaattaaatcaccccttttccctttaaatatagatataagctaaatccttgctcaagggaagaagtctctgaagattctttcaggtttcattcctcctccctctcctctcccccctcccctatatttttttaatttttattttaatttcatgtttttttgagatggcgtctttctctgtcacccaggctggcgtgcagtggcacaatctcggctcactgcaacctccacctcctagattcaagcagttttccctgcctcagcctccagagtagctgggattacaggtgcctgctaccacgcctggctaatttttgtatttttggcagagacggggttttgccatgttggccaggctggtcttgaactcctgacctcctccgcccgcctcggcctcccaaagtgctgtgattagaggcgtgagccaccacccccagcctttatttttatttttgaggcaggattccactctgttgcccaggctggagtaaagtggtgtgattacagctcactgcagccttgacctcctgggctcaattgatcctcctacctcagcctcttgagtagccaggactacaggcgtgtgccaccatgcccaactattttttgtatttcttgtagagatggggtttcgccatgttgcccagactggtcttgaactcttgggctcaagcaatccaccctcctcagcctttcgaagtgctgagatgacaggcatgagccaccatgtctggcttccttgttcttttttttttttgagacggagtctcgctctgtcgcccaggctggagtgcagtggtgctatctcggctcactgcaagctctgcctcctgggttcacgccattctcctgcctcagcctcccgagtagctgggactacaggcgcccgccaccacacccggctaacttttttatttttagtagagatggggtttcaccgtgttagccccttgttctttgttttttatttattaaaaaagatgtttatcctaaccacgagaccatcaggggacttcgttctttttttaatggttgcataccattccattatgtgaatagtcgttaattattttaaacctgcgcctgcactttattgatgaacctaaaactatttctgattttttgctattaaaatagtgctgcaattaaaaaaaccttcttagtcatttcacatatgttttggcatgtttgcagggtacattcttagaataggattgctggttcaaagaaaatgtgcttttgtaattgtgatattgtcaaatattcttcatagtgtttgtattaatttatactctcacctgcagtgtgtgagagtacctgtttccccacgtcatgtatagtagttttttgtttgtttgtttgtttgtaagatggggtctcactgcattacccaggctggtcttgacttcctgggctgaagcttttctttcacctcaacctcccagagtgttgggattatagacggtgcagtttgtttttaactcagtttaacccagttctgtgggttaaaaaaaatgatgtggcagaatgtttaatatacttctgcatggagtaagactctgaagttttgttttcaatcatgttgttttttagcgatgtgacattggggatgcttccaggggaagtttatcttcatatgcatatatccttatggtgctgtactttctgcagcagagaaagccacctgttatcccagttctacaagaggtaggtgtttaagaaaactataaaggagttttttttkaaaacaatagatctaaacacaggagattttgcttggttcatgtcatcatgaaggatttttccatcatggttgtcctaagttttctctttccattaatgctataattaaacaatgaatatttttgaaaaatttattatgggagaatatagactaccaaaagaatattagatgaatagaaccattgaatatcttttgtaatgtttttaaattttacagtcttagagtgctgtggatgattgtgaagttcttgtagccagccatgaactcatatattttatagtctccaagatgcaagtacataagtttcttctttctagaatattttccctcctgttgcctggcaatgaagattgatttattcttatgtatactttggtcaaccttgtgaattttggtttagaatgaacccagggaaactcttccttatctcttctgaagtcatattaattacattaaacataagaatgtacattgaaagaaacagattatactcattcactcagaattggtgacttataaagttcctttttgtagtcaatttatactctctgaaattggtacaaaggagatattaatcatccatctgttccgcctgattcttggcacaaagtagatttgtaggcgttagggaggatccaattcaaattttttagaatggtgactatttttatttaggagacaagcatcagacttggttggaaaagtcacatattctggtttcacataatctttgatagttatggcaaagaagaaaatcacaaaataggctgggcgtggtggctcacgcctgtaatcccagcactttgggaggccgaggcgggcagatcacgaggtcaagagatcgagaccatcctggccaacatggtgaaaccccgtctctactaaaaatataaaaattagccgggcgtggtggtgcgtgcctgtaatcccagctactcgggagactgaggcaggagaattgcttgaacccgggaggcagaggttgcagtgaactgagatctcaccactgcactccagcctggtgacagagagggagagtccatctcaaaaaaaaaaagaaaagaaaaaaaagaaaaatcacaaaattataagccatatagtaggtgtcagatagccttagtaagttttaagaagttctaatgaatatatatggttttaccagcgtttccttccctgttttaaacaatggatgggaatcctttcctagccaaagatttaagttgctgaatctgtgttgggtgatgtatgtttgggtgtgtgtttaaagtattttttcagagcagttttaagttcacagcaaaattgagaggactgtaaagagtttccaacatacctcctgtacccacacatgcatagcctcccccattattaaccccaccagagtggtacattttttacaactgatgaacctacattgacatataatcacccgaagtccatagtttgcaattaacatttattcttgatgttgtatattctaagggtttggacaatatataatgatgtacacattttatcataatcaatgatacatcaatatatgccattacagtatcatacagttttcagtgccttaaaaatttttgtactttgcctagtcatcctcccctcaacccctggcaaccactaatctttgtgctgttgtcttcatagttttgacttttccagaatatcatattgttggaatcatatagtatgtagccttttcagattgacttccatcactcagtgatatgtgtttaaatttcctccatgtcttttcatggcttgatagctcatttctttttctttttctttcttttttttttttaatttttaaatgttcagacttttttgttgaacctctaaatctattttatctttttttttttttttttttttttttttgagacacagtctcgctctgttgcccaggctggagtgcagtggcatgatctcagctcactgcaacctccacctccggggttcaagcgattaaagcaattctcttgcctaagcctcctgagtagctgggattacaggtgtgcaccaccacgccctgctggtttttgtatttttagtagagtggggttttaccatgttggccaggctggtctctaatgtctgacctcaggtgatccacccgccccggcctcccaaagtgctgggattacaggcatgagccaccacgcctggcctatcatttctttttagtgctcagtaatactccattgttgggatgtaccacagtttattcattcacatatggaaaaatatctgttttacttccaagttttggctattaagaataaagctgttacagacatctgtgtgcaagtttttgtatggacatagttttcaggtcttttgggtgaatacgaaggagtcacattgctgaatcatatgtacgagtatgtttagttttgtaagaaatggccagctgttttccaaagtggctgtaccagtttgcatttctaccagcaatgtgtgagagttcctgttgctccacatccacccagcatttgagtacttgtccatgttctggattttggccattcttttaggtgtgtagtagtctttctttctttcctttaggtgtataatcatctgtctgtctgtccatccatcctcccttcctccttccctctccccccctcccctgccctcccctcccttcctctcccccgtctttttttttttttttttttttttaaaggtagcgtctcactcctgttgctgcccgggctggactgtgcaatcatggctccctgcagcctcaacttcccaggctaaggtgattctcccacctcagcctcctgaatagctgggactacgggtgcacaccaccaagcccagctaattttttatatatttagtagagatggggttttgccatgttgctcaggctggtctcgaactcctgggctcaagcccacctcggcctctcaaagtgttgagattacttttaatggcaaaaccgcaattacttttgcttcaatctaatattttgttttatttatctatttatttatttttgagagagggtcttgctctgttgtccacgctagattacagtggcacaatctccactcactgcaacctccacttcctgagctcaagtgatcctcctaagtaagcctcccaagtagctgggattacagacatgagccaccatgtctggctagtttttgtatgttttatagagattgggtttctccatgttgcccaggttggtctcgagctctgggctcaagtaatttgcctgccttggcctcccaaagtgagtgctgggattacaagtgtgagccacctcacctggccactgttgttttaatttgcatctccctgatgacattatgcggaaatcttttcatatgcttattttgccattcatatgtcttctttggtgaggttctttggtccatttttttaaacaggttattttcttactgttgagtttaaggagttctttgtgtattttgaataatagtcctttatcagatgtgtgttttgcaactatgttctccatgtctgtggcttgttttttcattcccttgacgttgtcttttgcagagcagaaaattttaattttagtaaagtccatcttgtcaattatttctttcatagctcttgcctttggtgttgtgtctaaaaagatatcactatactcaaggtcatacagattttctcttgtgttttcttccaggagttttattttacatttaggcctgtgagccatttagagttaatttttgtgaacggtataaggtctatgcctagattcattgttttgcgtgtggatgttcatttgtttcaataccatttgttgaaaagaatattatttctccactgtattgtctttgctcctttgtcaaggatcagttgactatatttatgtactatatttatatacttttgggccctccactgttgcattgatttatttattatttcaccaatgccatactctcttatttatagtagtgttataataactcttgaggttgggttgcatcagtcttgcagctttgttcttctccttcaatattgtgttagctattctgagtcttttgcctctctatgtaaactttagaatcagtttgtctatrtccacaaaatgacttgctagaattttgattgggattgaattgaatctggagaccaagtagggaagaactgacatcttgacaattttgagtcttcctgtcaattataatggaatatctctccatttatttagttctttgattttgctcatcagagttttgtagttttcctcatgtagcccttgcacatattttgttagacttacacctatgtatttcattttttggtgctgatgtaaatggtattgtatttctaatttcaaattccacttgttcattgcatgtatctgggaaagtgtttgaattttttatattaatcttgtgtcttgtaaacttgctgtaattgcttattcttggagtattgtttcaatttggattttatgcatggattatcatgtcatatgtgaacagttttatttcttctcamcctgtataccttttatttccttttcttgtttcattgcattagctagaacttccagtgtcagcattacctaagacttcccagatgttgaaaaggagtggtgaaagagaacatccttgtattattcctgattttacaagggaaagcattgagtttttcaccatttgagtatgatgttagctgtaggatttttgtagatttgtttaacaagctgaggaaattttcctccattcttagtttatagagttttttttttttttaatcatgaatgtgtgttggattttgtcaaatgctttttctgcatctattgatcgtgacttttcttctttagcctgttgatgtgatgggttactaaggagaaaacacacactcaaacccaaaatgctttttatttcttttttttttttgagacggagtttcgctcttgtcacccatgctggagtgcagtgttgcaatctctgcttactccagcctccgcctcctgggttcaagcgattctcctgcctcagcctccccagtaggtgggattacaagtgcccaccaccatgcccggctaatttttttgtatttttagtagagacggggtttcaccacgcaggctagtctcgaactccttatgtcaggtgatccacctgcctcagcctcccaaagtgctgggattacaggcctgagcccccacgcccagcccccaaaatgttttttctattctcttactcaacaacaataatcacagaagacttctgtgaccaaatgtgttgggggggttttccccatataccaagcaagcaaccacttctgcgttgaacaccatggtgtcctccaattcaattctggcaccatctgtagtatcagattccactggttgacggctcagtcccacaagactatccccagtttagacaccagttgcaagtctaggccctccagaacttctgactgaccagcttaaagtttgggttcctatgacgacctctttgggtttgattaatttgctagaatggctcacagaactcaaccatttacttaggcttactggtttattataagggatattacaaaggatataaatgaagaaatacataaaacaaggtatgggagaagggatgaggagttttcatgccctatcagggcataccaccatctaggaacctccatgtgttcagctatcaagaagctatttggaccgagacctttgggtttttatggaggcttcattacatatgcaagattgattaagccamgctgttcgccattggtgatcaacttaacctttagcccttctccgctccccaaaggttggggtatagggctgaaagtcccaaccctgtaatcatgccttggtctttctggtgaccaacccccattttaaagatacctaggggctgtcagccagtagtcaacttgcttgcatacaaaaagacttctctttggagattccaaggatgttacgagttgtatgtcaggaaatgggtttggaggccaattataacatcacaattacatcagttgagtttgagatgttgaacctgctttgtataactctcttttgtacattattggatttgatttgctaatattttgttgaggaattttgcatcattgttcatgagagattggtctgtagttttctttacttacaatgtctttgtctggttttggtattagggtaatgctggccttgtagaatgagttaggaagtgttccttctgcttctgtcttcgaaagatgaggcagaaggaacacttcctaactcattcttcgagaattggtttaatttcttccttaaatgtttggtagaattcatcagtgtacccatctaggcctagtgctttcttttttggatggttattaattattgattcagtttatttaatagatataggcccattcagattttctgtttcttcttgtgtgagttttggcatattgtgtcttttttttttttttgagatggaatctcactctgttgcccaggctggagtacagtggcgtgatctcggctcactgcaatctccgcctcctgggttcaagcaattctccttcctcagcctctggagtacctgggattacaggtgcccgccaccatacccggctcatttttgtatttttagtagagacagcgtttcaccaatgttggccaggctggtcttgaactcctgacctcaggtgatccgcccgccttggcctcccaaagtgctgggattacaggcgtgagccaccgcccctggctggtatattgtgtcttttaaggaattagttcatttcatctaggttatcaaaattgtagttcatagtgttattattcttttaatgtccatgagatatgtattgatatcccctctttcatttctgttgttagtaatttatataccttctcttcttaattagcctggctaggagtgatttgttttttaacaaatttgttcactggatgatatttaaaatttaccataaattaattaggcctgccaaggccagcattactctctgtattcttattcttattcttattttttttttttttgagacagagtctcgctctgtcacccaggctggagtgcagtggcgcaatctcggctcactgcaagctccacatcccaggttcacgccattctcctgcctcagcctcccgagtagctgggactaaaggcgcccaccaccatgtcaggcttatttttttgtatttttagtagagatggggtttcaccgtgttagccaggatggtctcgatctcctgaccttgtgacccgcccacctgggcctcccagagtgctgggattacaggcgtgtgccaccgcgcccagcctactctctgtattattataatcgttgtttaggctttaaatagggatcatatgtactaattctccagtaatatcatttgccactttgccggaatactatgattaacaaaaatggaccacaaatttgattttcttggtggtttgtctgtattctctccttacccatggattaggagtcactgaggtagcatgaagtaatagaaataccaaggcatggtatttagagccagaaataactagtcagaatcctaattctaacattttggccttaacaatctgcataagtctgagtttcatcatcattaaaaatgtaataatgataatatttcagtgttgatatgaggaacagaaacatttaatgcttttgaatgtagtaggtgctaaagtagacattcataaacagtgcttgcttttattattatttttactattatgatttatgctcattagcagcattattgctattattattggaaaaatgtaggtaggactaccatattcaactttaaaaactctttcattatctgtttaacagacatctgcttaatattgatcaaacaagagacagttcatggaatgtttcctatcataatgaggtttgatttcgggggactttgtgatatatatagactgatgatacatggaattttgtttctggccttttttaatggttgtcatatgggacctcattgtccattgctctggcatcatttaagtattgaccattggcatcaattatcttttaagggtaaggatatgtttaaagaagctaatgatgtctgcctccatttgtaattaagctttaactttatatggctgggtattactaaggcacagctaagagcatttttttgatggtcagcagtactaagttctttacgtcaaaaagagctgtcctaggcagaagatttttgctctaccctagcaaatcataataagtaaaagcaaattttcacataaaaattaattccaaaaaagatttgggagtgttcacacatgattttatgaaaaatttttttaacccatatcagcttaaaatttgcaacttaatgaatgaatcttgaggacattatgctaagtgaagtaatccagtcacagaaagacaaatactatttgattctacttatatgaagtacctagagtagtcaaattcatagggacagaaagtagagtggtggttgccagggaatctcaaggagggagaaatgggaagtaatagtttcataaatacagagttttagttttaccagatgataagatttttgtgaatggatggtggtgatggtagcgtgacagtatgactatacttaggccgcaggactgtatgcttatgatggtaaattttatattttgtgtatcttaccacaactaaaaaattacaagttaggccagtcgcagtggtttacacctgtaatcccagcactttgggcggccgaggggggtagattacttgaggtcaggagtttgagaccagcctggccaatatggcaaaacctcatctctactaaaaaatacaaaaattagccaggcatggtggcatatgcctgtaatcccagctacttgggaggctgaggcacaagaatggcttgaactggcgaggtggaggttgcagtgagctgagattgtgccactgcactccagcctgggtgacagagcgagactctgtctaaacagaaaaatgcaatgtaaatataacagtacatattagaatatcacaataagataagaattttggaaatgtttagggtcattctttacataaatatgattgacttatttggtgatccttataatatgattgacttgtttagagggaggactgagtgctaagttgaagatgattcgtgttgaatgagagagaacagagagacagcagggagagagagtgtgtgtgtgtgtgtctgtgtgtgtgtgtgtgtaaaagtgtatagcattagtgcttctgggggctgaaacagagtggagagaattaaacacagtgaaacatgagaattcaaaagaataggcaaaatgagtgatgattaacgttacaaggcccacagacctactccactgtgttatcagccaacgtagttgggctggatcatggatattactgagaagtatgaaatctcttaaaaacaatcatgatctaaagagttggattgttgttactcagaagtatgaattatctcaaaacagggttctaaagaggtagtttatttcaatatctagcaaataaatctgtgtttacaaaacatgaaatacctataatagcgtctgaatctttaaggataaaatattacatgtcagccccttaatatcttcacttctttcttgaggtcagaaatcctatgtcttttgtttcagatattaatagctgcaattgcctctttttttttttttttttttttttttgagacagaatctcgcttagtcacccagtctggagtgtagkggcacaatctcagctcattgcaacctcaatctcctgagttcaagcgattctcctgcctccgcctcccaagtagctgggactaccagcacgaaccaccacgcccagccaattttttgtatttttattagagacggggttttgccatgttggccaggctggtcttgaactcctgacctcaggtgatccgcctgcctcggcctcccaaagtgctgggattacaggcatgagccactgcgcccggcctcagtctttcacttttgttttatgaaatgtcggaatatgtgctagatgacttttagtaaactgtatctgtttaagtaatatgtaaatgttaaaaagcaacttattagccctagtccctggaagcttgatttctgtgtaacatacttacatattaaatatagtcattcaacaaacatatattaagtgttctctatgtggctttggtctagtagggttctgggtttcagagataagccatagtccttacccacaaagaacttaaatctgaggataaaattggaggggccagacatgtagttaattttataaatcactgtcacatcaaaaatggaaatggccattgggcccaggcccaccttaactagtggatttaaatggtattgtggtttaactgtattctgggacccattagtcacggtagagggtaaagagaaggtggtgtggtatgttttctccatttataaactactgactgactaatttatatagtctttcctcattttcactgggaaaagtgagcacttagggagatgattgtcttgcccagaaccactattcctcaggatagaggctagaaattaggtctcctgactgaatctgttgcaccttcctactttattgcatctcttaagcctcctttagaataaaagtatcaattacttgtggaagtcagttacacagacatcttacgggatacttttcttgtaaaaatagcgtttttttctccttttttcttctccttaggacagcggattattattcataataaagtttatagtctttatcaaaatgtaagggaaagcttcctaattttccttttttttttttgtttttttgtttttttgtttttttttggtgagatggagtctcgccctgtcgcccaggctggagtgcagtggcacgatctcggctgactgcaacctctgctttccaggttcaagcatttctcctgcctcagcctcccgagtagatgggattacaggtgcacgccaccacgcccagctaattttttgtatctttagtagacactgggtttcaccatgttggccaggctggtctcaaactcctgacctcatgatccaccattctcggcctcccaaagtgctgggattacaggcgtgaaccaccgtgcctggccctaattttccatttttacaaaatgatagtccaattgctttttagccttatctgatatagataaatgattaaaggtactaggtcccaaaacagttctgttgccttcctttgggtgcacaatcagtgggtattatctattttgtatttttatatctgtgatcctttgatgaaactgctgtttcatcatgactgctgtttcttttttaagttttgcttcattattcttggactggatatgttttgataggtcaagtagataacatcaaatgtatcatttggagtttaatgctcttaaaagacatccttttccagctttggtctttcagatacgttttattcattaacttcttggcatcaaattataccatcatcctgacatgttctttttggaagaagtattttagtatgtcttataggtaaattctaaaatggtattagagtatttggacctttgggttggatcacttgaaatctaataatacaattaatttttttatgcagatctttgatggaaaacagattccacagagaatggttgatggatggaatgctttcttctttgataaaacagaagaactggtaattttaaaatagtctttatgttctagaatgctcactgatatatgttagcatctgtataatttaataattttacttaaatttgctgtccatgttttggatagtactgtatagacattgttcttttctttttttttttatatgtagaaaaagcgtttaccttcacttggaaagaacacagaatcattaggggagcttyggctgggactgcttcgtttctatactgaagagtttgatttcaaggaatatgtaattagcattcggcagaaaaagctgttgacaacttttgagaagcagtggacttccaagtgcattgcaattgaaggtaacatttaagctgatattaattcaggagcaaccaaaatttggtcaacgaaattgaggggaaaactgawatacattaggatttggaagattcttcctcttttatcagttttcctcctttaatgtgtaattttagaggaagagtttgctgatttgtatagtctgagtacatataagtattagacttcagcggtgacttctaagtatatttttatggtacagtgaatgtaattcttaatcattgatatatttcttttgtagacccttttgacttgaatcataaccttggtgctggagtttccagaaaaagtaagttttaaatatagagattctctgattttaaaactctgacacattaatgtctgcatctttattgttttcttctttctttaatagtgaccaatttcatcatgaaagcatttatcaatggaaggaaactttttggtacccctttttatccactcattggcagagaagctgtaagtttacattatatgaattgtgaatcttttctttttttaamtagaacaaraaacttaattgtgtttccaaactgatgttagatatagggaaagagatggtcatagctttgtatattttttcttattgcatttatcatagtccatagtgagatatatattttcaaaattttatttgtttaaactatttgttaaattctgtcttctccactagactataagccccacgaagacaggattcatgtctgtaaggttcacctatttccagtacatacatagtgtctggcgcattggatgtaccaaataaggatttgttgagtgaatgagaatagtcagtcaagactctggattgttgaattttaggtgctgctcattgtccctcttttatcttcagaaatctcgatgaaaatatacacatagaagacaaaaccgaagaaatattttattatttgttggggcttctctaatttttgtatagctttagtaagctgaattagatggcatggaaccgagaagtttccttctacctgaattgggtgggagagtgtcacacattcctcttggcctcactctggtttttgcctgctttcttatggttagggagactgcaggaggttttagcttcagagcaggagacttagaagaaatctcaagaaagagaacaaatgtattagggttctcttagagggacagagctaataggatatatataatcctattatatatatacacagacacacacacacatatatatatacacatatatacatatatatacacacatacatgtatatacatatatatacacacatatacatgtatatacatgtatatacacatacatgtatatacatatatatacacatacatgtatatacatatatatatacacacatatatgagtttattaagtattaatttacatgatcacaaggtcccataatagagtgtctgcagctgaggggcaaggagagccagtccaagtcccaaaattgaagaacttggagtccgacatttgagggctggaagcattcagcacaggagaaagatgtaggctgagaggctagtcctgtcttgccttttcacatttytctgcttgccttatgttcactggaagatgattaaattatgcacactagattaagtgcagatgtgccttccccagcccactgactcaaatgttaatctcttttggcaaaacccaacagacacacccaggattaatagtttgtgtgcttcagtccaatgaaattgacattcagtattaaccatcacaacaaacgtgcatttacattgcatagtgaatgtccttgaacttgttcagtccagtttcaggtgtcttatttcttgggggtagaataagaaaagcagagagaagtcttcttttcccttggagcactggttctcagatacttttattttctagcctcttatggggtaataataattaaaatggagaaaaataaaataatagtaaaatttgaaacaatgcaaaaaatgtaaaaacgaaattactgaaaaaaggaaaaccaaacaatttttttttctttttttgagacggagtctcgctctgtcaccaggctggagtgcagtggcgtgatcttggcacactgcaacctccgcctcctggattcaagcgatcctcctgcctcagccgagagtagcagggaccacaggcgcccgacaccacgcccagctaatttttgtatttttagtagagaggggatttcaccatgttgaccaggatggtctcaatctcctgacctcatgatccacctgccttggcctcccaaagtgctgggattgcaggcatgagccaccgcatttggcctaatttgactaatattttaattgaaatagaaacaatgaaaaacagatcaaaacaaatacaatgatacactgataaagcattttacctgagaattgtgaggaatccaactatttgtgtttatatatgcatatgttcagtaggaacctcacagtgttgcatgctgtcagacctttttgtttatttttgtttttttgatacagggtcttgctcttgtccccaggctggagtgcagtcgtgcaatcatagctcactgcagccttggacacctaggctcaagtgatcctcctcccttggcctcctaaagtgctgagatttcaggcatcagccaccatgctcagccccatgtagtgacactttttttttttgagacggagtttttgctcttgttgcccaggctggagtgcaatggcgcgatctcggctcaccacaacctccgcctcccaggttcaagcgattctcctgcctcggcctcccaagtagctgggattacaggcacgcgccaccacacctggctaatttttttgtatttttagtagagacggggtttcaccatgctggtcaggttggtgttgaactcccaatcaggtgatccgcccatctcagcctcccaaagtgctgggattacaggcgtgagccactgtgcccagcctttttttttttaattttttttttgagacagagtctcactcttgtttcccaggctggagtgcaacggcacaatcttggtgcactgcaacctctgcctcccaggttcaagcgattctcctgcctcagcctcccaagtagctgggattacaggcatgtgccactacgcccagctaattttgtatttttagtagagacggggtttcgccatgttggtcaggctggttttgaactcyggaccttaggtgatccacctgcctcggcctcccaaagtgctgggattacaggcgtgagccgctgtgcctttccgagactttttagtagaatgctaaattagagtcctcggtaaactggaaatgggcccattttagtttatgcatgcaaatttttagtaattcttaataatgcaatatattataattacatatagatgtcaaaatctttggtcttgaatgtcatttggggcctagcagaaggggcccatgagtctgctaatcattttttgatttattttattctctttcaaaagtcagtatgtagtattccataacttggatatactagtttatctaacttttcttttgatggacatttaggttatcttcattatgtcagtgttaacaacttacacaggttgagcactccaaatctgaagcctgaaatttactgagcactgacatgaccctcaaatgaaatgctyatrtggagcatttgagatttcagattttctggtttggggtgctcagctggtataaatgtaatgcaagtattccaaaatccaaaacacttctgatctcaagcattttggataagggattctcaacctgtatggtcaaaaatgtccttgtacatagtctttcatgcttatacttcatacctatttcactcctagttactgagattataacagcatgcaagatagatttgccttatttccctaaattaatgaaagataaagataagtatatttcctgtcctttcatctttcttgttctttcagttatttttctacatcattatgttctcctatatattgacccattttgtccctatccatcagctgtcttctgtcatttttcttccccatttaacttacattttgtctgctctctagcatacactttggcttttttttttttttttgaggtggagtctcactctgtcacccatgctggagtgcactggtgccatcaaaactcactgcagcctccaccacccaggttcaagtgatcgtcctgccttggcctccagagtaactgggattacaggtgcacgccaccatgcccagataatttttgtatttttagtagagacagggtttcaccacgctggccaggctggtcacaaactcctgacctcaaatgattgcccgcctcggcctcccaaaatgctgggattacaggtgtgagccacctcgcctggccatctgacatataccttgaattgctttgtgccacagtccttcctgtgcactcttctgtattgtaccttatatgaattcaggtatccaccatgtgcctgtccttgggtagctgtacactaatggaaaaaagtaaaaaagctagacaattttaagtatatagtacagtcataaacgtttaccagcctcaactggactttcagtactgtgtgacagtcatatttctttagttacctttagctcctattctattagaactatttcaaatttacttattttactcaaaatgcagtatgccggccaggcgcggtggctcatgtttgtaatcccagcactttgggaggctgaggcaggcagatcacaaggtcaggagttggagaccagcctggtcaacgtggtgaaaccccatctctactaaaaatacaaaaaaaaaaaaaaaaaaaaaatttagccgagagtggtggtgcacgcctgtagtcccagcttggctgaggcaggagaatcgcttgaacccgggaggcggaggttgcattgagctgagattgcagcactgcactccagcctgggcaacagaacgacactctgtctcaaaaaaaaaaaaaaaaaaagccatatgccctgcactttgtcccaccttttacctctgcccttctcactccagtggatgcttttcctctgagacagtacgtagtatcaaataaatagtcctttagctttctgctactagatctataaatctacctgcatctataggtatctcttctttatgaaaaattacttcttacatatgtactctagattattctgtctactttgagtcttcaacctcttcatctgtgaaaagcgttttcagttaaaatacataaaatgtcattgcagatcagcatttatagatgaacagttgctctcagttttaatgatagggaacactaactttgaaccccaattaaatgaactgttatctccctccaaaataattmtattcttagtggtaaacttataaaagattatatctaattattagtattagcatatttaacatttcttcaataaaatttttttgtggaaatttgctttctctcattatgtaagtacgtatattacatcttcaattttgtcacagcacctaaaagatttactacttgactctttacagaataagtttgttggcctcaggtgtaggccgccctaactggggcggaaggatagagaaaagtggattcaagagatattcagcaatagaatggatacaacttggtcattaattaaaagtgatgggtgagagagaacaagttcaggatgcttcttaggtttctgtcttaagcatcttgggtgaattaagacctttatgttgtcctggcaaaaactaggatgatgattttaattagctacattgatttatcagtagtaatgaagaattgtatctcttgtctttaaaaaaaaaaaaaaaaaaaaaacacaggatgggcatggtggctcatgcctgtaatctattactttggaaggccagggcaggaagatcgcttgaggccaggagttcaagaccagcctggccaacacagcgagatgctgtctctaaaaaaccaaataaaaccaaaccaaacagcttcattggaatagagtccacattatatacaattcactgtgcaattcagtggtttttaatatatatacaggattgtgcaaccgtccccacaatttaattttagaacattttcatcttctctaaaataaacccttgtcctcattagcagtcagttctcattccgtctcttcccctcttctcaaaccactaatccactttttgtctctgtagatttgcctattttggacatttcatataagtgaaatcatatgatatgtaacattttgaaactggcttctttcattttagtgtgatgttttcaaggttccttcatgctgtaccatgtatcaatacttcattcccttttatggctgaaaaatattccattgtatggatataccacattttattatccattcatcagttgttggacatttgagttgtttctactttttggctattatgaataatgctgttgtgaatatttgtgtgcaaatttttgtgagaatatgtttttatttctcttggtatatacttaatagtgtaattgctgtgtcattttgataaatttatgtttaacttttcaaggaactgttttctaaagtggctgtgctactttacatycccaccagcaatacatatgtgttctagtttttctgcatcctcaccaatacttgttattgtctttttaaagctataggcatcttattgggcgtgtctcttatacttttatccttgagtttaggtaaatgtgacaacacctaagtggacatgttctcttgacttccagaaggatggacactgttaggaccaactagtcttcgtgacagtgcaaaactaagctaaagtttagaaggataagcaaggtgcaaagataaagcagaaataagtctggttctaagactttggaaaattatttacttctttttagttccctaccttttctttaggtctgttcctctttacataatacatgttacatgttcttaaaaagctgtattaaatccaatcatatttcacataaaccagataattgctttttttgttgttgttaatttatttatttttagtttttagagacagagtttcgccacttcgtccaggctggagtgcagtggctattcataggcacagtcattatgcactacagcctcaaactcctggccttgagtggtcctcccatctcagcctcctgagtagctgggactacagactttttttttttttttttttttttagatggagtcttgctgtgtcacccaggctggagtgcagtggcacgatctttgcttactgcaatctccacttcctggattcaagcaactctcctgtctcttcctcctgaatagctgggactacaggcacacgccaccatgctcagctaatttttgtgtttttagtagagacggggttttgccatgttggccaggctggtctcgaactcctgacctcaggtgatccccctgcctcagcctcccaaagtgttgggattacaggcatgagtcactgcacctagcctacaggcaattttgtacagagaataattcctttccagaagtagcccgatrtagcagaaagcatgagttttgttgtgagacagacttagctctacatcttttatgtgagacttaacctgttttttctatgggcaaatgacctgaactcctgaatcagtttccccatctgtaaagtgaggatgaaaatagtatctactttattgagatttttcttattcatctgtagcatctttgtgtaatgtcatatggatgtaacttggttagtactattagcaactgtgatgatgatgattgtgaatcttattttcatatcttgggttttcttacagtgaaatatttgttgctgttattttctttgtaaaaataaaccatgtttgcatcttggtcttctttccatttggattcaaaagttttatagtgattcctcctagtaaaattgcrttttctccctaggagtacttctttgattccagagtattaacagatggagaactggctcccaatgatagatgttgccgtgtgtgtggaaaaataggccactacatgaaagactgccctaaaaggaaaaggttggcaaatgaatatatatcaacattttgaggaaaataaatgagaggccaatttgtagctataattatgttcagaaatgtttaactgagaaagtttagggtatttaattatacctaaggtaaatgttcatttgagtggaattttgtaatagggtaagatttgcatgtggtataatagtatcttctaacattcatttgttcatttattcattaattcactcagtttttttttgtttttgtttttgtttttatttttgttttttttgagacggcatctcgccctgtcgcccaggctggagtgcaatggtgtgatctcggctcactgcatcctccgcctcccagtttcaagtgattctcctgcctcagcctcccaagtagctgggattacaggcgcacaccacaatgcccagctaattttttgtatctttagtagagatggagtttcaccaacattggccaggctggtctcgaacgcctgacctcgtgatctgcctgccttggcctcccaaagtgctgggattacaggcgtgagacaccatgccagccagttttgtgttttttttaaatgaagaactgtttattgacaccgtctatgtgttgggaattgttctaggagaaataaaagtgaccaagacgttgggttcttgctgaggatctcacagtcatgcaaactgataattaaaatacaattaatggaattcttgagataacatgctgtgagctatatttatagatcttggggaatgtacatcttctatactccctcaaaatatatctacgaattatagtctcccaggttctgtatactgtagtaggtcaggaagatctctttcttttgtcatcaagtctggcctaaaataaaaacttggaacttttgagacagaacgaacttccagtttccatcactgctatttactattaaatttagtcaagacacttatcttctctaagcctcaatttctttttaaaactggagataataaatatcaacctctaaggattgttaaaggtttaagatttggtattttaaaaaatttaatataatattgttttacaaaactactggaaaaccgagttcctgccaaatgagcaggtgtgccataaatgtttgttcccttgccttcaaaaagacgcatgaaatgatgggcatgttagtccttttgttattgtgagagtcctgcrtagtttgttctgtgactcacttaatttacaagtccctagccccacattattggtatcagcagtttactgtttagactaaagaagaaagacagtgaagaagagaaggaagggaatgaagaagagaaagattcccgagatgttcttgacccccgagacctccacgatactcgagactttagagaccygagagacctcagatgttttatatgtggagatgctggacatgtacgaagggagtgcccagaggtcaagctggcccgtcagaggaatagcagtgtggcaggtaaatagaaaaggccaaacatagtttctggtagaaacgaagtcatttatgttgcttgcatgctaaatgaccctaattcctctctgttgcaaacctaattgtatgattttggaccttacaatttcttaaagagataaaatttagacaatgaggcttttacttttaatagtacttggataagtttattatcaaggtttccacagtctgttgtattcaattatctccctgtaagtattctttagatttttatttttatttttatttttttgagatggagtctcgctcttgttacccaggctggagtacagtggcgcgatctcggctcactgcaacctctgcctcccgggttcaagcgattctcctgcctcagcctcctgagtagctgggattacaggcgcatgccaccacgcccagctaatttttagacttttagtagagacatggtttcactgtgttggccaggctggtctcaaattcctgacctcaggtgatccacccaccttggcctcccaaagtgctgggattacaggcgtgagccaccgtgcccagcctattctttggatttgagtcagattcttcatctgtttctctcactaacattctttacaagagacttttttcctagaaacatattggagaattatatttcttcccactgctgttatgagagaaggatacctgttcatgttatatttcacaaggaatttgagagttaaatagtaacccaagtaagagtttattaaaaaaaaataagagaacattttagaagtagtgatttccagttactcagattcttactgcagaaaggtttgtgtgtgtgtgagagagagagagagagagagacatagagagagacagactcttgttgcccaggctgcagtgcgtggtatgatcacagctcagtgcagctttgaccttctggactcaagtgatcctcccacctcagcctcccagaatactaggattacagatatgagccactgcacccaaccagaaagtatttctcaaataaatatgttgtctcctttagaaaagcagaataacatttgttcttgcttctaggatcagtgttattttttttcttgatctgctagtttgacaaatagcttttaaaattaagtagctcagttgctgcaagtccttcgttaatatacttaaggtttaaaagtccaagtttataaaattgcagagatatttgagattcttttacataagaagggagtttatttattgtcatttctctgctactttccttatctgttgattttctttgtgatgccttctcttagcagcccagctggtccgcaaccttgtaaatgctcaacaggtggctggttcagctcagcaacagggtgatcagtccataaggactagacagtcatcagaatgtgtaagtactctgcctgtgaatgtgttagtcttgactgatgatagcagtatctttaatgggtgatagtgttttctctcagactggctaatacaatcttccagattacacagtgctttgtatatatgtccttgctaggcacataaggtggaatgagcattccttttggaataatgtagatctgggtttctgtctacagagaagctacttaatttayatgagcctactcttcaattgtacaataactacctaataagatggattaaaaataaggtaatgactttgaggtttcagactttgcttagtggaaaaatatcagtaccattaataaaaatagaccaaaaaattgagatgttttaggcatttagtgttgttagggcaatatatacatggcattttgcttgcatgaaacttctgtcttctcatagcttgacctgtggatacctagtgaaatacaccctgtaaaaaaacagtattgaatgagaattcagactcataagtttattttactatcttttctttttttttaagatggagtctcactccattgcctaggctggagtgcagtggcgtgttctcggctcactgcaaccctacaatccacacccctgggatcatgcaattctgtctccatctcctgagtagctgaactgcaggcaatactatcacgcccagctaatttttgtatttttagtatagactgggtttcaccatattggtcgggctagtcttgaactcctgacctcaggtgatccacctgccttggctccccacagtgctgggattacaggtgtgagccattgcgcccagcccagactcataagtttaatattgtttgttgagttgctcttaacctttgtgtaaatctatattcaccttgtacttcttaattaataatgactctaaataacactctaaatctgacataatattcagtgctttacacttagcaaatttaatccttggagtggccatgtgaagtggtaggtattagtatcatcaaattttacaaattgggaaactgagaataagagagtataaaaatcaaaccgaagtctttctagcatcaaatccattaaccgtttaacatgctaaatctaatgtgatttgtgttttagaaaaaacattcaagtatttgaagagtattagggagaatctttggaaaacatttaggaaattttccaccctcacctcaaacacttgaatacctattatgtgcttgatactttcataaacaacaataatcacatttaatgtagttaacatttgttgagtgtaaactatgtgctgtacatgcattcattctttgtgattataaaatatttcaaaagtacagaaaagtatagaaaataaatctctatgtatcattaccaggctttaacagtttttaacattgttattttagctttattaaaaaatcaccctcagttgaacaccctgtacattcttctttgatcccattcctatcttaaaagcttcctaccatccttcccttgctacagaaatgtatctgctatcttgaacttggtggttatatgttccacatgcattgttcagttaatcttctcaaaaacctgaggcaaattctgattatattttataggtaaagaaaccgaggtttcagtttcttgcctgaggtcaatagacacttggaatcagaacgcgaaccctcaggctctctgtcagcaaaacttatgctctaaccacttttctatgctgccctaattttcattttatgctactagtcctcacttttctctcacccgtgctttcggaaagagtctgtctaatggacattgctattctgatgtctaacaaagcacgtcaacatgcctaaaatatagttaatctttcctttcaacccccaggacttgcctcttcctcctgtgttttatatctcgttgaatgatcccattttctatctagtttccaaaacttttccctctccttcaacctctatgttcagtcactaagtcctgttgtttctgccttaaaaaaagctaggtgtttgcctcactcctgtaatcccagcactttaggaggctgaggtgggtggatcacctgaggtcgggagtttgagaccagcctgaccaacatggtaaaaccccatctctgctaaaactacaaaaaattagctggatgtggtggcagggaacctgtcatcccagctagttgggagactgaggcaggagaatcactcgaacccaggaggcggagattgcaatgtgccgagattgcaccaccgcactccagcgtgggcaacacagcgagactgtctcaaaaaaaaaaaagtatctcacagccatttgcttccctctatccctgtttgtgtttccttagcctaggctactatcatctcctaatcagtctcaacagccttttagcagtctcctaatcagtctcaacagccttttaatttttacttatctatttattcattcatttttgagacagcgtcttgctctgttgcccaggctggagtgcagtggcacaatcatggctcactgcagtcttgacctcccaggctcgggtgattctcccatgtcagcctccagagtagctgggactccaggcatgcaccaccacacttggctaatttttgtatttcttgtaaagatgggatttcgacatgttgcccaggcaggtctcaaactcctgagctcaagtgatctgcctgcctcagcctttgaaagtgctaggattacagtcttgagccactgttcctgtctctcatcagcctttaaaaaaattctctattttattcttattaaaccaggataatctttctaaagttcagattgatcatgttcyatacctgtttaaaacccttcagtggtttaccactgcatttaggatatagtctraattacaaggcttataagacacttcattgtcttgcccctatttagctcttcagcctcggccattcccctgccattatatatactccagtaatattaaacttctttcagattccaattactttaaaaagccatgtgttttcatacctctagaccttcaatcatattgaacactcttcctctccccttatctctcccttcttgtatcagactgatttctgtttaccctgagtctcagctaaaagatcactttttctaggaagctttccctgatttctcttctctccttctcccaaagtgactttaggtgttcctgctctgggatttcattatgtagttgacccttgaacaaaacaggtttgaactgcgtgagtctacttatacatgaattttttccaacagattgtggttggaaagtacagtattcccaggatgcaaaacccaagtattcagagatccaactttttgtatatatgggttctgtagagctgactgtgggacttgagtacaggattgtgggggtcctggaaccaatcccctgcatatcctgagggacagctgtacactgtacattctttatcatagtactcattatacttattatgattgcttatgtaatctttgtctgctcccttccttatcccccttaaacgttgagctccatgagggcatacatgttggtattacatttttattacctagaacaatacttagtacataattgacacaataaatacttgttgagggactgaatgaaagtgactatgagatatttagatggaagttttgagtttgcaataggaagtatgtgttctgcacgatgggaaccatgtctgggctctcgtttctttggacaataaaacgatttgtgaggcaatacctacttgaaaagggggtttgagtaccttgggaaaaactaattatttgttatgatatacatcatagagttctgttttataaagtttttaattttgtattttatctctacttttataaaattaagatgtttataaattaattwaaaaaaattttttttttgtctgcagtctgaatcaccatcttattctcctcagcctcagccatttccacagaactcttcccagtcagctgctattactcagccttcatctcagccaggatcccarcctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcytggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcaggtaacctttccttttcttcttttttatctgcatgtcttttcttcttttgtatctgtctgtagaaacaatgtgaggaaaaagaaggaaagcagtatttgtggaggggacagtacaggattagataaagattaagaatatgggctctggactcagactgcctggatttgaatcctggccctgccatttattatgtagcttgggcagttaatctctttgtgcattggtttcatctgtaaaataggccatctaactcacagggatgttgtaaatgttaaatgaggtgtaacacacataaatgttagctattattttagtattttaaaaaattttcactgccactcagtttggtgtattatttattacacagttgatgaaattgaagagttaagtaacttcactgtcttactgtcatggttaataatggtaggttggccgggcatggtggctcatgcctgtaatcccagcactttgggaggcggaggcaggtggatcacctgaagtcaggagttcgagaccagcctggccaacatggtgaaaccccatctctactaaaaatacaaaaattagctgggtgtggtggtgcacgcctgtaatcccaactatgtgggaggctgaggcaggaggctcgcttgaacccaggaggtggaggttgcagtgagccgagattgcgccattgcactccagccagggcgacagagcagaactgtctcaaacaaaaaaaagatcaaggaaaccaaaaaaattaatgatggtaggtccaagagttaaacgaatttctttgttcaaaaccgtgctgctgcatgccctagacactattttttctcaggaacaattctttaaaaaagaaaaatagttttttttctgatatctaagtaataaatgttcattatagagtatttgagaaataaatcatctatcatctcaattcctagacataaatactaaggaatattttggtgtattactattcagtcattaaaaaaaaactgcatatttaagaaaatagttgatacatgctataaatctagttttacatccagctttaaaatacatagacacacacacacacacatatatacacacatacatataaatatttatacacacttaaacatacacaggccggcactgtggcttacacctgtaatcccagaactttggaaggctgaggtgggcagatcagttgaggccaggagtttaagaccaggctggccagcatggcaaaactcttgtctctattaaaaatacaaaaattagccgggtgtggtgatgcatgcctgtaatcccagctactcaggaggctgaggcaggagaatcgcttgaacccagggaaagagaggttgcagtgagttgagatcatgccattgcattccagcctgggcaacagagtgagactctctcaaaaaaaaataaataaataaataaaattaaaaaaaagtatatatatatatatatttagacaaagtctcaaagtgttgtccaggttggagtgcagtggctattcacaggccaatctagcatactacaaccttgaactcctgggctcaagtgctcctcctgccttagcctcctgagtagctgtgggactacaggcacacaccactgtgcctgacttatgcccaactttttagtgataattatttttatcttaagaactattagcactttgggaggctgaggcgggtggatcacaaggtcaggagatcaagcacatcctggctaacacggtgaaaccccgtctctacttaaaaaatacaaaaaatcagctgagcgtggtggtgggcgcctgtagtcccagctactcgggaggctgaggcaggaggatggtgtgaacccgggaggcagaacttgcagtgagccgagatcgtgccactgcactccagcctgggcgacagagcgagactccatctcaaaaaaaaaaaaaaaaaaacctattatggaaattttgaaacatacacaaaagacagtaaagtatataatgaacccccctccccattaaccaactttaacagttatcaataatttgctattcttttatcggattcctagccattaaaaatatttttgacttgactgatcaaatctcagacattgcatcaaatttgctttttaacttcagttgtgtcacttaaaaaaaacatgagatcattgccatacctagtatcatctaatacccagtccttgttcagtttttcctgtttatctaaaaaagtatatagttttttgagacagtctcgctctgttgccaggctggagtgcagtggaayaatctcggctcactgcaacctccgccttctgagttcaagtgattctcctgcctcccgaatagctgagactacaggtgcgcaccaccatgcccggaatttttttttttttttttttttttttagagggagtcttgctttgtcacccaggctggagtgcagtggcacgatctcagctcactgcaacctccgcttcctgggttcaagcgattctcctgcctcagcctcccaagtagctgggattagaggcgcctgccaccacgcctagctaaattttgtattttagtagagacggggtttcactatgtaggtcaagctggtcttgaacttctgacctcaaattatccgcctgcctcggcctcccaaagtacagggattacaggtgtgagccaccgcgcctggccctaatttttgtatttttagtagagatggggtttcattcaccatgttggccaggatggtctcgatctcttgacctcatgatccgcctgccttggcctcccaaagtgctggatttacaggcrtgagccactgtgcccagcctaaaaaagtattcctattatcgatttatttgaatcaaaattaaaactgtgtgtttggtttttatatctctttgatttttatctctcttaactgtcctttataacagttgctgcttctgttttttttccgatattaactataaggcactgtagaatttcccatattctggagttggctgattatgtctttgtggcatcatttaatgtgtacctctgtccctgtatttcctgtaaactgggatttagattcagagactggattagattcaggctctttctgttggtaagaatgctgcttggtgggtccgtgtatttccagtttcctcacttcagaaggaacttactgtctggttgtaactattttagtgacttaagattgatctgtgagttaggttttatcagcctgttttacccattatcaaattcatcatttttacttaatagccttagctgccattgataattgttgccagtatccattattttgctgtctccagcttcttttggaacaatgcaagtaaggtattttgctgagcaaaaatgccagaatatggtaacttaattagatttctaagatcagaggatatatggcatacatggtccttctcatatatcattcaacatgtttattgtgtatatgccatgacatgcactgtgatagtcactgagttatagaaccatgaagacagacccagtgttttgccctttgatgtatcagctccatttttataatttgaagtcttccatccccctgcaacttgttgttctcagtgttttagtcatagtgaactaattaatgtcccacaaacatactgtactatctcttacccctggttgcttatctaagttgttccttctgcttggaatgtcctctccgttacctctgctgctcactctcaccttcttctgtgctgcctcaaagcttggctaactcactcatcctccatttttaaatttagatcactttcttcaggaaatcctcattttcttagtattcatatcataacatttgtcttactgtgctgaaattgtctgtttactcatctgcataacccattagactgaacttctagaagcaaaaaattgttttttgtctgtcattttctgtctagtagtgagtttagttttctctttagtagcctgccatgttcctgttatatagtattattatctaataagctatacttaatattattcattgtatagatactcaattcataattgttattaaagctacagttacactgtgttgaaaatggaaggactgaatggaaatatattaaaataataatcatagttgtatcggaggagattattatgagtttttttcccccatttttcaaattatctttaatgagattgtattactcattttctggaaattttgggttatgaaaaacaggcaaaggggattggaatatatcttttaaaaatacccttttatgttaaaacatcatttctcatttggttatgacctaattctggatataccagtttcacttatttttgtaaaccctgagcccttcagattcagcccttagttgtaacttggcttttatgaattcacagtgaactagctggtttgcttactttctgagaagattcagcttctaagaatgcagttcacacgggctttagttttttttgctgcctactctttcctatcccgtacttaatttgagttcctgctgagaagtttagtgaataagggcagttattcccttttattccctagcacactgtgactctgaatgagaaaagccaccagaatgatccagaatataaactgggtactgcacttcgaaaaatgtacttaaagatacattttaaagggaaatagatttggggggatagttagccataaaaagaataggacttacattttttgagtacctacctatatgctagctcttgtgcaagctactttcttttggttatccaatttaaacctcataatctgaggttcaaaatggaaccttagtagttttaggaaatgagatttgagcttagacttgtttggcctcaaagcccaagttctcaaccattatgccacaatgcctcaagcttgtaataggatctccttccaggccaagatataattgattctgggatagttggcattgtctttaggataaaatcttaagttcctttgcatgatgtactaaggttttttgaaatgtatatccccacctacctgtcccgccttttctcttaccacttcctccatcactcctgtctctatgttgcagattgttgtgcagttccccaaacttgatgtgctttcctgctttcaggcttttgtacatgatactccttctctctgaaatgccccccaccccctccctattttgcctaaatttttccttgttttctagaactcatattagtcaatcatcttacgaagactgtctctaaccttcaaagactgggttagccctctcttcagaacattttgcctgttctactagcaattattacatattgttgtgtatatatatatctcttcttgtatgtctcttatgaataatttgagcaaataccaatgctttattctttaaaaaagtttgtttggtattctctgaatttagcatagttcttagccaatggtaggtactgaatatatctttgtggaatgaagggatatttcaatgaatgaactaatgtttttaaatgtctttttccctcttgttgaaatgcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaaggtaccactgcttacaaattagttaacaggcttgggtgggttttattctgggatagagagccttagtgaaggccaggatctgggagtgaaaattcatgaattcagtaaacatttactgagaaattatactgtgtgtcagatggtgctaggtgcttgtaaaacaaaatctccattacttgatgcacactttattaggaaagccagacatgttaaatagaaaaggagtttagatgaatcagttaacattgccctagcaaatccaaacaggatgtggatttaagattattacatcacaagattttgacagttgagctagatcttgaaagagatgcaggaattttttttttgcctagagatgagagaggaggaggagtatgcttagctgagggattaatatatgcagtcactgagttttgcctggcataatgaaaaagagtagaaaatattagggctagaggacggaggtatatgggaaagatggtgataaggctagagagggtaggcttagmccatattatggagtttggacttggtttactgagcattggggacctaattaaaggtttttagtggaacgaagacataatcatatttgtttagtaaacgtaggacttgaatgaccttaaaatttattatgttctgctggtgctattgtagtactaataatggctttgactgggtaatgaatattacaaacaaagaattcctagaaacttggagcattttatctaacctacttgcctcagaggtatttgttcttataggcattgtctgagtctggccttcagctctttgttaacttagttcagaacacttgggtcagagtcagtatagttaaactaggagttcaagaagttaaaacaggcactcaggaaatgctgattgaatgaaatgataacttaaaggggaagtgcctggtatggtctcaggcttgttatatttaagccttcttaaaccacccatatactactggggcatccctgtattgtagagtggcagagccttgactgtggttgagctcttctcttgagcaaagaactggggctgaaggaagttactattagtcataagcccttttaggaggggagagtctgcaactcttttctagtgggttttttccctttgattcckcctctccatctttcgtgtcctctccttttttcacatacaggtatttccttcccttcttcatttttctccccaccctctcaaatgttttgcagcatgctttatcacctcctattatataaatagaaaaaaagaaagctaactacaagttaattctaaggtgttgtcagataaacaggcacaagcctttcagtttcctgtctgtgttgtatccaacagacagatgtgccacccrtcggtgtagagagcgttgtccccacccaccaagaggaaacgtgtcggagtaatgmgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagagttaaatttggttaawctgttgtatagatgatggaaatattacgtaacaagatttcttttaatttcagtgaatagagcattctaaatcacagattttagttttagagattcaagtaacatttcatatcctttatttggttggatgttcacaacacccatatgaggttgatagaagcggaagccatttccattttatctttgaaaataaaaactgaaatgcaaagcagtcagtaaattccaaaaagcaaacaatgctggagtctgaattgaaaagtatttggaaagagaattttaaaacactgagactaatattggcaattagagtggagggaagattacttttttttttttttttttttgagatagagtctgtctgtcacccaggctgcagtgctgtagtatgatctcggctcactgcaacctctgtcttctgggtttgagcgattctcctgcctcagcctcccgagtagctgggattacaggcatgcaccaccacacttggccaatttttgtatttttagtagtggcggggtttcatcaygttggtcaggctggtctcgaattcctgacctcaggtgatccacctgccttggcctcccaaagtgctgggattacaggcgttgagccactgcacccagcccagactgtattcattttgagtcctatacttccacctggaaagcacacttgccaagatgataattatttaccagtaatacttggaattaattattattgggtattggaattcagactcgagttgttggtggcataatgttttagctgttttagcagtgaggtgaggtaattttctctaaccccttaattagtccgtccagttgcctgggattttaggctaaatgatgctatatatctatttggaaaggtgcagaataagtagataaaaatgtaaggacagtgggttatctttgctgcgcttcctctgatatacattacttaaataggagactgcttgggcccttgccatattttgcaacatggaagatatttgaaacctattgcaggaggttgagggtattcatgctgtatttacagccctgagttaaatatatttactattttttttacctaacctgagttaggtatatttactattttttcttattaaagcgtcagcatctttcagaatcctattaagtggtggacttaaatcatttattaacaagatacctgacccaactatgcattcatgttaaaatgacttggagcattcaagatttaaattaacattcaatacttcatgtccttccacatcttggagaacaggtaatgacgtatacaggggtgtttattattctctttacttttgtacatacagtaggccctccatatccatgggttttgcatctatggattcaaccaaccacggattgcagatattaaaaaaaactgtgtctgtactgaacttgtacagtttgttattattccctaaacaatacagtataacaacttttcccacagaatttccattgtatgaggcattatatgtaatctagaaatgatttaaagtataaaggaggatgtgcataggttatatgcaaagactacactattttatatcagggacctgagcatccttggattttggtatatctgcgggaggtcctggaaccaaccccccaccagataccaaggggaggattgtatttgaaatattcattaaaaataaaacaacttccaataacagaatgccccaacccctcagcctttcttccttaaggaaggcagtataaaataccacttggcaaaacctattaactggcaacctagtaaccaacagcctaggttttacttatatgatagtgttatagatactagttttcagcatctcatttgcccctccttcagtaactgccagtgttcaataattggcaaaactgttctgttgaaaaacatatagtttaaaattgatatagtagaaactcagattttaagtctgcaaagtagattatgagttcagattcattgtagagcagttaagtagaaaattatcaatcttatacagggagaacacacacatttaagaccaaattgttttgaaatgttctgtttaatgacatggagattagtattttcccttgacattagggttattaaaaatataaatatgtactgtatatttgtttatatcccctacagatggacatttttgctgtttccagttattcttatatatacatattatatatgtaatgtgtaaaatgatgatgggataaagctatttgtgtgtacatgtaattattctattagggtaaattcccctaaatgggattactgggtaaaaggatcaaaagtcctaaggttcctgctacatattgccaaattgcccttcataaaagtggttatcaatctgtagttccagcaaacaatacgtaaaatgtgttggtatgcttataaaaaagcttttaactcccaacaactcatttcttccttgtagaaattaacatgtttattgtaaaaagaaaataagcattatataaaagtacaaagtttaaaaatcattcaaaagttcatcagccagaaagaagtactatctggtgaacttcattcattccaaccatctctcttaatcatacaggcacatatatacaaatagttttacaaaagtgggctcatatgctatatttaacaaatatagcaaattaacaaaaggaaaacaagtgtgaaactgaaaaaatgctcaatttaaatacttttttccccacaagagaatctagtcttgtaagatttctcctaaaattaaggacaattacggaaaacaataaagaggctatttttttttctagcttcatgtatgttttaattagagactgtacgtgattcctgctatgaaagatgaaaccagcacactctacttgttatttctatatagacagtgttcataatatttgactttataatcattgcccattatttttaaagtttctgaagtgtttactaacactccttttactgattctttgttcctaagtccttaatttgattcatttcttctttagttgaatttcattattgggcggttttttcccaaagactcatgatttgtacttttaagttcttacaaacttgagaacatctatagcctttgtattttaagacaactttggcaaagtataaaattcctggcactttttctcaaacctttggagccttttgcttcattgccttcttgttataagatctgagaccatcctgaccccatttaattcttttttctttttgagacggagtctcactctgttgcccaggctggagtgcaatggcgcgatctcggctcactgaaagctccgcctcccggattcacgccattctcctgcctcagcctccctagtagctctacccgccagcacacccagctaattttttgtatttttagtagagacgggtttcactgtgttagcctggatggtctcgatctcctgacctcatgatccgtctgcctcggcctcccaaagtgctgggattacaggcgtgagccaccgcacccggccaattctttttaaaccatcagaatatttctttattctacatatttctcttttccattttttatttcctccagcctattttctctgtgctgttttatgttttgtggtttctagtataaggcctttaaactccaccaatcttatttttcatctcttaatctcttttgaactttttttttttaaagagatcatgtctgctgtcttttttgagcaggtggagaatttctgtcacattaacctttttgagggagtgggcaatctgtgatcgttcttttctaaataatgcttatttaaacttcggtctactgaagaataacaaacaggaagaggttagaggaatgagcttgaagttgggttgttaatattggaaccctctcaccaaacccattcttcttcttcttttttttttttttttgagatggagtttcgctctttttgcccaggctgaagtgcagtggcacgatctcagctcaccgcatcctctgcctcccaggttcaagcgattctcctgcctcagcctcccaagtaactgggattacaggcatgcgccaccatgcccggctaattttgtattttttagtagagacagggtttctccatgttggccaggctggtctcaaactcccgacctcaggtgatctgcccgcctcggcctcccaaagtgctgggattacaggcgtgagccaccgcacctggccaaaaatgcattatttcttttgccccttggaacacatctcccttactttcttagtattaaaaggcgattgtgccctatggcaaagcttttaagtcagtgtatttcaaattattggaagtgaaatcgattaagtggtttcatccaatattaaaaactgttaacaagtaggaaacaccagaattcactttgcatagtaagtattctttcctgaaatttgtctcagtacagaatacagatgtgtacagaggtaagatgtaaaatacgtttttaaaatgtatgctgtagtcaaaaagtttaaaatgcttcatccataggcaagcacatagatgacagaaagagccttacagcaaggtttgtcctcaagctccatctcctgtgtaattttatcaaaacgatatctacagacatgcaacatgtcttactcttacctccttcttctaattaaagaatagggacattctctttcctgctattgattggctgtggtacctcaattttggtccacatattaccatatgtctaaacaagtatgttttaatgtttgtttagggaggtttatttctgttactaaaatttattgggctttgtgcgtgggtttatttttactttaaaacatattttaagacaaagttttattttaagagtgtactggatgacagcttggttggtccatgggtcatttctgtccatgccagaagacatttctttctacctagatcactttcataaagaaataactgctatgacactgtaatacatttacgtacagatgcttatatttaatcttaaaaggtagtcctatatagttctatcagaaaccgtaagagctctttcagaccacttttattaactcaggtattacgaaaggaaccattgaagaatatgaaagctcaaataagattaaaaaatgctttaatactgctgaagtctttcaattctagagcaggcatagaatatatagaatgtttaccttatgaccagatacaacctcccaagaaaaactggatcctgcagggcagctggtcttcacagttcctgctgggactacagttgcagaagtcattccatcacttttctctttttaagggagttaagtacaggtaaaggaactcttctagcaaagatcttaataatctcttgattatcgatgtccgtggaggctttttagtccttcctttgcttctgcattcttgacccttggcttctttcactcactctctcctaattctcctgtctttctgaatgggccattccagttttcaataggtgacttctatttcttcctgtgttggtgttgcctatggttctgttgtgtgcatttctgatatatattaacactctgggaagtcttattgacagattccaccattacttaaacattgtcaattctggcctagatcgctatgttaaactctggtccctatctccaactttatgggcttttgtttttagctataccatagctgtctcaaattaaacttgttaaactgaatgcatcattttcattactaccaccatcctctaattctctgcccctctaaaagctgtctcttcctgctgtattttctgactttgtgaatggcacgactgtctagcaatttaggtcaaaaccatgactaatattagatactttcctctccatcaaatctttttcaatcccgttaccctactgctactgactaggcctggataatgtcaatgcttatatgataaaggctggataccttaacctggatttcaagcttgtgggcaagaacaaatgaaactatgaaaaaatgggctgtataaagggtattaagtgctgctctctgttgaactgtttgatgaaactggctttaatgatccagaagcagccttacatttgaatgcattctattctttcaaaactgctacaaaccagttttcatgtttattaccacttgctgctgctggaaaaaagttaggagcaactatgttttactcctttgatctttgaataacagcagcagcacaaatcccaggattctcaaagcagttccaaccacaacaaaccaaaaactaaactacagcgaaatgggaaacaggtgtgtccggtttaataaaaagggaaagggtcatcaggtggccacagcctttccttgtcagtcatatccccaacctccagatcctttatactctcataagtttgaatacagtcaaggttagttgggtcaaaaactgatgttgattatgattaaaaagatacaaaactcagcacctccttcattaaaaataaaggttgagaaacttgataagaaaaaaactaaaatattcttatagctgcctgggggagatcttaatccttccacatacagatatcctyatatccacaggaggccatgtggactaaaaccaaactgagtccattactcattccctctccggctcttcttgtggctcttcttagacctgaaatggcaacacatataaataattatattaagaagcagccaggcacggtggctcacgcctgtaatcccagcactttgggatgccaaggtaggcagatcacctgaggtcaggarttcgagaccagcctggccaacatggtgaaaccctgtctctactaaaagtacaaaaattagccgagcatggcggcgggcacctgtaatcccagctactcaggaggctgggacaggagaattgcttgaacccgggaggtggaggttgctgtgagccgagattgggccattgcactccagcctcaatgacagagtgagactccatctcaaaaaaaaaaaaggagtcctgagaaagaccttggtatgctgacattgatggggatggagctgacactcaatattcattaaactgcttggtatttttttgactcagagcaacactcttgagtcaggcattactatccaaattttaccattgaggaaatgacctcttagaggttaagagtacaccaaacaggcccggcgcggtggctcatgcctgtaatcccagcactttgggagaccgaggtgggcggatcacaaggtcagattgagaccatcctggctaaaatggtgaaaccccgtctctactaaaaatataaaaaattagccaagggtggtggcgggcacctgtattcccagctactcgagaagctgaggcaggagaatggcgtgagcccaggaggtggagcttgcagtgagccgagattgcgccactgcactccagcctgggagacagagcgagactccgtctcaaaaaaaaaaaaaaaaaaaaaaaaaaaagagtgcacccaacggtatatggcacatgggggtttctaatgaaatcttatcaaatgaaagtgacttgtccaaggtcactcaactgttaagttttaaaacttgggactaaaccccatgttttctgagaccaaagctcatccattgtccaaagctgcaatcctgtaaagcaaaacaggtatcagcttgaacccgggaggcagaggctgcagtgagccaggttcacgccactgcactccagcttgggagacaagcacgaaactcagttctcaaaaaagagaaaaaagaaaaagttatctaaccccagtaattctcaaagcaatagaccaattttgtcttgtaatgcaggagaattcctaacatcccccaacaaaacaagaaaatttcaggtccagttagttgtaatttggactatttctgtaaagttaaaatagaggtcaattcattacctttcgggagactttgagtggctcctgtgtctgtgactacggtgatgacctggggaagaaaaggccattgcataagatcctacccttctactcttattaaactgtcattctcacctcccctaatacctgccattggcttaatattcttttggcctatgcaggggacacctcttagtggaagcaactctgaattagtggaggaagagggagcaaagaaagtagtaatgaaaccagttcaaatacatatacattcaagggctttatgactaatttcacaaacatcatattgggttttcactattatgttagatcttattcctccaattttagatgaaaaaactaaagcaaaccttatcagcaaagcttataagtgacagtcaagctgtgaaccttaattttcaaattctatgtccatttgcttttctgttaggcagtacagtcaggcactcctgtactgcaggaggctaactactccttttacatttctttgttaagacaacctgtggcaaaaggcccacaagctttacctggggacttggaacgggatctgtgccgccgatctcgggacctgctgcggtgacgtcttggactcttgctccgatgcctttctcggcgaggggaggggctgtagaaaagactggtcagactaccagatctggttagcaatatacatataacaccaataccaccaccccctccccaaagccctatccttcatcacaaatgactgaaggcctaccttctccttttgggagatcgactccgcctataaagaggagaggaagaagaaagcctaggttggcrcactggatgtggtagattgcaaaaacrgccccaatcttatycttcacgcttctctgtatcacccacctctgtatccatgtcttttgtcacgtaactctagcaccctcccattctaactttaggactggtgacatgactygctttggctaatgagatatttgcaaatgtgataaaagcagatactggaaaaacatttgcatgaccgggtttgtttgctcttgagttctgccactaccatgagaatatgcccaacttagcctgctagaggatgacacagagaagagaaatttcccccgtcatccaagctaaggcaattccataccagccagtagacagccgacaacagaacaggtactttaaaaactgcctatccaagctctgcttaaatcattgactgcagacttgtgaaaggaacaaatggttattgttgtctgccaatgaggttttataggtggttgttttgcagcaacagataactaatatattgggcaaacattctccatagacgtgcatttttccttctctaaaatccaaacttctaggctacagtgctcaaaatcttctgggaaaaggccaatgactaggctttaccttctgggagaccggctcctactcctcctgtagcgcagtgtgggagagcgacggggcttgtccaagtctcggtagcttctccggcggtgatcaggtgatggcactctttccaactggaaacaagatgattgggtcattgaaaggcacaggcttataaagagccatctaggaacactaattatacttcacgccccatcttgtcccaaagtccatctccatgtgactttaaagcacagtaacctgactacaaagagggaagcacttaccctattaactaacaaaacttattatgagctatataagacagccaaaatgactcataggagagggaacagaaacagacctgtgtgtgtgtatgtgtgtatgtttagtttatctgcagcctgggcaacatggtgaaatcccatctctacaaaaaaaatacacaaattagccaggtatgctggcacgtgcctgtagttccagctacttgggaggctgagatgggaagactgcttgagcctgggaggccgagaatgcagtgagccactgcacctcagcctgggcaacagagcaagaccctatctcaaaaaaaaaaaaagtttgcttcctggaacaactgggcagcttggttgttttcaacttttcagcaccgtaactagtactgaaagaacatgactatgcggttgacattttccccctcctaaacaaggtttattccttaggataggtgcaattatgaaagtgttctttctttccaagtatttaatagctgccaccatttattaggcaattataatgtgccaatactctgctaagggctttaagtttataatcttatttaatacttttaacagtcttggggaaaaaagtatcattaacctcactttacataggagaaaactaaatttaagtaatttgcgtaagattatactactagtatatggcagagctgaggtgcttttaataaggaaatattgtttttggctagagttagaaaaaaaattttttttgagacggagtctcacttttgcccargctggagtgcagtgttgcgatcttggctcactgcaacctctgcctcccgggttcaagcaattctgctgcctcagcctcctgggtagctaggattacaggcacccaccacaacgctggctaatttttgtatttttagtagagacgaggtttcaccaccacgttggccaggctggtcttgaactcctgaccgctggtcatccactcgccttggcctcccaaagtgctatgattacaggcttgagcgaccacgcccggccaatagagttaaaaattaaagtctaaaaacaaaaaaccattcccattttctattactccctcccctacaaccataaaagtctcaggtgccagaccttctcatcctcctcttcttcctcttcactggactccacatcatccatgtcctcttccagagcactaactcgaggctccagttgctcagcttcctctaatacatagcgtttctacagagaaaatgatgagagttaggggttgttgccatttcccctatttcttgaaacctcaacactgggcttcagggttccaaggagcaacagctgaggcaatttcatttcaaagacagttcaagattttcctaacaagtttaatagacctgaaatctataaagttctcctataaacataaatacaaacctgaagagaacatcttcattttctattgactctattccctgtaccttatactctaaagtcatgggaatatcaatcagtataggtacagcctagaaccaaaagtaagggcttcacacacagagaaaatccaagggctaataagttcatggctggtagttccactagaagaggcctagccctagagtagtaccaaatctccagtagacccaggatctcgggagctgttgatattcatgcattttgaactggttccattttaatctgggatatggcttagcaatgtttatttgagtggctaaggatcagagaggcaaagctgatttcaaaaatgccaaatggctaaatgtagtggcatgtacccgtggtcccagctccttgggagactgaggtaggaagatcccttgagcccaggagtttaagaacagcctgggcaacacagcaagacattgtcttgctataagaattgggccctcaaagtaggttttcaaatttataatctcattctttccactacatgccctacagtgccaacatggaacaggagagctgtatcacactcatttcctgaaaagatgcctcatggataatcgtttatcactaggaaagggaagcaggatggtgaaggcaagtttaaggaattaatggctcagtctcccactcctggccctatttttatctgttttatgtcctggctttttacatgaagattagtttaaaaaaaacgttcatgaagttaaaaactccctacctactctagctacaatacccttgatgtaacatcctgaataaatttcttttttcatgatagacaggtaatgtgctgactttgtaacaaggtttgagggaggcacaactcacacatgcacctgaactacaaaaggatggagaaaaacaaagtttccttgttttaaaccattcacttttaaagccctacccttcaaatattttatctattttcctctcactcccaatccactatcttgggactcccagacaggaagactattcattaagaggacccataagatccacaggcttcagtgtttaagctgtgtgtatgtgtttgtctgtctgcccgtctaggaagagaagggtgactctggtaacagacttttatttcttacctgtagtcggggcagaatgatatcacagactctctcactgtgcaatarttcatcaataaactcatcaacatgcatcaattcaaactctgcaagaaaaagtcattagagcaaacaacctggaaataaaagatttagatgccaaaaagtaaaagaagtgttaagacttcatatcaggacatctatgtgctaggcctctttagaagagattaagggatgaatgaagatgtcccaattagcaggagacaaacacaaaaacaagcacaaacagtcctgaattatgtagggatgatcttgaagagatcatataactcaaatataatttctcatctgaaccttcaatgtttctgaatttagaacatgtatcttatatggcacatggagtgatagcttttgagaactggctaggagtggtggctcacgcctgtaatcccagcactttgggaggccaaggcaggcagatcacttgaggttaggagttcaagacaggcctggccaacatggcgaaaccccatctctactaaaaacacaaaaattagctgggcatggtggtgggcacatgtaatcccagctactcaagaggctgaggcaggagaattatttgaacctgggaggcagaggttgcagtgacctgagaccacaccactgcactccagcctgggcaacagagtgagactccatctcaaaaaaaaaaaaattatatgtctatatatatgtgtgtgtgtgtgtatatatatatatacatctatatatatataaaagtatcattaacctcactttacataggagaaaactaaatttaagtaatttgcgtaagattatactactagtatatggcagagctgaggtgtttttaataaggaaatattgtttttggctagagttagaaaaaaaatttttttttgagacggagtctcacttttgcccaggctggagtgcagtggtgcaatcttggctcactgcaacctccgcctcccgggttcaagcaattctgctgcctcagcctcctgggtagctgggattacaggcaatttatattatatataaattatgttatatataaattatgttatatataaattatatatgattatgtatatttatatatttgtatgtaaatataattataaaatgtatatatatgtgtgtgtatatacacatatacaaatacatatatatacatacatacatatacatatatagcttttgagaacttccatggtaaacattaccttacttctggggttctcaaccatgggcaattttgcacatgcccatccccctacttagaaggaggtgttacttccatctagtgggtagaggctagagatactgctactcattctatgatgcacaagccaatcctcacacaaaagttatatgacccaaaatgtcaataggttcagaaattcttagttttacgtaataaaataataaataaataactccatcatggccatgaccatgtccatcttgttcaccatggtatttacaccacatagcacagtatgtgacatgtcaatggcacttaatatgtatttattcaatgaatgaatcaataagtttaaagtataataccaaattctatttttttaagatggagtcttgctctgtcgcccaggctggaatacagcggcgtgatctcggctcactacaatctccgcctcctggttcaagggattctcctgcctcagcctcctgagtagctgggattacaggtgtgcacctccacaccctgctaattactgtagttttagtagatatagggtttcaccatactgacgaggctggtctcaaactcctgacctcaagtgatctgcccatgttggcctcctaaagtgctgggattagaggtgtgagacaccgtgcttggccccaaattcttaaccttctactgtttaatgatacatgtagggggaaaggtaaatgttcctatcttctgttatgacaccaagtgagaaaaggttttgactgcattacctggaatccctccttagcacattaagtaatctccttgtagaaggtatggagctgcctctcttggatatacttatttttcagtgggattcctgtataaaaatgagtagtcttatatgctgcagtgtgaattacagtgttagaggagaggccagtagaaagaactgtgaagatgtaaaatatggaaaactaattttgtctgagagggctggggaaggtttttatggagaagccattctgcagctagatcttttgggatggagcacatgtaaagggggcatatgatgcaaggcagggattaacataagatgcacttggaaagggagacagacagaggcaggctgggtaaggccaacacgaagctagtagtcagactgaaaactcccrtgagggacaagggaaaacctgcatagagacagtaacaatgtagatgaaaaggagcattcacactgtctatgacaatgcaaaggtagaagtactggtaaaataaaaactggcttaaaaatgacaatcaggagacttagcaccatacttacccccatttcggttctggctcttgatttttcgatagtcattgtacaaaggttccaagtacttgtagcaatcaattgcagtgcctgtcagcctcatgtaaagtgcccccagcatgcggacatacctgagagacagatgacagtgaaacaacaggccatcctagaagttcctgagttttacaactagctgttctcatgacagtagtggataaacatgttcttctctttggcaggtaagaaagctgcaattgtggaggtagaatgcagcagaagaaagacagctaaaatatggagacctgagttcaagttcccatgctaccatttatggctgtgggaacatcatacatattgatcaactttcaaatatatcatcagtaaaactagaataaaacctatttacctcacaggattactctaagaatcaaaagaaatactgaattttattttattttttaaggcagagtcttgctctgttgcccaggctgcagtgcagtggcacgatcttggctcactgcaacctccgcctcctgggatcaagcaattctcatgcctcagcctccatgtagcgaggattacaggcgcccgccaccatgcccagctaatttttgtatttttatttatgtatttatttatttcttgagacagaatcttgctctgttgcccaggctggagtgcagtggcacgatctcaattcactgcagcctccacctcctgggttcaagcgattctcctgcctcagcctcccaagtagctgggattataggcatgtgccaacacacccagcctaatttttgtatttttagtagggaccggttttgccatgttggccaggctagtctcaaactcctgacctcaggtgatctgcctgccttggcctcccaaagtgctgggattacaggtgttagcaaccatgcctggcatatttttgtatttttagtagagacggggtttccccatgttggccaggctggtcttgaactcctgacctcaagcaatccacctgccttggcctcccaaagtgctgggattacaggtgtgagccaccacacctggccatatattgaattttaaaacagaaagaagatatatttaataacaatacaagaacaagtacacataaacatgactgctggttttggaaaaaagtaagtcatctgggttcaaattctgactccgtaatttactaagtctgtgacactactggtcaaatcatgtgttttctcaatccttgtaaaacggagataatgctacctaatttatggcttggtatataaacaagaaatgcattgaaagtgctaagtatagcacagagcacacagtaagtgcctaacaaaagttaggtattttctagctgttaatgctttattagagtcgttccagccaggggcggtggctcacgcctctaatcccagcactttgggaggcgaggcaggtgggtcaccgggtcaggagatcgggaccatcctggctaacgcggtgaaatgccgtctctagtaaaaatacaaaaaattagccgggtgtagtggtgggcgcctgtagtcccagctacttgggaggctgaggcaggagaatggcatgaacccaggaggccgagcttgcagtgagccgagactgcgccactgcactccagcctgggcaacagagcgagactctgtctcaaacaaaaaaaagagttgttcctcttccctttttcctatatctaactacttaaatttcctcttgggtaactaggaggcttttgaaagtcatagtttctttgtacgagaagcagaatactgtagcaaagaatatgaactctgaagccagatttgccacttactagctgtttgaacttgggcaaaattaattaatctctgtgcctcagtttcctctcctgtagaatagggattaaaagtttagaaggttgttgtgaaagtgaaatgaattattatatgcaaagcccttacagcatggcacataagaagctattatgtctgtctcctatacttgtttgtgatttcctcgagaatcggtaatacggtaataagctgacattttctaggtgtttaccatgcagcaagtgctgtgttcagagatctgcatgcattacgttctttcactcttatattatagtcaccattttacagataagcaaagtttagaaaattaagtaacctctccaatgtcatagttaatgggcaacagaatctggatgtgaacccagatcttacacctcttaaccaccaccttttgttgtttgattttcacccctgagcgtccagtgcctaccaacatatcaggcactcacttttgcttaatatgtatttagtgaatctgtgaaatcctttttcagggaaaaattaccaaaactgagaaagtaaagtagaagattaatacaatcagaacagataaaatacaaacttggcagggtgtggtggctcatgcctgtaatcccagcactctgggaggcccggggggggaggggattacctgaagtctggagttcgagaccagcctggccaacatggtgaaaccccatctctactaaaaatacaaaaattagccaggcgtgatggcacatgcctgtaatcccagctactcgggaggctgagacaggagaatcacttgaacccaggaaatgggggttgcagtgggccgagatcgcaccactgcactccagcctgggcaacacagagagactctgtttccaaaacaaaaaacaaacaaaaaatacaaactcaagggctcaaaagcaaaaatctggagtggaactctctagaaatgagatacattgtgtacacccctcttaaccaaagcccaattctaaaccgccaaaattaaacctcttatattagctagtgaacattgcactcacttgaaatcttcatttttgataaactctacaatgatatccttctcgggttgaatttgaagcatcttcaaggttaaacacagaaagggtgttggttttatgttgccaccatagacgccacccacaaaccttaactccatggctttatcgactacaagttcagctaaaaaacaaaaacaatacagtaacatattagggctaagctcttcctagttggagtggagttagttcaagctttggttctcctaaatatacatcaacagtgtaatattaggagaacgaatgtgtattaataacagtaacgacaacagctaatatacattgagaatggataataaaataggtaccctgctaagcttttcatattatctcacttaaccttttttaacaagtcatgaagaaagttctagcaatgttcttatttccaggtaaggaaaatgagggctaagaaaggtaaagtgacttgctcaaggtccacagattgtcacaggacatggatttaaagccacaattcaaatcggaagattacctggaagacttctctgaagcactgatatttataaatactggaaccggcccagatctaagaatagtaagatcatgaatttggtttcaggcatattaacgttaggtccttaaagaccttcaacagattgtgtcaaagtgttatatccggatccctgagcttaacactgttgcaacccagcctgctatcattaaatacggaataactcacaacacccaactgagacagccttcagaatatgaccttaccagattcatctgtgcctctaatactcaacacaagacgaggcacttagcaggcactcaaaatttttctgaatgatcgacatactccgttccagtaccacccccagaggccagtcgctagtcctacccgcgctcggtcaggagaaatgggccacaagggggctgagaggcgctccgcgcgcttccacttacctgtaagtccaaagcactcctctttccagtacttggactcatagattcgcgttcgaatgatcttctccaccagatattgagggttggtgccatggatgctgtgcgcatccttcactgtacggttagccattttagaatgccttcaattctatttccgtcggatcctttaatgcctcacatccaggttcagaaaaagcacctagaggaatggagaaaggtggaagaagtttcactaaacagcttaggcgaccatcttgaagccggaaacaccgtagtgtaaagggcttccgctccccgcgtcgcctatcgaatcaatgatggcggctgcatgttagcggatgtacgtcatgcgcccctcttaggtgtacggagtgggcggggcgagctagttggtgtcgcaacgaagggacggtctgggggcggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccgggtgagtgtggcgtccagcgggctgcgagggactcgggggagggcgcatcggaacctctgaaactgaggacgttctctgtagactcagtcattgattcttttagctgacatgtaccaagcgcctgttcagtgccaggcactgttctgaactgttaagagcgttcctctgttccacactccgattcctaaaaggcttcccgcgctgcagggaactgagtttgcaggggggaaggcggaagccaacagcctagaagcaggagcattcctgccctccgcaccctgatgctcagtgatgactttccctccatctgcatttgtaaagcactctacttgtttcgttctttgagctatagtgtaggaaccactacagggaaggcggagcagaggttattaccccattttacggacgtaaattgcgcccagggagggacgtgtcttaggtcgcttttcgtgactaagcagtctgggctcctacccagatctttttttcagatgagctcctaactgctgggctgtctgtcattcaccttcttttcagaagagaagtctggtggcccccttcctacttctcttttctaaccccggaattgaagagtcttctgctgtgacagttggaaaaggcattcttatcctgatctatttgtgaaactgcaatgattatatacgattctagttgtctgtaacacatgaataatagtaccctcgtctctgctgtgttaggtgggctggaaatgccaaaggagtttccaatatgacagaatggtttaagtccctttgcaacagtttttaactttaatggagggcaatatgtggactttaggaggtttgtgaatctgccgaaattgaatgcaaaattttgcttgaattatgttagttccatagtattcatcaaatgatacttaataaataaaaccactgtaccttacaaataaatgcaagggattaaggtagtgggaaagtggatttaccattttgcattttttcacttaatcttccattatcctaaaatagtgcctggcacacgatgggtacttaataaatattggttgaataaacggaagattctattttctccattttgtgggtaagcaaattgaggcccaatccacaatgttcagtcagtggctgggaagcctgatttattgtaataagtacaccaaaagcaagctctcagttacatattaacattatccagtttcacacagtgtgttgtaaggtgaagtagttaagagcacagtaattgcagtctggcttttccgggtttgagttaaggctgtgccatcctgtataagataggataagttatcaccttgaagtgataataacatctacttttcttttttttattttgagacagagttctgctctgtcacccagactagagtgcagtgttgcgatctcggctcactgcagcctccacctcccgggttcaagtgatttgcctgccaccatgcccacctgatttttgtatttttagtagagacggggtttcaccatgttggccaggctggtcccgaactcctgacctcaggtgatccacccacctcagcctctcaaaatgctgggattacaggcgtgagccactgcgcccagcctttgtatttctgttttatccttgtgtgcattttataagcgtcatgaagacatttacaacccctgtatcactgtcttttaatttcactttgttagatgttttacacctattgttctgccttattcctagtatttctaaatgttacagtttcatttcttaggaattgacctttctgttttcctggatggaaagagatacggcatagtacaagatggacacagatgatactaaattgcctgtgtgtaatcttcgtagaccatgacttcaaataaaatgttttcttagtctaaaatgtatgggagtgtagcaggggcagaaaataagtctgatctcatttgaagggagggactgactatgtcttagaatcca

SEQ ID NO: 12575 - DNA, 55392 bp, Homo sapiens
atacaggtaggagcaagtcttggctcctctaagggctagaaatgcatattcccagaaaattcataatcagctaatcatctcgaagaaaaaacttggatttttccaggccaggccagctggtctgccttgtagccgtgtgcccttggacaagctgcagagagtctcattttcctcatctataacacattaccacactggtgtacttacagaacatgatgacaacatgattagcctgtgctagtgagccagggaaagaaagcacacaaggcttgctctgccaactctcaagtcctccataaacacccaatgtctcagcagcacccatctgaggatagcgggggctcctaccgctccactgttggtgactaagtcaggcgatgacggaagcttccatctatcactcccatgcactttattccacccacatcacttccagaacatcagcctcaaagttccaaagtgaatgtgactggtacttttgtggtaatctccttgtgacttaaaagtaggttgccatagttaccaatcatctttgctggcacagagagcacaatgttattttaaaaattaggtttgtttcttcataaatttattttcataagggatgcatgattattcatacactgtatacaaatctagaaaacacaaaatgtatagatccttcttaaacctgctgtttggacagactcagcccgtttgatgtgttttctttctttagcaggtaaaagtacatacatgcatgcatactgttcagaaacttttttgttttgagatggagtctcattctgaccccggctggagtgcagtggtgtgatctcagcttactgcaacctctgcctccctggttcaagcgattctcctgcctcagcctcctgagtagctgggactacaggtgcacaccaccatgcctggctaatttttctttttttcttttttttgtatttttagtagagacagggtttcaccatgttggccaggctggtctcgaactcctgacctcaagtgatccacccgccttggccttccaaagtgctaggattacaggcgtaagccattacgcccggccacatctaggcactttagaagtcaatcctcaggcctataaaaatggtaaggcaagactcagaaataatttctctcagagattaaaggtttctattgctatggtaggacatagaaacacagcagtcagccataacatttatttcgaatctcatttcctaaacatatggttaatataacaatattgcggttcttttctttttcctttttttttttttttttttttttttgagaaggagtatccctctgtcacctaggctggagtgcagtggtgtgttctcggctcactgcaacctccacctcctgggttcaagcggttctcctgcctcagcctcctgagtaactgggattacaggcacacgctgccacgcccagctaatttttgtattttttgtagagacagggtttcaccatgttggccaggatgggcttgatctcctgacctcgtgatccacccgccttggccttccaaagtgctgggattacaggcatgagccactgcatctggccaacaatgtcatggttctgtctcagacggcatactagtacccatatttgtgctaggatttgccttcagtggaattggaaaaaaccacatcctttttgcaaacgccatcaatgagtcagcctgctgaaggagcacctcaaagagcatatccacctgccctgggccactgaggacccctaaggagcacggcagtccttctccagaccgacacagcacccacacccagggccagaccacgtgcagcacagcccacatcccccaaccagcagatgtccccaagggagctgggcctggtaccttctgggtcctcctccccccgctcctccccatccttcaggctctgttcactgaggtcggccacgatgccactgctgtgtttcttcccttcttcatcgccggattcttcagactcgacccgcctgtcaactgaacccacacatgtcaatgagaattcacatccactttatgggactttgaggaacatataataaacacccggttgtaagtcaaaaggatttcatttaaacatgtttgttgaatccagttcaacgaacatctgagtgtctcccatgtcccagcaccatttgaggcatatggccgcggggagaatggggagcagagtgtggagcccacatggatacttaggtgaggaacacactacttctgccctcaaggagcttgtgaagaattgcccagtgttctgaaagccttggatcacctgtgattaaatccactaatggaacccggtagtgaagcacctcctgagtgcctttcacttttgggctgggggatcaccactgtgacccttctgccacatacctccatccatgctctactatttatctggctaagaaaaccagccaagttcacaggcccacgttctgaaagaaatcaagactaactcaaatcagactgtgggcagggaggatcactaaggaaaaggagaatacagccaatagtgctgaccgcccacagaaagctcattggtgtgaaatgagctttcacactggacactggacagagtgttagcaacttaaggcttttaaaggttcataaatattttttgaattaaagaataaggcaattcaatgtgtcaggtaaaaattctttggtaaggttgtcaaatcatttttcttttttataactttactcatgacctcttttggaagtctgtctggaaaacatgaggcactaacacattacttggaattatcaaccatactgaaaatactctttcctgactatggtttatctacaaagagatgtgctctttgagggaaaaagttcaatttcatctttgtacttcccgcttagcctagcaaagtaaaacccaagaaaggattgctgtagaaaacaagtccttataaaacccacctccaaaacctccaaatccatctcttcttccctacccccgcaatgacggtggctcacttacttattagctgcagcctgggctcctgccctgcctcctaactcgtctctgtgacttgtcttgccctgcttaacctattctcccctgccagagagtctgatctaattctaaaatccaaatctgatcttttgagtccaaaagtatttctggaatgctcttcctgagtttgcatcttgctgctagagatgcagctttggcaaatcgtttccatttgaaagcctcaatctcctagtctgtggaagggagctagtatagcacctatgcctcagcaagttgctgtcacggttaaattagaaaaggcacaagagcagttagcacgtgcatgacatgcagtagatatataacaaattagtcaccaccaggcacaggtcacttggtggtccaggctcagggagagaaagttctactgcatgacaatctggcacaaaaaccccagtaagaggaggagtggtgtgaggttagcaaaggcttagctaacgaaggttggccaaagtgaagcctgagggcagcagagagggtctggaacatgggacagtggctctgcatgtaagaaaatgactttggtgtactggggatgatgggctggtgaacagggacaatcaatctagcctagagatgatgaaggtctgagttaaggtactggcaatgggaatggaggacgtatcggagatttggagatactttcaaaagtaaaagtcagagctccttgactaacaggacatgggtgggagtgggacagtgagaaaagccgggcttttatatctgtcatttaccaagacatggaaacagctgaagagggagtgggaggatatgaagaggcgcttcttaaaaagactcaaagggtatgaagtccaagacccttaacactaccgcccccatccccaccacatacgatttggtcaaactctcctccacaccttttgacagcagttttctccgtcttgagtgattcttgctcttttccctcaccctatccccaacctcgttgccttcgagttattcttcaggctccagctcagagctcgccctgcttctgcagctgtcaccactccctaacatgtcaggccttcctgctgcacccgccctccttccccagctccacattcctcttccctacccctttcacataaggcagtgactgctcttctgggaggtctgtacccctcaccaaaccatgggacccaaaagtacttaagctgatgacacaactgattccccagttgctaagtgggtgtgtgcacgcatgtttacacacatactgtacgtgcacgtatatgactgtacctacagatatgcagaaaattataaacacatgtgtacgtataacatatacatatatgcatgtggtttttttttccaacaaagtgaatgaggaggaagaaagttgaattcagactttttggaactatgacagctttgaaaacaggtatcaccttgtgtaactcaatcttccggttccttgttaccccttcccaacagtccattcgatttcaagagaagacccttctccaccctcaccacgtgaaccaaggagcagactctggtagatcccagcgcctcagtttcctcgtcagctgaccgaggaggctcccccgcccgtcaatctcagaggctcggggcgaggctccaactggactgaatggagccaccgcgtcccattcagccccacccccggcctggcctcgcgccgccgctctccccctagctctgggtccttcccggccgctgccgcccccgggccggggctcccccgaggtccagcgcctcccccgctcccccgggtccggctgtcagctgtcagggggccgcgcggcggcggccagaggcaggacgtggagtttctctcaggcacggagcagttccagcccgcagctccccccgcccgctgggcccttgggccgccgcccgcaggggccgctcaccctccatcatctcctgcgactgttgctgccccgcgccgcgttccgccgccatgttggctgctcttcccctttccggaatctgtcgcctcagacccctcagccaatcagggctcccgcctcagagccggccctgccaatgggattccggcgcggcgacttcagccgcgccgcgcctgcgtgggcccagcgcctcatgggagttgtagttccgtcatgaggccgcgcgccgcgcctcccccagagcaggtaatttcaggcggcggagccggaacagtctggaggcgagaagctgggaaggaaagcagagggagtcgaagcgggacgcacagagccgtagctgcaggcagacggagtggacgtctaggcagagtggagagacgccctgggcttgagagttgacttatgtcactgtctcgacctcggaggcgtggaggggccgcgggccaggcggatctttccgtggctgcaaggtgcgggccagtcctacgtgcatccctgacctctgcgagcctcgctggctgcgtctgtacaatgggccgaacggcaagagcaacaacattctcccggcgtccccgcgcggattttacccatgcgaaatgccgccttctcttgacgctcggagcaggcgggcaggtgcggggcacttgcgctggtggggccgctagccagctggctggctccggggcgccagctgggctccccttgcaagtcgttcccagcccagtgcggacgctgcagccttcgtctaccctgcggagccacccggcccatgaacgagccgccccgcgtcctccgccttcagaaagaggcctccaagaggcgagctctgcgctactcacccattttgatcgcgagtcgggaggaaaccgcatctgcccggcccgggggcggaggcgcccattattcctttggctcctccgaagcgccgtaggggtgtttggtgcgtccctagcaacccttagcgcgggcttctagactctggctagcttagtcccgcccatacgcgcaagtggctggtccgtggagcttgtcaatcggtgcgagtcgctgtgcgattggtcggtgggataaaagcgcggaagggctcctttccgtggtgtgtagccggcttggcgtgaccctcgcctgatccaggtgagatacctgcgctcgggagagcgggccgggctccgccatctccccagggcggctgtggggcctgcgcggctccgcgcccctggcccaggaggatccgccgcccgactcttagaccagcccgaccccgggtctcccgcccctgcgcccgtcgcccttcgcgcaccgccgagcccgcgtcctytccgtgcccaaatcgcggcggggttgcggccgttggccctgggccccgcgcccccagcgtcttcggggtgcccttcagtgtagcctgcccggtgggcgccgaggccccgcgcctcgggtcgcctcgggaccctgcgctctcttcaccgcagccggccctgcggggcgagctccaggagaaccagcccggatcccgccagcctcctgcactgggcgtgtgggtccctgcgggctcagccggcgccgcggggtcgggggcgcgcgccgccggcgctcgtggttacagcaaagacctggacttgagccttaattttttcactaatttttctttcccagagtacggcaggggcctgcgctgccgtcttgaggcctttctcgtccttaccttccgcatctcagtaccattcgatgtccatttttctcttaggggttccctctcttcatctttctgctgctaccttaatttaagactttataatttcttgcctggattactgtagcctttctcctgctttccagccttgcaccgacatggtccctggagtaatctttgtaaaatgcatatctggccatgttactcctaagcattgaatccttaaaagttcattttggggataaaattaagactttgggcaggcataggaggctctgggctcatgcttggcccttccaggcccacgtccacctactcttctgggtactgaactcctctctgggaggctttgcctctgaaagacttcttcactctgcttggwagggcccggctctgcaggtgcctcctccaggactgacatccttgctgtgttctactgcactgttcaccttgttggcctcatcctgaaactggttctcctttttgttgtacagctgtgctgacagcaatgggagctgtttgcttcttagcttatgttctggtgggagggggacagttgcytctagaagttcgccgagatgctccctgcaaagttgtccttgcttctgtttggtctgaggtggggtcacttgtgtcttctggaatcaaaactagcaatgggaatatggttactcggtggcaccattaggtgctgtctgctgggtttgggttcccgtgtctgcagctcacagtggatacaaaggacaattttaaaaatttgggcctggacgtgcaggtatttctggttaacgtctgagtcaaaatttagtgatctaaggtcatgtgaagccagactctgttctttcttgaggccaggctgtggctgtggagtgcacgggaggctccaggggcctatgctgttcagtgacaaactggcccacgtggacttcagatgcccaggaggcacagcgggaaaaaggatgcatctttcctgctgtcctccccgctcccgcagagggtcccatcagtttccctcctggataggcttgtaactctcagtaacctaattaaacttccacaactttagttggtatttatttactttctcccatgaaggacaaaaaattgcatgcccttaccctccctttgctttttttccccctttccatttcatgttagttacttttacaaagaaacttctgtaacatttacaatatattctgaatagttatattacttttttatyattttattttttgagacagggtcttgctctgtggcccaggctggagtgcagtggtgctgtgtcctctcactgcagcctccgcctcctgggctgaagcgattctcccacctcaacctcccaagcagctgggactaccagcatgtgccaccacaccttgctaatttttaattttttttttgtagagatgrggtctccctatgttgcccaggctgatctcgaactcctgggctcaagtaatctgcctggcctcccaaagtactgggtatatgactttttaaaatagttttgtaacattgacattgcagtctgaagagttatattttttaggaattaaagttttctaacaatgtattctgaagagttatattacttttttaagaaagtaaggttttacaacatttacaatgtattctgaagctataattaagtgtcctgagctttgtctataggttggttctaaaagtagaaaaaactgcctcacactataatcatgtcattgttatttattatggcaataattagtgcatttggatgcttagagaaggagatgtaaacctgtaactaaaggtcccattcattgttgctgcttgtaggaaagctgcacactcgaaccccaaaccctatatgtaatagcttcctacacatctgcaggtttgcagagcctttgccttccagggtcctaggctgggtttgtgtgtgaatgtctctgaattttttggccgtatcagtttattcatacaaaagaataaaggcagtgttagtcatgaattgtaccagcagagtggatgcatttgaacccatcaccctaggaaatcaggggacctgtgcccttgtgcctcttccccactcttgcacctgcctgacccagagggaascayctgcctgaaatttaggtttaccagtctcttatttaagaagtagtttaattacataggtgtgtttccctgaactacttatttagattatttcatgacaaaggaatcctcctgctgattgtcttccgtaacttgattttttccactcgtatatggctaagattcacccttgtgtgtagttyatttgttttcactgctgtaattagtggtatgaatataccagaatttaaaatctatcttcttgttaaagagtgtttgggtttcatttccttttttcctccctctctcccgcactccctccctttcttccctcccttttttctgcctgtctctttgccattgagaaccatattgtcccgaacattctggtgtcttcttatctgtttgcaaaaatttctctgaaatataaatctaagtgaaaagtgctgtatccatataracaaatgtttcacttgaattgttttctaaagagattatattaatgtattaagagttcctgttgatccaaatcctttttgacattgggtattactagattcttcatttctgctgacttagtaggtataacatyatcatgattaggatttcctctcctgtaaaacgcttgttcctatttcttgacattttttattgggccatgtgtcttttaaaaatgtttaaattttaaatagttgatcttttaaagctattctggatattaattttctgttggttatgtatgtggcaaatatcttctcccaaattgtggcttgttctttcrttttctttatggtattctttgtgaagctgtgttctcatttttttttttcttttttttkggggggacggagtctcgctgtgtcgccaggctggagtgcagtggcgtgatctcagctcattgcaacctccacctgccaggttgtgtcgccaggctggagggcagtggtgtcatctcggctcattacaacctccacctcccaggttcaagcgattctcctgcctctgcctccagagtagctgggaatacaggtgtgtgccaccatgctcagctaatttttttttttttagtagagatggggtttcaccacattggtcaggatggtcttgatctcttgacctcgtgatctgcttgcctcggcctcccaaagtgctgggattacaggtgtgatgtgttctcaattttaaygttaaacttattaatcttattttatagctagagttttttgtgcsttgtttaagaaaactttccctaccccaaagtcttacagatagcctcttttctcctaaaaacttagtgattttattttatattttatttggtttgacaggtctcgctttgttgcctaggctggcctccatctccctgggctcaagcaattatcctgccttagcttctagagtggctcggactataggtgcaggccacgagacctgcctggctaaaaagtttagtgttttgacttccacasatcagatcttttatgccctgggcaccatagtgagacctcatctcctagttaaaaaaaaagatggccatgtgaagatacatacaaacagggagaagtcggccgggcgcggtggctcacgcctgtaatcccagcagtttgggaggccgcagcaggtggatcacgaggtcaggagatcgagaccatcttggctaacacggtgaaaccctgactctactaaaaataccaaaaattagccaggcgtggtggcggstgcctgtagtcccagctactcgggaggctgaggcaggagaatggcgtgaacccgggaggcggaggttgcagtgagccgaagtcgcgccactgcactccaccctgggcgacacagcgagactctgtctcaaaaaaaagaaacaaacaaacagggagaagctctgtgatggcgaaggcggagactggagtgacgcagctgcaggtcaagaacaccaaagatggccagtatggccagtagccaccagatgctaggataaggcaaggaggggggactccttggagttccatattggaagaggtggtgttgggagggccacctcccctttcctcttcaccccaggcctgccttgtcttggaagggcctcgtgtgggcatcctgctagcttgtccaagctcgctattcctggaaggctgctcctcagccagttcacggctataggtgtgccagtgtgggargacytgggtggaaagaggcctgtgtgtgtcttagaagtgggcaccagaccctttggctgggaactctggggttctggatacccagaaggtggtccagaagagggtatatggggtgtggttgggcttgccttggccccagggtctcctmatttcgtgggggaaactccagccatggttctggtattggccacagcctcctcttgctgtttatctaaagcctggatgaccaggtgggggcttcctgycagtagaggaaatcttcttgctttaagggctctttttgttgagtttggccatgaggacagggtattggtaaatgtgtacttgtgtttcaagtgcttgccaatatgcaggatggaactcttaagtatctccactctgcagggtggtcacatgaatgtatacatgtgacaagactgcatggaacacgtgctcacatgcgcgcacacacacacgctcatgtacacatgtgcacacgcacacacacgcayggacacacacgcacacccmcacacacacacacctgcaggtaaatgccttgaaatctggacgaggctgatggatggtatcaagtcagtttcctggctgtgacactctcctgtaagatgtcaccatgagagggaactcggaagagtatgtgagattttcctgtatttccaccctgtatcagcatttgaatcatgtataagagaaaagctaaaaatacaaatctctggtgccaggcctgtctctaggagacatggcctcttggccatggcccccgcgacctcacttgttggcagcacccaggtgattctgtgcacagctggtcggatggtcaggactcactgtttaggggaaagctgagaccatgggagctgtgcagcccccacgtgctgatgggttcatcatgacctgggagtattttcagttggtgtgtacctgcagtccctgccttccctcatggctccttcccaccctgttctttgttttcctctctctctccttccctctttcccatatcttcctatgtatttttcttggaaagagcttctttttttttttctttttttttgacatggagtctctctctatcgcccaggctggagtgcagtggtgtgatctcrgctcactgcaagctctgcctcccgggttcacaccattcttctgcctcagcctcccgagtagctgggactacaggcacccrccaccatgcccggctaattttttgtatttttagtggagacggagtttcacagtgttagtcaggatggtctcgatctcctcgatctcctgacctcgtgatccgccctcctcagcctcccaaagtgctgggatgacaggygtgcgccaccktgcctggcccggaaagagcttcttttagcaccactttgggtggaccattctcccatygcgggttctgacccaggatggcggttggtgrtgtatgtcttttggggcygagctgaactcagcattatraattagttggttaaactgtctttgtgtttttgcattgcagatgttaatcagcttcatgttgttttctagttgttagagktggaagcttggcagttggcctcccttcttcccatggaggacgggggcttaacagcctttgaagaggaccagagatgcctttcccrgagcctccccttgccagtgtcagcagagggcccagctgcacagaccactgctgagcccagcaggtcgttttcctcagcccacagacacctgagcagaaggaatgggctttccagactctgccagagcaggacrgcgctctctggtaatgaccttcgaccactgcaggccttakcgcrtggaaatacaaatgtggagttgctctgtgttctcatggaaaccctctcaccagggattgaagtcactctattcctgcagagaaaagttcgtggtttaagtgctcggctcatgctggcagatgactccggcaggacccttcctgctgcttttactctgctgtgattcccaggcagcwggcgcttcttttcaggcagcaggtggaactcaccttcacatttcagggtcaagttacaacaaaatgttatttcttactttagagtatgtgagaacgctgttctaggttaggctattttacttagrgaattgcagctttgctcgtgcagtttactgagctaaacgyggtttagctggtggaccaagaatcatggggcagaagtctgttggtgcctcctmtgtccagattccgttggtgcctcctttgtcsaggcaccccaaaggwctgggccatggtgaggaaggaagcgtcacttgcctttcaggggctgtctgatggaggcacttggggagacagcaggctgtgtgcttgaagttggggtagacctggaaaatggggaagtggggcatagagctgcgggaaatggtggctgggagtctggtctccaggtcaaggagcacttcgacactggagtaggagggtgttggagctgagcttgtgcactggagtgtctgagggtgtagagcggagggccctgtggagagtgcccaggatactgcagggaggggtgggctgggaggcacacagcgcccttgggagtgggcttcacccaggcgctgatcaggaatgttctcagtgagtgttgacaggtgtgttccttttttggagcatcattctggtggctgcatgaggagcaggggtgggagccggaggtacagggccttgagacatgagaaggagctgcgcttggtgactgctgtctggggaagagcaggggcgagagtggctggatggccacgtggtttccagcctcagagaatggtcggggtcaggccactcactgagaaagtcaggggtcctggctggaggacatggaggggaggggatgggagagaaatggaagggtcaggtcttgagtgcttggttttgagcactggaagaatgtatctggtgtctccagagatggggaagcaggcgagtgggccgtgggaggtccaggctggaggtgcgagtgtgagagtcttcagtgcatttctaattagatgtatttaaagctaccgaggaatgggtgagatggagccagggtcactgagaggtgggaggtgggggagcccaggtgcccgaggagggtggtgtgggaggagggtgaggcctgaggaatgacggggctgagggttttgggagccattggaggcgttgctgagagaacgctgcacaaggagctcttgaatcgtaggaacgcttccaaggaggaggtgacggggcagccaccggagtggccatggggtcttggaatgactgacagaggacagaaggtgggaaggaaggaacctttgagtgtaattaagcttttttgttttttgggacaaggtctgactgttgctcaggctggagtgcagtggcgcagtcatagctcgctgcagtctcaaactcctgggctcaggcaatcctcctgccttagcctcctgagtagatggggctgcaagggcacgccactatgcccaastgatttttacaaattttatttttagtagggacagggtctcgctgtgttgtccaggctggtcttgaactcctgaactcaagcaaccttcctgcctcagccttccaaagaactgggattataggcacgcctggctttgartgtaatttagacacagaagtgttgatcttatgctgtttgtgcttccgagtggacctggtggttgcctaagtggattctggggaccatgttcagacacgcagtgagagtgtgtgttagctgtgcagactgacttaatccttagatctttttgcaggagttgagggcaagggctgtgtgctttgcctgtttcagaaggtggactctggcagctgtgtgaagtctaaagcttcgcttcgcttctcttttcagaagacagatggagctcctattgtctatcatcactggctgcccagaatatttrtacragtaaactgcactgccctgctgcccctgagcacacggacccgtccgaaccrcggggcagtgtgtcctgctgctccctgctgcggggactgtcctcagggtggtcctcacctctgcttccggcccctgtgtgcaaccctaacaaggccatcttcacggtggatgccaagaccacagaggtatttgcttctcttttagatccagctgtgtagatgtggatttgtggtttgtgccttaaacctgggatttgtgtgttttaatgcaattagaaaaacatttgggcacttcgggaggtgggaagtttgcttgagcccaggagttcaagaccagcctgggcaacatagcaagatcccatctctacaaagaaattagccaggtgcggtggcacacacctgtagtcccagctaccagggaggctgaggcaggaggatcacttgaacccaggagttcaaggttgcagtgagctctgattgcgccgctgcagtgagctctgattgcgccactgcactccagcctgggcaacagagtgagaccctgtctgtcaggaaaaggctggcttctrcatggtcgtcctgggctgttctgggcagctggtggagctgctggggatgtctgcatccttgctcctctttgtgattcctcagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtgagtggatgcgggtgcagygttcagtctggcctcaasaccagcagtgtgtggcaggaacagctcrgtgttccctaccaggagctctgctgggggttgggtggcaccaggacatctcagcttcttcagctgaaaatgtcatcccaggcgccgtttccccgcttcagctgcagtgggggtgggggccctttaagaaygaatcatcgcaggaatggacactgtggctgtggctggactcctgggaggtgtcgtgggtggcccttgctttgtctgagggctgtagcttcactaaygttttgcagtcctgccgggcagcacatcagatgctcaagagtaatatggttttattgtctattgatttttacattctgtttggtgtttgtgggagcgggcgggggtgttggcctggaagcatttccctagacagtgttgattctctcacctgtgccatgtgtccaacctggatgttgacaggtgagctgagttggatgtggaggactgagcccaaggcatggaaaaagcccaaggcatggctgattgtagggtttcccctcgtcagccggtcggggactgggggagtagcgttggagggcagtggaggttggggtatgatctgaggctctagtagtcatccagatcctccaggttgcctgtttcccacctagtgtgtggctttcacacagaagaccccattgcttgaactgaactgatgtcacaggcttaggaccaattgtatcagaaaatcactggttcaagaaactgactactaagaagaaaaaaactaagatattcaccatgtgttggtgtctgtttctttaagaaataacagatactgcttttttcaccctgcaatattaccatgaactgagaatgaaatctactctcttgataaaacttgcacttggagattttaatgttcagtatgggaaatcttgtttgtgctttggtaaatttctgaaatgaaartcaggtaagcagaagttgaaaacgttgcagtgcctggagtttgggcctcctggaggcaggtgccccacccatactggtcttttgggttcatggcatgcaggtgtgaacctgtctgtttccacaggtggacatcatcagccgtagtggggagaagattccagtgtctgtgtggatgaagaggatgcggcaggagcgccgcctatgctgcgtggtggtcctggagcccgtggagagggtctygacctgggtcgctttccagagcgatgtgagtgtgcarctttgcctcatgtctcatggacgctggagccggcgtcgttctcctcttcagcaagtgctggtccctgtctcattcctttgggaagaaagagaggatgaggagcctggagggtctgcccagtggtaccctcgctgattgcgtgtgcttgggcagggaacgaacttcctatacttcagttcctcacctgtgaactggggcataatcataactcctcataagattgtttcaacatttaaatgagataatatatgtaaaccccccaggatagtagctggcattagagacagccctcatatgtgaactgggatgttattaatgagctgtggtgtgggccaggctcctgaagaacaagaaggcccacaatttaggtaygtctctggtagaaggagacagatgatgaagctcttatcaaattcatgtgtatatgtctcttgcccttccgatggagaagtcatgttggggtcttgcttttggcttgaacatattgaagcttagttaaatttacagctggagcacaagaagcttttatgataagcacggggcttttcctccagggcaccrtcacgtcatgtgacagtctctttgctcatcttcacgggtacgtgtctggggaggacgtggctgggcagcatatcacagacctgatcccttctgtgcagctccctccttctggccagcacatcccaaaggtagggctcctgacctcccrcactgtgtgatggggtggagttcttakctctgaatccataactggagaygcagaccaagggtttctgaaggcaagggtggccttaggggtgggacatgctcagttttgagcttcctgtgcgctgaggccttgaccaagggccggagcctatgtggtctcccagctgaccactcttgtcccctgagtcttctcccaggagctgggccacccacagaggtggatgctgggacgctgcccaaggctgaggggtgggaggtaacatccacagctgcgcagctggtgtagtgctgcctgtggggccagtatcctggtgccagatcaaggatggcacagttgccagtggcgtggctgagccccgagcctgagccccacagtcctccctccctccctccctgctggtgccyggcccctcactggggtgtctcacttgcccyggggttgctgtgcctggggcggctctggacactgagtcctccccacccacagaagggctctttcctgggccagctgggcctgggaggagagggaaggcagagcagtgtgggtgtgagatgtcctggggaccttccccgatgacgtggggtagaagtcgggtcggacgcagcacagactcagtgctctgtccacgtgaaacacggcttaagccaaacgacaagcctttctttcagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaaggtggggctgccctgggcgcctggctcccgttycctgggaggaagctgctgtgctctgcagtgcgggcttgcgtgtggcacaggcctcgcacccggcaagctctccagctcgctcctttacccaggaaggaycttgggtccagggagggaggtccctgctcatggctgccaagctccttcctctccacccttccccagcaaccaccgtcggagggagaggagcactgtgcttcgaagccctgagagatctggtctgactgatggaccagggtttacgacacaactgcgggggttcatttctcaccctagtagaaatactaaaaagtagctaagctgaattgtagttacgttaaatttaagttagttraaaagcagttagtgttcttcctggatgaggggttcccacaggagctgagggcattgagaccttgcagggattttgggggcatggacacttgtgccctctgtgaggttagagcgggttctggcattacagctatgggcagtgtccckgtgagggggccacacacaggttcagaggaagcatctgtcagagcagctcctggcctgggaggaaggccccacagtccttctgtcctgggtgcakgtcactgttccggccaccagtgagccgcgtgaggtgaggcttgcaracacaggctcccagatccatctaaacatggggccaaaggccagatgtctgctccaaagatgtgtcgatgtcactgtaacttgccgcagagtatgtttttacctttttcttaaggggaaaatcacagatcacatgttgagcatcygaggggcttcaggtgcgtcgaagggcatttggcccgaggcctttcctgaccttaagggtgaaccctcagggactggctctccttgtgttcattcctcccccagggggacggtccagtgggtcagcgtggatcctccaggttctgaaatgtccctgctttgttttctagaatatcactttcctgattcctggtttctacagctacatggaccttgcgtacaacagctcattacagctcccagacctggccagctgcctggaygtcggcaatgagagtgggtgtggggagagaaccttggacccgtggcagggccaggacccagctgaggggggccagggtaagacgtcctcttcctcctgaatgcgcctgtagctgctgagccccagacagccccatgcctctgagacagggctgggaggagcaggagctaytgtccctccagaggctcaggggtggtggggggcggagtagggggtgactgttttctggtttgatgttcctctctgtctcgggggctgtgacatattcttataaacatatgagcatagagaagagaatagaaaaccccccaagagtgcatcaccagtgcccatgatatccgagacacagcatccgagacacagctaactgaccgtcttgtcttttctaagtaaacttatatagcttcatgtagtttaagtgaagccatgtagcatatcggattaccgctgacccttgaacaactgggtttgacattagagggtccacttatacacagattcttttcaacctcagaaatccagtactggtgggaggtgaagttggcgtatatggagggctgactttccatgcacctgcgttccacgggtgggctgtgggacttgagggtgctcggattttggcattctgggggtcctggaacccatcccctgagtgtactgagggttgactgcaattcctaaattgaatgttctaccagtatttcctggtttaattatgtttatcccacatagttttaatttaacattttaaatgatttcaacaaatactccgagtccctttcatatgcacagtcttaggtgtgtggcttgtgaagacagggtgagcacactgcctcctgtcccgagggacccactctggctgggagcaatgaggggcagtagaaccygctgatgtcctggcagggcccacgcctgagctcctggtaaggagcaggcccctggctgcttccacagtgctcaytcttgttgacaagcatggggtgggggtgcgccctgtccctggctctgccctggtggggaccccggaactctgcctccagggcctctgcccacctggagcgtgggctcactgggtgtggttctggagttcctggggcaggctggggcccaagggtccaggtgatggtgtggcaggggtgtcaggtgggggggtctctgttctatggaaggacacagtgggggtgagagagagagagtggccagtgctggcagaaagcacagccrcctcggggctctgcatcgtggtggggccaggcgggtcggcaggtgctggcttgcgaggttgtcctgcmtgcggtcactcgggtatcgaatgagtgcgaaagtggatttaatacagtcactgagaaaaactacagcttcacgagactgaccagcctggtgagataaacatttaccgtcagacactctttagctgtctgggcattgtgtgagttctttggcacatgcgcccagcctccttccccacagggtctcgcctggggcattagaagctggattgtaacatttgttttaaaagatactttgttaggctgttggttctccttacaatccyggctttccttagcatgtggttcccttcattgtatctgggtttttctatctcagtctgtcctttatacaagctttttcctctagcactaattatattccccttcccctttttccagaattccaaattctgacctgtgcatgcatgcctgtgttgagtacatgctgtttgtcggatatttggtggtggggggaggggatcacatttctgttactctcgcattgtttccttaggatgaattcttagaagtggaacttctggattcagggaatgaacacgtttgctagttactgtcaaaaatgcctcttggagaagttatgccgaaccacccaactgtcctggtcacagagcaggcttctctcggcttggggctagggttctttctggggtcgtccttttttttttttttttttgagacagagtttcgctcttgttgctgaggctggagtgcagtggcaccatctcgtctcactgcaacctctgcctcctgggttcaggtgattctcctgtcccagccttccgagtagctgggattacagggatgtagcaccatgcctggctaattttgtgtttttagtggagacggggtttctccatgttggtcaggctggtctcgaactcccagcctcaggtgatctgcccgcctcggtctcccaaagtgctgggattacaggtgtgagccactgtgcgtggcctcccagggtccttcctaatgcaggctgctttctctcatgtaaccaagagacatacwttcatcccctaccacgtgccaggctgcrctgcgtgcagatgcccctgcgctcacggggactggagggagccaggtgacatggagcccaggaagtggccagagctcgggaggaaggcaaagaggggaagagggcatgcagtcttaggcttggggkcccaggaggcctagggaagccttgtagatacccaggtacagcatttctgggatcaggagccatgatcccaaggcctctaatacttcagatatggcagggaggccaggtggagagacctggaggagtgaggccacagagttggggggccatggccgagacttcggcttctatccagagtcagatgggagctgttggagggttgtcagcmgrtgagkgccgtgctctgacttgggtgttaataggatcatggtagctggctgcaggtgtcctgggccaaggagcagggagacaggaggcagagaagagggcgctgggttggacctgggacgcctggggtggtgagaggtggtcgatgctggtcatgctgtgaagcagtctcagtgagttccaggcgaatgagcagattygttttagggagtgcctgtgaagagcaaacgctcttttttggtgttgctgccagatccaaggattaatgtcgtgcttgctggtggccacgttgtgccccgagatgagatcyggaagctgatggaaagccaagacatcttcacygggactcagactgagctgattgctggaggccagctcctttcctgcctctcmcctcagcctgctccagggtaagtccyttggtgggaggttgcaggtttactaaaagtccagacagatggtaggtgaatgaggaacaagtcagagagaaatgttcagcctattattcatagtaacattgaaaactcacatgtgttsagcacctgctctcttccacacacactgactgctgggttttctgtgctgcctggctgagtccttatcagcctgtatgggagggcaccatggtgttactgtctcactgtagggataaggaaacaggctgtggagagttccagaatgttgaggtagatttcagagaactgatggaatcataattttatcattttccttttttttttttttttttttttttttagacagagtctcgctgtgtcacccaggctggagtgcagtggygcgatctcagctcattgctcattgcattgcaagctccgcctcctgggttcacaccattctcctgcctcagcctcccgagtagctggggactacaggcgcccgccaccacgcccggttamttttttgtattttttttagtttcaccaygttggccaggatggtctcgatttcctgactttgttatccacccgccttggcctcccaaagtgctgggattaattttatcattttcaaagtcatatgaagctgttctctttgcacattttaaaatattctatttagagtaaagaaagtttatattagagaattaggaacatttggaaaagtagaaataaaaacttgttctattctcatagtcgtattgtacatagcacgtgtgtgtgtatttttaacccattttcttcttcggaatcttttttttttttttttttttgagatggagtctcactcagctgcccaggctagagtgcagtggcgtgatcttggttcactgtaacttctgccccctggttcaagtgattctcctgcctcagcctcctgagtagctgagactacaggcacctgccaccacgcccggctaatttttgtatttttactagaggcggggtttcactatgttggccagactggtctcgatcccttgacctcatggtccacccgccttggcctcccaaagtcctgggattacaggtgtgagccaccatacctgacccagaatcttttcttatgcacagcatgcagtaaaggtgcccaaactgtaggtgcccaggtggcccaggaccctttcttggctgcctgcagaccctgggtccyttcctgcactgtgccccctacaccctgctgccctgggtcagggcagaggttagactgcctgccgttgagcctgacgcatgcatttccttctgtctgccttctgcttattgctgtgtctgtgatatttatccacatagttgtgttttctagtcttgaaattatttaaaaaatatgtaatagatacatataaagtatgtatgtatgtttaaaaatatgtaatgcatgggccaggcgcggtggatcacgcctataatcccagyactttgggaggcygaagtgggtggatcatgaggtcggcagatggagaccatcctggctaacacggtgcaaccccgtctctactaaaaatacaaaaaattagccaggcatggtggcgggcgcctgtagtcccagctactcgggaggctgaggcaggagaatggtgtgaacctgggaggcggagcttgcagtgagcctagatcgcgccactgcactccagcctgggcgacagagtgagactccgtctcaaaaaaaaaaaaaaaatgtaatacatgcatatgtgtttttttaattatagaagaataatggtaaaagcaatagttcccctggccgtcttccaatccccctcctccaatcctactctttcccccaggggaccgcagtcagcagttagagccttccaggccttctttcttgtgcatttaactatagttgtatattatacttctatgtgtgcatgtgcatatgtgtgctcacatgtaactgcttctgttccctgagcacggctgggattataccatacacagtgtcctaaatgtgtgtgtatgtgtacgyacacacatgtcctgcagatcttcctctacaggcctcctcggaaccgaagcctcctggatggcaccctagctcatgggccactttcccactggccgatgtgccggtgctttctcttgtttgcttagcctccctgattttccctttgccactgtgggtccgcgttgagtggcgtgagagggtagctgttggctctatttgctcyacttccactgygagtggaacagagcaggcgctcaacacgtgagttttcaatattactatgaataatattgctgtgcgcacctctccagaggtgccaccaagctgaagtggggcggccgtggttgagggcccaagtctgacccgtgggtgctcaacagcactagcggccgggcccccttgccagtgctcccgttgtctgggacatcttggtggacagaggccacgtggcccgttgctatcctcaggaccttggacacaactcatcttccaggacttggtggtaccaagggagttgcccaagatcagccaattcctagtctttctattgcattggacgtttctggatgtcacagttctgagagtttgattagcatccactgcacagctagtgcagttatgactatagagatttatccattcattccccgctcagtcattcactcactcgttcgcttattcaacaaataagcattacagaagacttggggtgtgtccctaagaattgtagtctggtcaggacaataagctgaaacagtaagacagaacagggttaggaagcatgaaggaaggaggtgagctgtacggagtgcttttgtgttttagggactacgttgggtgcttcctcgtaagttgtctcctttagttctcctggtaatcctgggagtgtagtctgatttttagcaaatggatgctgaagctgagtgaattgttacactgggcatcaggtcctcraagagaccccaggtgatgtgctcagacagcaggtgggggtctcgggtctccacgggggtcaggtcctggtgcttccccactggaggacctacggtccctggggctgccctgggttgaggtcccagcagctcaaggcctgtgtgcastcggcagatcacatccttcatgccctgactgcatgctggccagaactgagtggcgtggcgatgcctggctgccagggcagctggaggatgtcctcrtgtttcctgagttgctgtcatgctgaaagtcagagatccacagtttcacaatctcttagccaaaattatgaaatccaaaaagcccccaacactgaaatatttttcttagaattgatgctaaaagcattggayggtcaaattggccctaagcacgtgagaagctgtttgtggttttcccttgacctctgcagtttgagtgttcagaggccttgctgcagacacagggcagtggatgcccgtgaagccctctccccagcctgctggggtctccctagcaagtggtcatatgacttttctgaaatccccaaacacatctggcccaagggttttgatggaagggccgtggacccaggtgactgtggagagaacgggtactgaggctgcagcagcccgctaaggccccaagagcatgggtgaagatgcagtgctgcccaggggcctcagctttgtgtctggactgtgccccagaagttgcccagactctttggcaaggggctttgtgagaccctcgtggtgtgcattcgcctcctgtcttacctgatcctgcaggaggatgtgcagtttcctagcatttgcatggggtttgtctcaagcatgggatggatggagagcgggagagggaggtacaggggagagagagatgggagacatggagggagagaggcgggagacatggagggagagaggcaggcagacgcagaccctcagcctccccctcagttcccctcagaaaactgcttttcctcagaacttggctcacaatccctttctctgtggaacccacccttgggttgtatccttcctcttccgtctttttttttttgagatggtcttggccattgcccaggctggagtgcagtggtgcgatcacagctcactgcagcctagactcctgtgctcaagcgaggttcccgcttcagcctcccaagtagctgagactacaggtgtgtgtcaccacgctggctaatttttaaatgttttgtagagacgaggtctcactatgttgcccaggctggtctcgaactcctgggctcagcctcccacagtgctgggattacaggtgtgggccactgtgcccgatcctgtcctctttctgagcctctggtatacctttattaggttgctgatgttaacctgtgtgtctgtccccgagtgagktggtgcggtcacattctgtgcatctggtgcccagtgtcagtctgtcatgtggaggccagtggctgggctgacaggaggcctgggtcccttggctctgtgatcatcctgtctggactgtggcagcctcctcatgggtcaccatgtgctgaatgctggaggacattgtgtgccacctcttaggagccgccctcaccagcctcctctctctttttcggcccgtgtccccttctttttttgtttgtgtttgagacggagtctcactctgtcacccatctcaccagtgagctggtacaatctcagctcactgcaacctctgcctcccaggctcaaaccattctcctgcctcagcctccaagtagctgggattataggtgcctgccacctcacygggctaatttttgtatttttagtagagacaggactttgccatgttggccagtctggtctcgaacctcctgacctcaagtgatctgcccacctcggcctcccaaagtgctgggattacaggcgtgagccaccacgcccggccccctggcccctggccccttctgtgtgggccccatctgagagccatttcccaaatctgagagccatttccctagtcggctgtgaaatcggatggtgtttgtagtcaatcagttgtttttttactgttgtggagtttaccagggactctccaatctctctctcgtttcctctcacacctcctcaaggcagcagcacggacttccccttgcaggtggggccgaggctaggctgcacggctgacggggggtttgggggccctgagatgaagcgagagcgctgaccaaagcattggcaagtkctcctgtactttactgttgggcttttggtagcrttctctgcaaaatcatttctaaatgtggacttaatttggagaaatttgagactaagtgctttattttttaacttggtcacaaaatttggtctttttcttgttataaattggtggcattaaatgctttgtacttagttctaatggagaatcggtgcamtctctccttttgactcatctgtggccctacatgatggtcacccatgtcattatccccagggtggacaatgtcccagaaggaagcctgccagtgcayggtgaacaggcgctgcccaaggaccagcaaatcactgcctyggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcrggagccctggatgtcccccacgccgaactcgttccgacagagtgccaggctgtcaccgctcctrtgtcgtcctgcgatctgggaggcagagacctgtgcggtggctgcacgggcagctcctcagcctgctatgccttggccacggacctccctggggrcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagayggcttacggctgagtatgtcccgggccccataggaagaagtgtggtgctcccagagcacagtgcagtgggggtgcagggccttccttgttctggggtctgatggggtttcaccctggaatagtgtyagcagaaatcatgttttcaaggagaatgcatatcatccacccctagaaaattaagattacgaatgtgtgtgcctggggagggtggcgcccaaggtcccaggccacctgccccatgcccgtcagttccagctgtgcccccygactcaggccatacacttagagagccgctcctcccagcagcctggggagatyccgtcgggagcaggagaagcgtgggggtgtcacgctagagtctgtctctccacctcccaccagcccccacctcagtggtcacacagacaggccgagagggatgtgagcgtggtgagatgctcacgtgttcttcttccgtgcttttggtgtttaggctgccctgatctctgaaaaacctgcccttctgtgagggtcatgtgatcgggcccctctgcttgcccctttgagattgattctgttttactttcttttttattttcatttcttttttttttttttttctttttttttgagacagagtctctctctgttgcccaggctggagtgcagtagcgcgatctcagcttactgcaagctccgcctcccgggttcatgccattctcctgcctcagcctccctagtagctgggactacaggcacccaccagcacgcccggctaattttttctatttttagtagagacgggatttcactgtgttagccaggatggtctcgttctcctgacgtcgtgatccgcccgcctcggcttcccaaaatgctgggattacaggtgtgagccaccgtgcccggcctattttttttattttttgagacagagtcttactctgtccaccctagctggagtgcaatggcatggtctcggcttactgcaacctccgcctcctgggttcaaatgattctcctgccccagcctcctgagtagctgggactacaggcgtgtgccaccacacccagctaatttttttgtttttttagtagagacagtgtttcactatgatggccaggctggtctcgaactcctgaccttgtgatccacctgcctcggcctcccaaagtgctgggattacaggcgtgagccactgagccaggctaattttttgtatttttagtagagatggggtttcaccgtgttagccaggatggtctcgatctcctgacctcgtgatccgcccgcctcggcctcccaaagtgctgagattacaggcatgagccaccatgcctggctgtattttcctcatttcttaataggtccacattattttagccagttgtttccatattgctgattttgtagtgttgatagctagggtttttttcttacacttaaaagaattttgtaaataatacgtgttatttgtagaaacattagaaatataaacaagaagaaaataaaatgggctgtaaacccccaccaccaaagaaagctaaccacacttatgttggtgtatagctaggaggctgtggaaaatgcacacatgctttctctatgtaagtgggtatggaattgaatatggctgttagtgagtagagtaggtacatgtgtacatgcttttaatgtaagccattcacattcttgtcactggaaggccgaagacccaccgtgtgtagggcacgttgagtgcaggttctcccggctattctgagttgggggttgtctgcaccctccgctacaggcctctctggagggcttccttggcctctggctgccctgagtgaggaggtgtggttgttgcaggcctgcaggctatgccccaggggtctttccctggccggccctgacagctttcctccaggccttggtgctgcctgcctctgcctgggctgctctctggtctgtgttctggggattgaactttctaacttaaagctgctggggattggactgttgcattctggggactggacttttctaacctaaagctgctgtctagccaggtcagcacaggcctgtgcgttcttaccttctcacccttcaggtatacagtttgaggtgaggcgggtggagctccagggccccacacctctgttctgctgctggctggtgaaagacctcctccacagccaacrcgactcagcygccaggacccgcctgttccttgccagcctgcccggctccacccactctaccgctgctgagctcaccggacccagcctggtggaagtgggtatttgcartcaatgcctgccctggacttgccttgtactgtgtggcaaatatcctagttggcatctctctctgtttccttggggacgggaatacagtctgtttgtagctttttttttttttttctgggacggagtcttgctcttgttccccaggctggagtgcaatggtgctttctcagctcactgcaacctctgcttcccgggttcaagtgattcgcccgcctcagcctcccgagtagtggggattacaggcacgcgccaccacgcctggctaattttgtatttttagtagagactgggtttctccatgttggcaaggctggtattgaacctcctgacctcaggcgatccacctgcctcagcctcccaaagtgctgggattataggcgtgagccattgcgcctggccctctttgtaacttttcacactgtcttttaatatccagtgtgactatgaagccactttaggtcgggcatggtggctcaagcctgtaatcccagcactttgggaggccaaggcgggtggatcacgaggtcaggagatcaagaccatcctggctaacacagtgaaaccccatctctactaaaaaaaatacaaaaatttagccgggcatagtggtgggcgcctgtagtcccagctactcgggaggctgaggcaggagaatggcgtgaacctgggaggcggagcttgcagtgagccgagattgcgccactgcactccagcctgggcgacagagccagactccgtctaaaaaaaaaaaaaaaaaaaagaagccactttaaatctgcctaggcccatgtatatggtggggtgtaaacacgtttcgacatgtgtgccagttgggatcagtgtgctgaggctgcttggggtgccctgtggagataggctttcagacctgtctgagagcatgrgaggagaggggactggagtgcagggcacacctgcctckggcggctgctgaagacgcagggggaccactgtgggtgctgcacctctgcccggtgcagttgcatgtgaccccacagaccttcttctgcattgcaggtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaargaaaaaaacaaggaggtaacctggctgtsggsggggagtggcgcygggcaccacttcacatggctctcgacttttggtcccagttctcaaacctggggtttttggaggagtcctctaggtatggcaccaagcacacaacctggcatgtgggcggtttccggattcaaagaggctctcccagcagcacacacgttgacatccagggttgctgatcccgtccaattgtagattcagacctcgaacaggccaggctcagggcttcgcctcctgccattgtgttgagatcccacatctggacctgtgttccctcctttctgagcctggggcttgcaccattctcctactccccactgagatgctcatatctcacgggcactgcacatgcatgctgaaaacatgcttaatcttttcaaataacctgctttgggtttcattaatttttcttatttataatctattttcaatcttgtgacttttctcttattataaaaaatttttttcattattttttcttactttggatttaattttattttcttcttctattttcctaaggtggtatcttagatcatttatttgagctatgcttttttctaatataatcatttaatgttttaatttttctccaaccccagctttatctgtgtatcacatattttcatatgttgtgctttcacattcattcatttacaaatacgttgttactttgtgttatttagaagtgtgttgtttaattgccaattatttggtgattgttcagatatctttttgtttttaatttctttatagagaacatactttgtataatgtcagtttctttaaatttgttgatgctygtattatgttttgaagtctctacctatacttgtggatttgcttgtttccctttgtaatcctcccagattttacttcatatatttggaagctctgttgttataggaatacccatttagtatcatagcatcttcttgatgaactaattcctaatttgatatgccttgttctgaagtctactttgatattagtatgactactccagctttcatttgatttgtgttcacatagtaaacttttctcattcttttacttttagtcatttatgtctatatttaaaatggtcttctgtaggcagcatacacttggatcttgcttttgaaattcagtctgaaagtctctaattgaggtgtttataccgttgatgtttaatgaaattactgatatggctggatttaaatctataatctaaatctagatgttttctattgtttctggatatttcygtgctttgttattttcccctctatttttcctactttctgttgactatattttattatgtcatgtttttgtttcttgttagyttttaatatttcatcatgatttttggcatcggtattgagatatagttcacataccatataattcacccatttagagtgaacagttcagtagattttagtatatacagaattgtgcaaccatcaccacaaacgaagaacatttcatgacctcagaaagaaacctcatacccatcagtagtcagtcgcataacccccgtcctgctcgaatttcctccatcccatcctgggcaaccacaaatctactttctgtctcaatagatttgcctattctggacacttcatataaatggaatcatgcacagcatgctcttttgtcactggattctttcatctaacataatgttttcaaggttcatccatattgcagcatgtataagtacttcattcttttttatgaccgagtaatattccattatatgaacagacaccatattttgtttatccgtttatcagctgatggacatttgtgttgtttccattttttggccattaggaataatgcttctatgaacaattgtatataagatttgtgtgaacatatgttttcagttctaggcatatacctagtagtgcacttcatgggtcatgtcgtaactctgtgtctaatgttttgaggaactgctgaacagttttctaaaaaggttatactgtttttacattcccatcagcagtgtacaagggttcctggtctacatatccttgtcaacacttattattgtcttttcatttctagccattctagggggtgtgaaggggtagctcactgtggttatgatttgcatttccctgatgactaatgatgtcaagtgtcttttcatgatcttattggctgtttgtaaatcttctttggagaaatgtctgttctgatcctttgcccattttttttttcttttgagacagagtcttgctttgtcgcccaggctggagtgcagtggcacaatcttggctcactgcaacctccacctcccaggttcaagcgattctcctgccttagcctcctgagtagctgggatcacaggtgcacaccaccaggcccagctgatttttgtatttttagtagagatggggttgcaccatgttggccaggctggtctcgaactcctgacctcaggttatctacccgccttagcctcccaaagtgctaggattacaggtgtgagccactgtgcctggccctgcccctttgcctacttttaaattgggttgtctttttattattaaattgtatgagttctgtattttagatacaatttcttgatcagatatatgatttgcaaatattttctccattaaatgtgttgtcttttcactttcttgatgtttcatttgaagcacattttattttattttattaattttattatttattttctcacattgattgtactttatggatggtttataggaggtaaggactttctgcttaaaatatttaaaatttacatgtgtacacaaacatacacatgttcccccacccgtggggaaggacaagatgactctgaatagaggatggaggaggaggagagggtgtagacagagggcccttgactcctacaggggcagcaggataaggaacagagtggggcagaaggtgggttattaagaagcatcttgcaggccgggcgcggtggctcatgcctgtaatcccagcactttgggaggccaaggcaggtggatcacgaggtcaggagatcgagaccatcctggctaacacggtgaaaccctgtctctactaaaaatacaaaaaaattagccgggcgtggtggcgggcacctgtagttccagctactcaggaggctgaggcaggagaatggcatgaacccgggaggcggagcttgcagtgagccgagattgcgccactgcactccagcctgggcgacagagcaagactcttgtctccaaaaaaaaaaaaaaaaagaagcatcttgcttactgacatgaagccacatgcccagcgagagcatggatgaggcctcattggtgtagaggaggcccttggagggtgggcacatgatgcccaactagccagccaaggccaacgtcccaggggtagggcggaagtggggtggygtgcacagggcacgcagcccaggcctctgctgtccccacctccctccccaccctccgaragaaaagacagtttgggcctcagccatggacsgacgccgttactggcagcgtctccttaaactacagagatacaatgtgtatcaacagggtgatcgcttctgacccactcaggcagacacctagaggtgctgcatgggccagaaccagtcctatggtatctttggtttgtgggcttccctcccgacttgaatcctccctctgtccagcctctggggtggrcctcagggctgggaacgggctgctcgatggcgcaaggcccagcctgacagcccttggaggctgggggtgctgcccttgccagccacgggcagcttactcactggggtgctgggacttgtatgagaagatctcggcagccagctgctgcgggtccaggagctgcgggaagtgccccatcatggcctccaccgggtgcggggtgtgtacaccacacagcttggtgtacacgctggcctgttccttggccaggctgtctgccctgcgccgtgggcccctgccagcccctgggctttgcactggggrctcctgaagactgggaagcagaaacattttaaatggatgacgtttagttggtctcttttaccgtttgtcacttgtgttttggtgttatatctaggaagactctgccaagcccaaggtcataaagatttactcccatgttttctctaagagtcttatggttttagattttacatgtaagtctttgatctatttttgaagttaatttttgtgygtggtgtgagactggggttgracttcaccctttcgtatgtggatatctagttgtactagcactgcttgttgaagactgtcctctccccattgagtggtttttggcacccttgtcaaaaatcagttgaccatagatgcrtggatttgtttctggactctgaattctattccattgatctatagtctgtctttctatcttaagtgtgtccttaagccagtaccacactgtcttgattactgtagctctgtagtaagttatgaaactggaaaatgctagtccttcaactttgtgttttttttttttccaagcttgttttggctattttgagattgttttggccatttttcactttcttaaggattttaggatgagcttgtcagttttgcaaaaaagccagctgagattctcataggaatcacattgaatctgtagctcactttggagagtattgtcatcttaacaatatttagtctcctgatctgtgaacgtggaaagttttctattcatttagatctttaatttctttcggtagtgttttgtaatttcagtgtacaagtcttgttgttcttttgttaagtctccattatttttatgtccagtttcttcttttttccaggtttatttttcatttgctagaatatattcgttgccagtttttccaggaaggattcatgggtactatacattcagtccttgtatgtattaaagtgtgtttatttttctctcatattttagtgatgatatgcctttctcctctcagaactttttagacctgtatctgktgtaatctagcattattttgaagtgaattttgctgacagcaaaacgtgatttatttttctttctagatgtaaaatctttgtctttcaaagttttcaccaggatgtctttaggggtttatgtttgtgtgtgttttctttattcttgcttgatacttggtaagactttgatctgaatatttaaagcttccgttctttggttccgttaattstttccttctccctcctcctgacrctcattttaggtgtgcatgggcccccctggaggagcctgccctcttgtctccttggccctgcagctggacaggccgcaggcctcttcacctagagtgtcagggctcccgccctcccggaggcttctggagctctgccacatctcagcaggcccttcttttgctcctcaggaccacagcctgcttcccctcgtcttcttgctttccctcagtctcacttctggccttttgggccatagtgaccctcccgtcaaagggtcttcagaatttgtctcctttcacctctcacaggctggcacccaagttgcccccttctctcctgatgacggtgagagrcctggatgttgcccaggctccgatgattcttcctgctcccgccctggccccgatgccctcccgatgcccacttacgttgcctgcccagccccccgcctccctcacacctcctcacagctcaggtgcgctctgccacagtcctgtgctcccgctgccctctgcctggagggccttccccgaggcgctcagaagctgccttccygggactcactccctatcccatgcacctcgcaggggctgcacccccgcggcacttcctgccccatctttttttccttcttggcactcatcgttccttggtgcgtgatctcactcagcatctyttcctgacacctgaacaggcccatcctgtggttggcaccygctgggttgcccrtcgctccttcagctgcgtgccgacacccacgtagcagcaggygttgtgttgggcgaccagattttcagcracttgcagtgttctttcttttgtgaatggtatctttttctgttacactttgactatcattgactgtggtagcactgtttttcttatatttaccttatgtctgtcagtcttgctaaastctgattaatctcagagtcaatgttgaaaacatgtctaagagtgatagcttttctttgtattttctagttttctggcttcttcgtttattctcttggccagggctttcyagtccttggttgagaagtcggggtgacgtggatgttctccggggcacatgccctgaggcctctggggccctctctccagcccaggttatggctccctcagctccacctggattctccatctcacccatctgtccaccttacagaatgggcastaatgacgctgcatttctggtcagctgctgacccccttctgtgcttccttgtgctgcaggcgtttatcactttgtttcttctttcatgtccgtgggacttaggggaggtaaatgcaggggatgtgtctgccgcatggaccaatggtggccctggygtaatgggatgcytgaggactgggtggccctggtgkaatgggatgcttgaggaytgggtgkccctggtgtaatgggatgcttgaggaytgggtgkccctggtgtaatgggatgctggaggactgggtgtctctggtgtaatgggatgcttgaggactgggtggccctggcgtaatgggatgcttgaggaccgatggtggcccctggtgtaaygggatgcttgaggaccaggtggccccggcgtaatgggatgcttgaggactgatggtggcccctggtgtaacgggatgcttgaggaccgagtggcccctggcgtaacgggatgcttggggaccgggtggccccggcgtaatgggatgcttgaggactgggtggcccctggtgtaacgggatgcttggggaccgggtggccctggcgtaatgggatgcttgaggaccggtggcccctggtgtaacgggatgcttggggaccgggtggccccggtgtaatgggatgcttgaggacygggtggccctggtgtaatgggatgcttgaggaccgggtgtccctggtgtaatgggatgcttgaggactgggtgtccctggtgtaatgggatgcttggggaccgggtggccctggtgtaatgggatgcttggggaccaggtggccctggtgtaatgggatgcttgaggaccgggtggccctggtgtaatgggatgcttgaggactgggtggccctggtgcaatgggatgcttgaggactggctccagctatttccactacgctctgtcttcctcacaggtggtggtgaagtttattaagaaggagaaggtcttggaggattgttggattgaggatcccaaacttgggaaagttactttagagatcgcaattctatccagggtggagcaygccaatatcatcaaggtgatggtttcctcttcagagataccctaacttggctcatgtcaaatgtcttcaatttkttgacttgaagatgttttggtagagttggacttggctttgtctcttcctaggtattggatatatttgaaaaccaagggttcttccagcttgtgatggagaagcacggctcyggcctagacctcttcgctttcatcgaccgccaccccaggctggatgagcccctggcgagctacatcttccgacaagtgagagcaggccagagccgtgttagtgtgaacgcaggcctgggtgcctgggtcyggtggctgcaaagatcagtgatccatactcggttctctctctgagctggatctagccttctgtgtggggatttcatggagtaggatatatattttgagaagaaaattctatgattgaagtagagaaagtgaggttgggaaggaaggatgaggccagatacagtcctggaatgactgagaaagtatgtttaatggttaaggtttatttacatacataaaatatccacaacaatcataaaaattaaccagtaagggttaggrtgcagccagagagygtctcaaaggcatgtgtgcggcacagcggcctgcaggttgtaagtgcccactaaatggtggctgttgaggtaattaaccagcaaaactgagatcctgacattctcacttttcagtaagtatttgtcttgatctgtttcgtgtctaattacatattgaacttcggccattattttattggaatgggagagtgatgatccaaataggaaggcaccctagcagagggacagggggaagaaacggtaactcgtgttgggttttaaggagagggtggcggttccatcctgtactgctcccagctcccccagaagaactggagaaataccagcaaagggctgtgtagacaactcacatttgctcttggattgtttgctggggacaactcgatttctaatgacagcttccgtgaatcaacatttcttccttaaagctacacactctcgggttgttgggtttccgaagtttagtttctcaggctcctacttgtaagtttcagatattatggttctgcaaaaaagggtcacctctctcsctcttcctgtgttggaaggtgacrtcctccctttagtttgtggccaacacttgtttctgaaactttttacagyaaacagagtatctgtatgaggttatgttgagggtcgcttgttaaaagctgctgcctgacagctgttaattctggggctagtgagacacataattatggtgtttatactctaaaatttttgccaaaagaatctctaccccttttgtaaatatatagacataaatgttattctatgtaaatacagatgcacaattttataaagtatatgatcgcacatcaatgtatgtaggaatcatgctggttctcagggcattgcctgtcagctccagattcatcaggacytgctcagcagcggggtcggggagctgggcctgggaacagccctggcttggttcaggccgctccagggcagcatggccrgtccagggcacagaagcatctgcaggaagagcagctttcttcaagtcgctctttagccctttgtggttaatctctcagtactagttaataaatcttaatgaaactttccatgttcaagttcatgtgtgatttctgtctcctgattggatcctgactgatttgtatatatctacatatatatgtaagtatgtatgcatgcatgcttgtatatgtgtatttatgtgtgtacctatgtacaagtatatgttatgtgtataggtatgcacacgtgtgtrtgcaggtgtgtatatatgtgcacatgtatgtatctaaatgtatgtataaatatgcaggtatgtatrtataaatatgcaggtatgtatatataaatatgcaggtatgtatatataaatatgcaggtatgtatatgtttgtatatatgtgtataaatatgcgtatatttattaaatgtaagttaatcgggcttagctaacctgtgattattgctcctgatttgaaagatactcatttgtaaatataaatttgtctcaaaagatcaacatgatacatccatgaartcactaagttgattggtataatgggtgtccaaattatgacagtcagacgtttaattcatcctagttgagctaaactgaaaggccgatgttgctggcctctgttattggagaggcagagtgggcaggcagtggagcactgcagctgcacctccgtgggaacgaagcccgtttccagtgtaactgctttaagtctgcatcattgagtagccacacatttggggaaaggatggctgatacgtcatgctgctctctgagaagccactgaggctgtgctcccagctctgccccaaattgctgcctgaactctgggcaagtcactttccctccctgtgagctgaggttatcgacttggtgctttctcttgggtacttcccacttaacaccaaacctgcacccattcacttgcccaccatgagtgtctttgagctgtggctttgtggcctgtctttcctcctgaaataggcatggtgtgcgttggtgggggcgagtgtctgctgggaagcttttctcagcagcaaacagaactcacgagtctcattgatgttgccaccttgccggctaacgtggccatccccagtgaacacgcctcctgaagggctttgtttcctgtttgcttccaatcatatcttcagcattgaaaaatctttcctgtccccagttcattatgagtcggaggtttattttttctttgkgtttttttttgttccagtttattttaaatgcatattttagttgaattgcttttttaaaaagccccctctggcctcctgattccagctagtgtcagcagtgggatacctgcgcttgaaggacatcatccaccgtgacatcaaggatgagaacatcgtgatcgcygaggacttcacaatcaagctgatagactttggctcggccgcctacttggaaaggggaaaattattttatactttttgtgggaccatcgagtactgtgcaccggaagttctcatggggaatccgtacgtatgcggctgcggtgcggcccgtcctcgtgtcctctgtcaggaccctgagggtggcttgattttgggtgggaaaatggcttcctttgtgcctctttgtgatgagtgttgagtggtcagggtgatatgctggaaagtaagtgggcagkcaggcaaggtcatattgggcaaaggcactgggcgatggatataggagttaataattttattttctcagcttttatttgtttggagtttcatataataaaaagccaagaaaaatattgaagagtccyccaaaatggcactcttcaaataagtgaagaggattctttttagttaggtttatttattttgatgacaggaataatatctatttcaataaaataccgcggggctgaccatacaagaaatcaagcactagagaaagtcccgaggcagaggattcgtgctgaaggtggagcccttggctggaggggctgtcgctgaccagccagactccatgtcactggagtgggccagctgagcctctgctctgctgtggrgagaagcggcgtccttgggtgtgtggctgagtttgcatctctgcagtctggggagcctgtgagtygggggccggcctgggcagggcctcctctcgggggactttagagaggaaagcaaaacggaaaggaagattgtkgttcatttgtagggcctgagtggagactgtctgctgacgtgcccgatcactgtctcatctgcctgtaaaccaaatgtgtctrtgtgtatgaaatagactttattaagtcagaaayagatarcaggtgttttccactaacacctacatgtattttagagaggtgtggttggaatgcatctctaggtgagttcatggttagagagtcggatgatcacagcactgcttggacyctcctggcccycygctgcagygctctgctgcaccgcccatatctgctccatgtggttctctaggagggaagctgatgctgcccccacagragaggcacacggggtccctcacagacctgctgcacctgacctggyggcctgaggccagggcatttgctcgcagtcacgcrcgagctccatgccgtgycttgggctctcgggagggcctcagcatyggggagaggagtggctgggcyctggatcctggtgtctgcttaggccatatttcattaggaggtgcaggttccaggctgcacaccctgagtcctcagagcccagcagcctcagcctgcgccaacctctccatgccaggcagcgttgagctcttctgggcctggatgccctgtgtgcagagtatggaggaagtgaaaatgggctcttccccgctagaacctccatgcatcttcagagccaccaaacagcgtgaaatatcgaagggggttggtctaagaagggccgtggagtttcccttcagatctagtttggttgccctagagcctggtgggcgctggtgggctctgcctgccctgcagtggttgtcgtgccctccgtgctggagggaactgcctgtcccctgtccactgacccatgatgcctgctgcatggcttgtcaccccttcctgtacccaggccgtgaagcttggggagggtgcaggggggatccaacctgggcgagagctcagtgctgcttggccaccttggccctgcctcccagagctgtggctcccaccctctccctgagcgcctgccctgccagggctctgccctgcctcctggcctctcctttctggctgtgagcggtgtrctgctcctgggcctrcggggctgcaggcctcctctcaggagctccttcctccctcctgcgtcctctccccatctccctggatgaaagggtttctgagttcttattctcaatcccatcctcagggccctggcttctgtcttgtcatcttcatctccgtctactccagggtcggcagactgtggccttaggtccctcttccccttcctcaggccctggcagctgccattctgctattttctctatgaatctgactactctagggacctcctatacgtggaatcgtacagcatttgccttttggtgactggcttatttcactttgcataaagtcctcaaggtccatccatgttgtggcctgtgccagcatcttccttttcaaggctgaatttgattgcgttttctggatatgctgtacttattcatctgtcagtggacatttgtgttgcttctaccttttgcttccatctttatgttgttcgtgatgctgctacaaacgtgtgtgcaaacatcccctgcctcttgtttctataaataaagttttattggaatggagctgtgctcatttgcttatgtgtcgtctgtagctgcctttgtcctacatgacagagttgagttgcagtggggaccatgtggcccaaaacctgaaatatttactatttgacccttcacaggaaaagtttgccaacctctgttctgttctattggatatttctcttcagcttctaaacatcttgaaatctctctaaaaaacagaaacaacacaaaaacaaaaactgctgaaactgattttcttgctctagcccctacagctctcatccgtccgctcagcttccctgcggtctgtgctagccaccccaccaccctgctgactcagcctgggggcccgactttcacccacgctgctgctctggcctctgtgatctgccctcttgagccctcccctcccctcccctcccctccctcccagcccctcttctccgagtccagcccggggctctgtccgtgccactcttctcactgctgtggtttctcttggctcccttgtctaattctggttctgagaacaggctgctgcttcccagacctcttctggggacagacccccagctgcggacctggagacgcatggccttggccagtgcaggggcagggctgtgggtgctggtgacctggctctggtgcgtgcttggcagcaacttcacctcaccaagccttgctcttctgtgcaaaatgaaagtcatatttatcttgctaggttgttgtgaggatttgggttaagccatgtaaaatgctggtacagcrttggcatctctaggtacccaatagatggtagcrtggatgaggatgtttacggtgacaggaaataaatggtagcatggatraggatgtttacggtgacaggaaataaatggtagcgtggatgaggatgtttacggygacaggaaataaatggtagcgtggatraggatgtttacggtgacaggaaataaatggtagcrtggatgaggatgtttacggtgacaggaaataaatggtagcgtggatgaggatgtttacggcgacaggaagtaacaatagtcctttgggtgtcttctccctgaagcttgctcctccatttggcccactgtgtgaacacccaccttcaccacgtccttcttgtttgctttcatccttcggtgtttttccctgttcagtctcgtcctgcagcacccttcacatcgtcgccacagccatcttcctaaagggcatgtgtgtccatggtcacaccaagcccgttcacaccaagatcgtgaacatgcctgatcacgtctgaagggcacgtgaccctgttctgaagtggcctgcagctcccgtggccctcagcaaagccaatggacgtgtactctgcttcctccaggaagccctccccccgctcccccctctggtagacacgtcttgtggttggtgtccacaaggaagttcctgattagcctcggagctgcccgatggcctctccactcctggcacatggcctgctggctggcctggggcagaagtgcgtggaaatggagggcgtgtttgaggggtggagtgaccctcctcttgggaaaccactgcctggcctgtgtgctggtcgggaagggccatggtgcttcccatgggcgggcttggcaagcctgcgctgagygccgtggcgtcctgatgcctcctcctcctcayagctacagagggccggagctggagatgtggtctctgggagtcactctgtacacgctggtctttgaggagaaccccttctgtgagctggaggagaccrtggaggctgccatacacccgccatacctggtgtccaaaggtgagcgtgagctgcaagtggtagacagtcgacactgtccttagagaccagmcacttttttttcccatttcctcattcctcagtgtatctctgtccatatcaacagtctcatttgtttcttttctattcatcaaataatttgcatatgactttaaaacatcttgataatttagtttttgttaatgttcctctttggatcttagaggccctcttgtgagaaacacacttgcagtcaggacagggaggctccaagtggccctgttgacttggtgcctacatggttaaaggaactggggcccgaatccagatgcaaggctgggggcttctctcagcttgtgctggcatcccctcacctgtcatgttaaccctgcgttattcacagctctgcattgccagagcccctgagaatagagcagttaggaacctctgcaccacctggattttggttgagtgggatggcatcttgaactccaagctttcatttcagaggcaatgaatgtttcctgcagcttctgtccaagcacagctgggccctgcactagaggttcctgggccgccacctgcycagtcagaggctctgcgggggggtggtgagcacccaggaatctsagatgtgctccacttcatcccaatctggacctaccatctgtgttctttgtgtccccagaactcatgagccttgtgtctgggctgctgcagccagtccctgagagacgcaccaccttggagaagctggtgacagacccgtgggtaacacagcctgtgaatcttgctgactatacatgggaagaggtgtktcgagtaaacaagccaggtgaggcttctcagcatccctccaccccacrtgacttcacttggaataacgaggtccccaggctgccttcctaggtcaaaaggaggaaaaggaggctctctcccccatgctgtcttggacacaaatgtcagggcctatagctgacctgtcacctgtgagagggggtttgattctgtcccgaggcctctggacaccactggggttcagggtgtggctttggaccttggagggtgggcaggtgtcatgggagctcctggcagaaggggtcggaaccctcaaagatggtttgaggaatgcagctggtgatggtctgactgggccgaaggggaggatgaggccacagatgctgagagtgattctctagcagccggcggggccgagggctcttcagacaaggctctggccacagagccaaaaccactgctcagagcatttggaccaagctgcggttgatggccctgggcttagatccccaccttggcaggatctgtacttccgggacattgccagttggatttctgagggcctcaccttaggcttttgttctaggacttcttcaagtgagaagcaaagtattttagaaccttaagttgttagcacgtgatacagttaccttyttgtttcttcagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcmaatggccagactatttcattaatttatttcctcaaatgcttttcaaattaaagcacctttgttagtaaacagttatcctgacttggatgttgtgaactgttcccgtgtgctaagtgtgagaaatacctggtttcctcatttttccatgtgtgcaccccacttgccacagttggagagaagtctagccttggccattctggggttccttttacaagcaggccctgccaggggtgggcctagggctctgaagcttgctccatctggtaagacgggggagggtggcttcctcagggacctcccttctgtctgtagcaagactctgctgtcaaacacgtggctggctcactgccagcagtccccaaatatcccatggccagccagctcccacctctgtccacatgaggggcttcctggcccagcccccacctctggtctgtgtgaggggctccagccctgtattcctccgagctgctcaggttccagggtgtttgtcagatactcaactggctgcttccctcccttagactccagtccatccccctcagacagacttggctaggtcaagtacttaggattgttttatttcatgtctgtgttagagaggagggaatagctagaggtgagagcagaacctttcatttttttcccctgctgagacagtaggaaaaaaaccaaaaacctaaacccctacccttttcccacatgtcatcacttgcagacggtttttccacattctgagactcctgcccagaaccctctggaagctgcctgggagccaggctgcctcctgcgtggttctgagctatttctagtggttatttaggaggcactcaactgttttgggatgatcagagttaattttagtcccatctagtaggatatgggctattgccatccctttcttcagaaagtgctgcctgagcctcgctgccaccacaagtgactgatggagttggtgggggaggaccctcctctatcagggacattcaaggtacaagggttttacaggtgtgtattaaagtcagtgatgttcactcttcagaattcaaagagttttctgatgttttaagaacccctaccttgtagtgtttatggtgcttataacacagaggatgttatagaatggtgtttgtttgtttgtttatttatttagagacagagtcttatactgtcgcctgggctggagtgcaatggtgcgatctcagctcactgcaacctccgcctcccaggttcaagcaattctgcctcagcctcccaagtagctgggattacaggtgcccaccaccacgcctggctaaatttttgtatttttagtagagacgaggtttcactatgttggccaggctggtctcaaactcctgacctcatgatccgcccgcctcggcctcccaaaatgttgggattacaggcatgagccactgcgttcggccacaatggtgtttgcagacaggtgtttaatgggttgagaatgcatagtctgagctttctaagaactgttacttctttataagaaaaaataattaaagctcatctgacttcatggcagtggaaggtctggtattttgcaaacgttctttgcagaaagaacccagagaggaaagttctgaggctgaggctgacaatttttccactccatttttttttttttttttaagatggaatcttgctctgtcacccaggctggagtgcaatggtgcaatctcggctcactgcaacctccgttccctgggttcaagcaattctcctgcctcagcctcccgagtagctgggattacaagtgtgcgttatcacgttacctggctaatttttgtatttttagtagaggcagggtttcactatattggccaggctggtctcgaactcctgacctcaggtgatccacccatctcagcctctcaaagtgctgggattacaagcatgagccaccgtgcccaacccactgcatatttttaaagtatggttcgagagagcaaagttttcacacaagactgaaggtgatgtcaaattttttttttttttttttgagaagtactttcgcttttgttgcccaggctgcagtacaatggcgtgatcttggctcactgcaacctccgcctcccaggttcaagtgattctcctgcctcagcctcctgagtagctgacactacaggtgcccaccaccatgcctggctaatttttgtatttttagtagagatggggtttcaccatgttttccaggctggtctcaaacccctgacctcaggtgatctgcccacctcggcctcccaaagtgctgggattacaggcgtgagccaccacacccgggctcatgtcaatttttcatagtaatccccatgtcccagctgtcattttatttctagagctagacaaactgttcaggttccttgattctttccagggagttggggtggctcatgggattttcttaggcttttggtgtagcattaacacaatttattgtgagatgttgacagttgagtattttgagaagaaaattacattataaaaaacaacaaaggcaaccaattttttttttccttttgttttttgagacaaggtcttgctctgttacgcaggctggagtgcagtggtgcaatcatggctcactgcagcctcaacctcctggactcaagtgatcctcccacttcaggctcctgagtagctgggactacaggtgcacgccactactcccggctaattttttattttttgtagagacaggattttcctatgttgctcaggttggtcttgaactcctgagcccaggcaatcccccccacctcagcctctcacagtgctgggattacaggcgtgggccactgcactctgccaaagcaaccaattctttagttctacacggattagaaccttccttttctttgacataatccttttgtcaaaagacagttttacataaattgtttggcaccccactccatgcctggcgcaaagcagatatgtaaatgtgtgcccatgcaagaatcaaatcctttatgtcagtccagaatgaagtagataaaacaagaaatgcttataaattaaggctttggtggcaggatttaggcagctgagaaagcacacctttttattcttcacaagcatcaccttgtgaaagatgcctacgctcttaggtcgagagaggaaatttaagaatgaatacacattgggctaaaactttactatatttcatcctaagagggaaccagacctcgaagttgggaaggctcttgcttataaagggaaatgtgccgtaattcctgtcattttacttgggtcttttaaaaacggcaaattctcatcttccactggctgagagtaaaaagaaagaaaagcggtaaagacttctttttgtgcgtaggtggccccggtgttcacgctgaatacagatttttacacaataaaatcttaaatatctctacatggaacggaatccatttttcctgcctcgggaaggatttctgcgctctcgggtgaagttcccgaagcaaggaaccagttcccctctacctgtactcttgagaggaattctcaggtcatctgaaacacaagtatgggccaggacgacccattcgttcacgcggcccagagctctgcgaaacgggacacggcagtgcaacgggaacaaccggacaccgaggcccccgaaggctgaggccgcggcagaggcggcggcacggtgacgggcgcgactccggccttccggctttctaaggggcggccccgggacacctgagccccgcggggccgtgaacgctcagcacagctccgggccggaatcacgatccaccacaccgcgctggcgctgggaacggcgtcggtgacggaccgggggccggaagtgaaggacgggggaggaccgctgcttccggcgccgtaactgctgccatcttctccgcgctatggctgcgttcggccgtcaggtaagctcgagctgggcgcgcgggcttctccgggtcgcaggcgggcgggcagcgacgcagaggaaccgcggccgccgagtgtttcacggccaggtcgtggagccctcccggaggtccgtgcacgctgacctggttttggcatcctggacccgtggctctgctcaattattgtgggatatagagttgacatttttttttttttgagacaaagtctcgctctgtctccaggctggagtgcaatggcgcgatctcggctcactgcaacctccgcctcccgggttcaagcaattctactgcttcagcctcccaagtagctgggattacaggcgcccgccaccatgcctggctaatttttgtatttttagtagagacggggtttcaccgtgttggccagtctggtctgtaacttctggcctcaggtgatccacccgcctcgaactcccaaagtgctgggattacaggcgtgagccaccgcgcccggcctgagttgactgttgaacaagagtttgaacttcacaaggaagataacatgtacttttcattaagaggaagcggaatcagcatagaggtctttaggcttgagcccagttccacgggccgcgcccgctgaccccagcgactgccaggtgttcctggcggagggagcatctggacaggggaggctggagagcagccagagcttgggcttggcagggtggccccagggcgacaatcgatgacgctggagaaggggttgggaccgatgtgaaggttttagagcaggggttccccaacccccggtaccgtcccttgcctattaggaaccaggctgcacagcaggaggtgagcggcaagtgagccagccagactgtatttacagccgctcccttcgctggcattaccgcctgagctccgcctcctgtcagaccagccgccttagattctcactggagcgcgaaccctattgtgaactgcgcctttgaggggtccaggttgcgctccttatgagaatctgatgcccgatgatctgtcactgtttcccatcaaccccagatggcacctcctggttgtaggaaaacaagctcagggctcccagtgattctacattatggtgagttgtataattatttcatcttatattacaacgtgaaaataacagaaataaagtgcacaacaaatgtaatatgcttgaatcatcctgaaacccctcaccagtctgtggaaaaattgtcttccatgaagccagtccctggtgccaaaaacgttgaagactgctggcttagagtgcctggatgatttgtgcatagtttgttaagcaccagcctgaaccactgaagacttttgaggtcaactggaattgtgtatgcaagttgactaattactgtgacccttgaacaacacaggggttaggggcaccagaccgcccccacaccagttgaaaatcagtgtataacgtttgactcctccaaaactcaactactaatagcctactcatgactggaagccttaccgacaacataaacagttaacacatatcttgtatatatatatattgcattctgtattcttaaagtaagctagagaaaagaaaacgttattcagaaaatcataagggcaaaaccccgtctctacaaaaaatacaaaaattagcagggtgtagtgtgcacctgtagtcccagctactcagaaggctgaggtgggaggattacctcagcctggggaagtcaaggctgcagtgagccatgattgcaccactgcactccagcctgggcaacagagtgagacccccgtctcaaaaaacaaaaagaaaatcctaagagaaaatgtatttactattcattaagaggaagtagatcctcataaggtctttaggctgaagaggaggtgaaggagagtttggtcttggtgtctcaagggtggcagaggcggaagaaaatccacatataagtggatccaagcagttcaaacccttgttgttcaagggccaactctgtatcccacaagattcttctcgtggaatgaatttaagaacatgaatctggaaagtagtctgaggtccagacttttctggcacacatgaccaggtggcctagaaatagtttttccctcttcctccatgtccctgctcccatccttaaagctgcaaaagctaacaatattgtacctgcttgac

SEQ ID NO: 12576 - DNA, 49186 bp, Homo sapiens
  misc_feature (1)...(49186): n = A,T,C or G, or insertion/deletion polymorphism (see Tables 1-2)
tcttttcttttcctttctttttttttgagatggcgtctcgctctgtcgcccaggccggagtgcggtggcgtgatctcagctcactgcaacctctacctcctgggttcaagcaattcttccgcctcagcctcccaagtagctgggactataggtgcgtgccaccatgcccagctaatttttgtatttttagtagagacggggtttcaccgtattggccaggctggtctcgaactcctgaccttgtgagctgcccgcctcggcctcccaaagtgctgggattacagacgtgagccaccatgcccggccatatttttgtttttttttttttaaagagacagggtttaaccatgttgcccaggctgatctcaaattcctgagctcaagtgatcctcccatctcagcctcccaaagtgctggggttacaggcttggaccactatgcccggccaatcctttatctttcctgcttcctttttatttctggactaatcactatccctggaccctgctctggggcagattctcacctttagcctccatgaggaggtcagttctcctactccttctggtctcagggagaccccaggtctcgcccacaccaacccagggacccagaagggcagggcggggcagggctctcaccacaggctttcccagctgagtccagcaacacactctgcacagtggcctttgtgaggacagcgcccccagcccgctgaatcacagggatggtgtggaaggcaatttcactggaaccccctcggggataaaagcctcctttcatgtagtggttgaccagcagggcgtgcatggaaaaggcactgtggttgggggtgacacctgcagaagcaaggaagggtggtgagctggcaagagaaggcaccagcaccattcagaaaggaacgtggaattctgtgagataacacacagcccagtctatccgaggaaccacatgttcctcagggtccaaggcagccagaggagcctttccatctagacatggggtaccttagagatcttggcgccagtaggaataccccccctgcaaactgccatgctgccaagaccaaggaggatagtgttgcttgaattgaaaaatcatccaaggcatggatgaacagaattttgaccaaggagtccagcaggtggccagacttctcatccacaagctccagagggcctggggtttacactgctccatatcagtcagccaggcagggtcgagaagaaagattgagagatgagagggcagccgttcctcctccagaagctgcccagagcccaggcccagtacccaccgtaagtggggaagatgtagctgagtactgcctggagctcagaggaggcccccagctgctgcaggacctcagccaggctctgggtggatgcttgaaggaatggagagaaacgagtcagcagcccacacctgtcgaggagctgaaccacgggcaatgggaggaatttcaacaggatggcatgaggggctccactggataccacctgggggagtgaatgaggacagcaggcctcacctctagaaccgctttgacagaactgctatccccatagcctggaccagcccaagaatccagcaacacttacccctgactgaactttgctgaatttgaatatttttaaaaaatctatactctgtgaatttttcccatcctacactcggatgagtcctttttttgcttttaattttcctgctcaaattccttttcaaaaatcccaatctggtctcggatgcagtaaaaaggagtagtgatctgatgtcatggaagccagcctagtcagggaggagagcagggcatccccagaggccagggtgacagcagcagccgtggagccaaggctccagagagagagagacagagaactggatggacttgggtggaggctgagctaagaacagatgtgactcttcctcccttcctgcctcccgcactgcactctccacccccagtgcctccactaataataaagaaacccagccttatcgagaacaaactctgggtcctcagcatgtccatgttaccttaaccagctttatatacttgtcaatgatagcttcctcctgtggaaacttctccttgaggccctgaatgtaggctttctctccactgtacatggggtactcctttcggccattgggcccttccagtaccatgatgtcaaaaggagaggacaggggagcccagtccagctgcccttcagtgatctggtccaagataaaacggccaatgctgccctcttccatacgcccaatgtaatggattcctgttgggagatggaaaaacaaggtagtaaagggatatggggattgagccctggaaaggtggctgaggaagtgaggtggaagagtttatctggcctggccaagttcacgcccagagtgagctgctcactctgtctgtagggaggtgtcacagcagaaaccgccagatcgctgcccgattcaactcccagtagctatgctgtcacataagaaaactgcccagaggctgggcacggtggctcacacccataatcccaacactttgggaggcagagggaggtggatcacttgaggtcaggagttcgagaccagcctggacaacatggagaaaccccatctctactaaaatacaaaaaaattagcggggtgtggtggcccacttggtgggattactgagtgtaatcccagccactcgggagactgaggcatgagaatcacgaactcaggaggcagaggttacagtaagctgggatcacaccactgcgctccagcctgggtgatgaagtgagactctgtctgaaacaaacaaagaaaaaaagtacccagagagaagatggcacttccaaaacaacagaaatgctcagtatcaccccacaagggctgctccaagcctcttcaacatacagccatgctcccaacccttttccacacaagccttacctgtgtcaaattcaaggccattctttccaaaggtatgacagcagccccctgccttggtatgttgttccagcaccaggactcgcttgccagctttagctagaattgcagctgcagccaggcccccaaagccactgccaattaccaccacatccagcttctccggcacttggttggctgaaaaagctacagcagaagggccaaagggtgggtttctcaggcaggggcagggaaatagcaaagatagggaaaccaaagaagacttctctagcttgtacagtgcaagaaacctctagagtggtttggcacagaactcttgactaacatgtttcaaacattttacctgggaatactcagaaccagccaggcagatttggggttttgcttatttgttttttgagacaaggtctcactatggcccaggatgaagtgcagtgatgtgatcacagctcactgcagccttgaactcctggcctcaagcaatcctcctgcctctggttcccgagtagctgggactacaggtgcatgccaccatgccgggccattttatttttatttttatttttatgtgtttaattattttttaagacggagtctcactctgtcacccaggctggagtgcagtggcgcaatctccgcttactgcaagctccgcctcctgggttcacatcattctcctgcttcagcctcccgagtagctgggactacaggtgcccaccaccacgcccggctaatttttttttttaatattttttagtagagatggggtttcaccatgttagccaggatggtctcgatctcctgacctcgtgatccgcctgcctcggcctcccaaagtgctgggattacatgcatgagccaccgcgccccgcctattttatgttttatagagccaaagtcttgctatgttgcccaggctgatcttgaactcctggcctcaagtgatccacccacctcggcctcccaaattgctgggattacaggcatgagccaacacaccagcccacaagccgggtttctttggaagatgcagggtctgcaagcaatagtggaatagctgggtcttatggtggctcttccaggtcctgatgaaaaggcttgggcaggacagaactgctcagaggctgcagctctgagaaatcacagcaccagcccctcccatagggaaggtctgggggcagtgctgagggaggcagcaccttctcagaagacaaaactggatagcaagtggtgctatatgggtacttccgacacaagatctgttctttaacaatcactggcaaagaactgagatctgggatgtttcaagatacaagagaacttggcaaactgcttatttttttaatgtttttagagagatcaatagtaaaaaaaaatttcacatgtaagtatataagataaatacatgaaacaagtgtcacaatgcaatacttagtggaactatgtataatgcactctgatattttctattctactgcattctaaaatactagttgtggccaggcgtgatggctcacgcctgtaatcccaacactttgggaggccgaggtgggcggatcgcttgaggccaggagttcgagagccttgacaacatggtgaaaccctgtctctactaaaaatacaaaaattagctgggcatgcccactactcgggaggctgaggcaggataatcacttgaacccaggaggcggaagttgcggtgagcggagatcgcgccactgcactctagcatggacaatagagcgagactctgtttcaataaataaataaataatgccagttgcaactcactaaattgatttcatagcccactaatagatcacaatccggtttgaaaagcagttaagctagtcatctcatttttagaccagcccaggtaggtgctaatggttatgcagcaaattagtgacagagtccaagctaaaactcagttctcagaagtccagatgattagtccttccacttagaacagtactgtctccgattgtgtagcaagatatgacacggagaattctaaaatttacaagtgagagggactccgtagatcaaacaggtgatccattattttttaaagcagcagaactctttaaactctagaagcaaccacaaaatatgttttaaagatgagagtggagagcaggctctgagcctgaggcgccttgttgaacctctgccaatgtttcagaactagggttcaatccttacgatttgggaccatgcaaagcctgttaaatcaccggacgggcaaaacgcaatttcctacgcatttctgtgctgctcccccacacccctgagctcgcatgggagggtaggtgaaaaagttaaggtcctggaaccaagtggaggaatgagtcacggggattatcagttccacgagccacggggattacaagtggcagggcgggtgccaacaccttgcaaaccaaggacaatgaccacacccttgggactactattcccggggcctactagggcaaaggctatcgacagtgttgcacactaaagcggggctcctccacgtgcaaggaagccctcctagtactttacatatggggaaactaaggcccacgtctggtagcggctgccttggcaaaatgagaacccaaatctgtgagaaagcctcgagtgcagccccggaccccagggtccctcctgctaccttgtttgagaaccttcttcctggcctccttgtcagttaccaggggcgctgggggccgtttgacatcttcggagaaaggattcggggagctgccagagaatagtcccaagtaaactttgcagaggacggccagcagcagcacagccaggagcagcaccagcggaagccacatcacgccggcgtcgggtcgggtaaatgggacagctccgactgcgctcagcctctaggactgtggctccgcccgggctagttcgctctccagtcaggaggcggaggcagctttgagcactgattaaccagccagccagcgaagagccaactctcaggtgatgattgaccctcccggctctccgtacttcttttgggtttccattgcctactgggaaatgtagttctcggggccaggggagccggcacggaagcggctgtgcgcatgagcagatgaggcctagccgaggcggcgggacccccaagtttggaaagctctkttaacggtgagaacgcgttaacacttgccaaggggagtggttggtgcctgtgcggagctagcagccggcctgaggagggagggagaatgtgatccggtggaaattatcactatggggcgagacaaggccgagagttgtaagactgaaagagartcccgactgggagacaggagtcctgagttctggtcctggctctgccctggactcgctgccttgaggtgttaaattgctttcctcgtcttacgcctccaggctatgcgaaagttctgtccaaaggctgctcacagcccctgtctgactggttgtcatgatgaattgagctctctgttacctgcgcatcacaaccggtgagcgtctgtctctgtgcccctcaaagtggcccatagttttgtcctgggggcccgcctgggacggagtcctctatggcgggtccctaatgacaccccatccgtggggaacctgggggacggggagccgcccatggacaagcatggtgaaaggatcagctaagggcccatctaatttaaattcctatgcagagaatctaacctccagcaagcagttgaagaatcataccccctccttgcctaaagagggtgcataatgaatacttgattggagaaggatccatttttacaggaaggccgtttccttaggtccaactatcaggaatttgcctttgagtacttccttgtttaatggaattgttgctcttttcttctctgctacagatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggccccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaracaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagaggtaagcatttggctgaggcaagttgttcattcagaataaattcacagctgcttaaattttgtcaacaggccgagcgtgttggctcatgcctgtaatcccagcactttggaaggccgaggcaggcggatcacgaggtcaggagttcaagaccagcctaaccaacatagtgaaaccccatctctactaaaaatacaaaaattagcagggtgtggtggcrcacgcctgtaattccagctactcgggagactgggacaggagaatcgcttgaacccgggaggcggaggttgcagtgagccgagatcgcacggctgcactccagcctgggcaacagggcaagactccaactcaaaaaaaaaaaaaaattgtcaacagaggcataactgaatggtgaaaccagttttctttttcaatttcttttttttcttttgtgcagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacaggtaagcatgcactcttatttgggaaaggtggtgttggtttgagatatatcattaagtatagtaagaatatattaagagaatatttggaaaaatttagaaaccctcattatagttctctttgttctgtaagaaggagcttctattcacctcagggtcaattgcttttcctaatagcttgttttgtaagtgagttatgagatttttgttttctttttgcttgggtagtggggagaatttcattgaggaatcacccaagaaatctgtatttcattgatttggatcattaccttactagcctcttccctgtgaaacgcttgctttggcctgatcatcctcaggactcagttcaatgtgatatgtctttgtatgagccgggcagctaaccctacatgccttacctttcacactactttgcccacccaaaaatggtcttaaatggaggctgtgggattcagtggccagactgggacaaagcctttgctttgggtctccagaaagattttcttcactgtagtaatatgcgaactgttccaaagagggaagtctttggacactggaggggactgaattggagaaggaaaggaaggatgaaatgaatctcaggtacacagatgcctgcaggaagttgttcagcacaatgaatcaccaaatattttagagataaaatttcaacaaaaatttgagaaatatattttgtgcttagtactgtgccaatggttgtgaaacatataaaagaaatataagagcctggaggcagtggctcacgcctgtaatcccaacactttgggaggctgaggtgggcagatcacttgaggtcgggagttggagaccagcctggctaacatgatgaaaccctgtctttactaaaaatacaaaattatctgggcatggtggtgcatgcctgtaatcccagctactcaggaagctgaggcaagagaatcgcttgaacccaggaggcggaggttgcagtgagctgggatcacaccattgcactccagcctgggtgaccaagtgagactctgtctccaaaaaaaaaaaaaaaaaaaatgaaaaaagaaatataagagaaggtccttatgcaggccttttgcagaggaacttttgctgcatacaagggttactggacttagaggtgtgagacagcattgtagccccagctagtaaggtaggttgccttgagtaggtggaactgaccttgatcagagaagagagtggaggtgtattctggaggaaaactacatgaacaaagggatggaagtgaggagagggatctgcagcaggtgtgttgattgcattacagtgggaaataaatgcttagccatcatgagctcctttaccagggagcttggtcagctgtgaggtgttttggcctccatccttgcatctggaacatgaagaaatgaaagttgtgtttaatgagcattagttggaaaggcaaaaaaaaaaagcagaaggattagagtaacaggatgatctgggattccagggccttggcataatacattcacatggttcaaaatgcaaaaagtacagaacgatatatgtattgtgaagaaaccaccttccacccttgtccccccagccactcagtttttctgctggagacaaagctactgcttccttgggtataactgtgaaaatggtctctgcagagacaagcaaatgtgcttatgtacttttaaaaaataaaatggtaaaatagtgtatagactctgtcctttgctttttcacttaatacatcacggaaattgtcccatattgcctgtaaagtaaagcactttctcatttgtctttatggccatatagtatctcactgagtgaatgtgcttttatttatgtaaatcagcccattaatgaacatttaggtttttccagcctttccctattataaacagtatgacaaagaatcacactataaatgtaaacatgtcggttttgcacatggatgaatatatctgttagataaattactagaatgcagtatcaggccccgcatgtacaaaacatgtatgatttcattaggtactatcaagctgtagaggtggtaacagtttactctccagtgtgttatgcactctggccaatgtacatgttatcagactttttgatctttgataatctgactaatgaaacacagtagttttacatgactcttttttttttttttttttttgagatggagtcttgctctgttgcccaggctggagtgcaatgacgcgatctcggctcactgcaccctccgcctcccaggttcaaatgattctcctgcctcagcctttcgagtagctgggatcacaggtgtgcaccaccacgcccggtgtgctaaaaatacaaaaaaaatacttttttgtatttttagtagaaacagggtttcaccatgttggccaggctggtcttgaactccagacctcaggtgatccacccaccacagcctcccaaagtgctgagattacaggtgtgagccacggtgcctggtgacgtttttctgttttgcttttttttgttttgttttgttttaatgagtgaggttgaacatttgttcatatgtttaaaaccaatttgtgattgtgcaggatggctcgtgtctgtaatcccagcactttgggatgtcaaggtggcttgagcccaggaatttgagaccagcctgggcaaccatatgtagaccccatggctacatgggcatggtggtgtgcacctgtggtcccagctgcttggaatgctgaggtgggagaatcccttgagccaagaagtgagtgagccatgatcgtgccactatgccccaagtggggcaacagcgcgagactctatctcaaaaaaacccacatggagaaaccccgtctctactaaaaatactctactaaaaattagcagggcgtggtggcgcatgcctgtaatcccagctactcaggagtctgaggcaggagaatcacttgaacctgggaggcataggttgaggtgagccgagattgcaccattgcactccagcctgggcaacaagagcaaaactccatctcaaaaaaaaaaaaaaaaaaaagccacnnnnnnnnnnnnnnnnnnnntaaattactagaatgcagtttcaggccccgcatgtacaaaacatgtatgatttcatttggtactttcaagctgtagaggtggtaacagtttactcttcagtgtgttttgcactctggccaatgtacatgttatcagattttttgatttttgataatctgactaatgaaacacagaagttttacatgactcttttttttttttttttttttgagatggagtctcactctgttgcccaggctggagtgcggtggcgtaatctcagctcgctgcaacttccacctcccaggttgaagccattctcgtgcctcagccacctgagtagctgagattacaggcatgtgccactacatccggctaatttttgtactttttagtagacattgggtttcaccatgttggccaggctagtcttgaactcctgacctcaagagatcctcctgccttggtctcccaaagtgctgggattacaggcgtgggctaccacacccggctggtttttcttttttgccttaatgattttttttttctctgagattaaactttattaaagttacttttccagaaaattcagtgaatatggtaacataggaacaaacttaggctcataagccctttacatttttacataatctttaatgatgttgatcaggaaattctttcactggtagaattacttctccattctccagaattgtatcatctgggaatattctgggcttcttttcaatggtgccatatggtttttttagatacatgatacttcttggtgctctatatgttcagagaaacttctctagtaacaaactatagaaatgatgattttttattttttaaacagtagagacagggtctccgcatgttgcccaggctgctctcgaactcctgggctcaagcaatcctcctgcctcagcttcccaaagtgctgggattgtagctgtgagccaccacacctggtgatttttaggattttaaaagaacacgttgaaaaattagctctgtatctgtgaaatgagttacaaacaattggccgagtattttggtcggttttttgtttttcatctgtarcaggggataggtttggctgagcagaaaggccataggaaactgcttcactaaacttcgctcactcagaaccctcagactttcaaagagccaggaaatcggtataaaatttttgagataacattaattaagctttttgcagtttttcctaggaccagattaaacagaagttttcctttacagtattcattatggttggtatctccagagttcatcctttttttgtggtactgggaaaagttgcaacatttacctttgcagggacatggatggagctggaggccattatctttagcaaactaacacagagcagaaatccaaataccacatatcctcacttataagtgggagctaagtgatgagaacacatggacacatagaagggaacaacacacactggggcctattggaaagtggagggttggccgggcccggtggctcacgcctgtaatctcagcactttgggaggcygaggcgggtggatcatgaggtcaggagatcgagaccatcctggctaacacggtgaaaccccgtctctactaaaaatacaaaaaaaattagtcgggcctggtggcaggcgcctgtagtcccagctactcggaaggctgaggcaggagaatggcgtgaacctgggaggtggagcttgcagtgagccgagatcgtgccactgtactccagcctgggtgacagagtgagactccgtctcaaaaaaaaaaaagaaaaagtggagggtgggaggagggagaggatcaggaaaaataactagtgggtactaggtcaaatacctggctgatgaaataacatgtacaacaaacccctgtgacccaagtttccctatgtaacaaacctgcacatgtacccctgaacttaaaagttaaaaaaaaaaaaagtatgacatttaaactattatctttgggggattaatatgtgcctaggagattgacccttgtctgttttacagggtgaaagattgtctgctggatattctccatcatatgacaaggacaagagtgttctggctttcagaggaatccctgtatgtatcacccacaacttggtaccttctgccagggcttttgttgtgtgttactgtgtggtgccagaactgtggtagacgctggggacacaagggtggcatagaccttagcttccaagagctcacacttgaggggagtgaggggagggtgtatggaacacaaacatacaaaacaacttctatttaataagataattgccataatgaagcaggctataaaacgcagagagaataccaaaggcacaccacagtctgaaatgagtgtatgaatttttgtttatttacattcaaggtggacatacacttgtccccaacatcacccaagttccacatcatagttaaagttttccaggtacctcaatttaaaatggacttcaaggccagtaagtggctcatgcctgtaatcccagcactttgggaggctgaggcaggcggatcacttgaggtcaggagttcaagaccagcctggccaacacagtgaaactccatctgtactaaaaatacaaaactagctgggtgtggtgatgcacacctgtagtctcagctacttgggaggctgaagtaggaggatcacttgagcccaggaggtggaggttgcagtgagccaagatcaggccactgcactcccgcctgggcaacagagtgagactccgtctcaaaaaataaataaataaaaagtaaaagaaaataaaactgacttcagtcaacccatcagggcacactaggtccttttggcctccagtgtcaaggacattcagtacagtgggtgggaagcgtttgtgtatatgggggtatgtggattctatcctcaagctaaaggtcagctgcctctacagatctcagagttgaagaaccatggcattctccaggctctgaccacagaagcttatgaatgggagccaygtggtaaggttcccttcagggcccttggagtctgggtgggacccaagtcagaccttcccatgcatctgctgttcatcatttgaatttctctcactccttgtctttcagaattttgtagatgtatcagtccttggggaaaaatagaatcaacactgaattaggaatcaaaagaccagagttctgatcttcctctgctagtggtttactgtgtgcctctgggcaagccatatgatctctaatattagtacctcccttatcctcaaagggatgttatgaaaatgagacacaatataggaaaagcctttgaaaagttattctacttcatctgctttgcaaggcgcttccccatactatatttaaagttcactctacttgccaagtgattatggagaaaggtacactccagcctggccaacatggtgaaaccccattgtattagtccgttttcatgctgttgataaaggcatacccaagactgggaagaaaaagaggtttaatggacttacatttccacatacctgggtaggcctcacaaacatggtggaaggcaaggaggagcaagtcacatctcacatggatggtggcaggcaaagagagagcttgtgcagggaaactcctgtttttaaaaccatcagatcttgtgagacttattcactattatgagaacagcacagcagagactggcccccatgattcaattatgtcccactaggtccctcccacagcacatgggaattatgggacttacaagatgagatttaggcggggacacagagccaaaccacatcaccgtctctactaaaaatattttaaaaattagccaggtgtagtggtgtgtgcctgtaattccagctactctggaggctgaggcacaagaattgcatgaacccaggaggtggaggttgcagtgaaccgagattgtgctactgcacccatacctggccactagaaatatgaacttttaaaaaaatactcttttttttttttttttgttagggacagggccttgctttgtcccccaggctggagtgcagtggtgcaatcatagaatttgtgggttcaagcagtcttcccacctcagcctcctgagtaattgtgtaccaccaggcatagctaatttttttttttaagagacaggttcaccgggcacagtggctcacgcctgtaaccccagcactttgggaggctgaagcaggcaaatcacgaggtcaggagttcaagaccagcctgaccaacatagttaaaccccgtctctagtaaaaatacaaaaattagctgggcatggtggtgcacgcctgtaatcccagctactcagcaggctgaggcaggtgaatcacttgaacctgggaggcagaggttgcagtgagccgagatcatgccactgtactgcaccctggcagcaaagcaagactccatctcaaaaaaaaaaaaaagagacaggttcttgctgtgttgctcaggctgatcctcaccttatcctcctgagtatctgggaatataagtgtgagcttctatgtgtagctaaaaaatattctaatataggaacatcatttggacatctgtgaagtttcttttaatggaattttatctttatggtgacaaacccagcattaatacattaataatttttactttaaatacatatatatatatatatatatatatatatatatattttttttttttttttctttccagagacagggtctcactctgttgtccaggctgaagtgtagtaatgtgattgtagctcactccagccttgaactcctgggctccagctgggactacaggtgtgcactaccatgcctagctaatttttaaaaaatttgagatggagacggtctcattatgttgcccaggctggtctcaaactcctggctcaaatgatcctcccactttggcctctcaaagtgctgggattacaggcatggtggcatgtgcctatatctctggctaactttaaaaaaaaaaaaaagtaaaaaataaatgtaggctgggcacggtggcccacgcctgtaatcccagcactttgggaaactgaggcgggcggatcacaaggtcaggagttctctaccaaaaatacaaaaattagccaggagaatcacttgaacccgggaggcagaggttgtagtgaaccgagatcgcaccactgcactccagcctgggcgacagagcgagacttcttctcaaaaaaaaatatatatataataaataaaaataaatgtaaaagagaattaataaataagctgactcaattggcagtgctcttgactatatgagtaagtggaagagagctgaaataaaggagacaattataaaaaggaaaaaagataacctaattaacgtgagctgtgttaattatcctgactatttgtcctttgcccccgtgttcttctgttggtcaggggaaaacagtatttatgtcacacgtaggaggcatctccctcattccaagagaaaaggagaagctcttacgtggtttgggcatttgtgttgaggttttaagcaccagcttgctattgctggtggaaaccttgaacttttgttgactaacctgttttgacagcatattcccacccccttgccactgtggttcctgctcctggctcacagactttgatcaagctgtttgtaggcgagggtgtatggggttggggagggattggttaagttgctggtagatgaggctctgacaggtgaagaatcaataaatcaataaagctgcatgaaggtaagagggtgaaggatcctgttcagcttcataataagcattgcatcctgctgttctactcttcccccagtccctttttttttgaaacagagtctcactcttggcgcccaggctagagtgcaatggcgcaatcttggttcactgcaacctccgcctcccgagttcaagtgattctcctgcctcagcctcccaagtagctgggattacaggcatctgccacatacccagctaattttttttttttttttttgtatttttagtagagacagggtttcaccatgttggccaggctggtctcaaactcctgacctcaggtgatccacccacctcagcgtcccatagtgctgagattataggcgtgagccaccgcacccggcctactcttccctttttgttcagccactttgtccctcctttttagctcctatgctgaaagtaagttttattttcttgatcctccaaggttgaatattctcttaaagctgtcttaggaactccaaggctcagtgtctgctactccggactggagcaggtgagatggaatttcctaaaggtccagatatttaggaccctggacccatctcacccgctgcctctgtccattgccctgctggacctgagcccacacctatgttgataataatagcttacatttgggccacgtgctctcctaggaagtagaattaccccatcctcacaacagccccatgaggggttacagatgataagtaacttgcctgaagacatacagctagtaagaggcagagatgaagcattcacaagtagtttggctctcaagtgtgctttcagtaactatcctctactgcttcccagccgctttctcttccttattatccattagtgtctggtagcatttcatttaatctgcaggtatattctcccaacagtttattgtcatgtgatgtcctcagccaagattgtgaggcagagaggagctgtcccaacctactataccaccgaggctggagagatcatatttttggtattaaactggagtctctccatccttcacattgttgatgtcctctgtagcaaaccggaaaagtcagtgacagaagatgccgctagcrgtttgagccagagaatgacagctctggtttggagaaaagggccggatggtggctctagaaagcccatccttctgctcttctttttttctcccccttatattgtgctttcattcattcattcattcatcaaacatttgttgagcacctattatgtgtcaagctctgtgctagcctctggaaaacctgccctcatgtagctcactgtggagtaggagaaacaatgactacactatgataagcacgggttgtcagggtctcacagagcagtggcccctcatccagaccgatgaggtcaaagaaggcatccaggcgaggatggtgtcagagctaactgaagaatgagagggagctgcaccagcaggggttggaactgaaggtggcagtgcctggagtcttgattccagcagagggagagcagtctgtgaaaaggcaccaagggtgggagagggcagagcacatggaggaacttcaggtagttctggatggccctggggcaaagctagagaggtaagaagaatctacaaatgttcctcgagttacatgaacttccatcccaataaacccattggaaacgaaaaatttaagtcagaagtgcatttaaggctggtccgagtagaatgatttttacaacgaattgatcacaaccagttacagatgtctttgttccttctccactcccactgcttcacctgactagcctttaaaaaaacaaaaaatttaaaaacaaaaagaaaagaaaaatgcatttaataccctgataaatccatcaaaaagtcaaacaattgttaagtggaactgtcatgagttggggaaccatctgtagattgtgaagttatgtggatactgtgctgtagagtatgggttttatcttgaggactgtggagaatccctggagggttttgagcagtgatgtcggatcttacttttcttttcttttttttttttttgaggtggagtctcgctctgttgcccaggctggagtgcagtgacatgatctctgctcactgcaactccgcctcccgcgttcacgcattctcctgcctcaacctccagagtagctgggactacaggcgcctgccaccacgcccagctaattttttgtatttttagtagagacggggtttcactgtgttagccaggatggtctcgatctcctgatctcgtgatccgcctgccttggcctcccaaagtgctgggattacaagcatgagccactgcgcccggccaatcttacttttcaaaagctcactctagcaaacctgtgaggagaggatcagagggtgttaagatccaaggcagccagatgtggtagtgcgtgcctrtagttccaggtactcaggaggctgaggcaggaggattgcttgagtccaggaattctgggctgtagtgtgccatgctgatcatgtggccccactaagttcagcatcaatatggggaccacccgggagtgggggatcaccaggtggcctaaggaagggaaaactggcccaggtcagaaatggagcagttcaaaaatcctgtgctgatcaatagtgggatcatgcctgtgaatagccactgcactccagcctgggcaacacagtgacaccccatctcttaaaaaaaaaaataggcccaaggcaggcagacaaggctggggtctgcagtagaggcccagacatacctagatctcagagggtctccttttctcctactattgcagttgtgagtayagaggtggtcagagcccaagaagaatgggaagctgtggacaccatccagccagagacaggtaactgtacgaatgctgctgtctccccatagcccctctgccascaaaggcaycatccacacatgtggcaaatgtttctgtgagtctgggactaggagatagaattcstgagagtgctcattttaactatataacatagattacagtayctttttcaaatcctaaratgatgacatcctacctctggaggaaaccagagtgaaggccatggagaaagggctgccatccctgtccatctttcacccagccatgagagaagacagggttgaccttggttagggcagcttctacagagtggcaaggctgggtaggaggatggagatgggcccctgtgtaaggctgctcaggttgtttactgcacaaggaagtccctggggatgggagctgaagcaatctgctggaaggctctgaaggctgagtaaaaattgtctcctgtttctttctaagaggttggatgaagagatagaactaggacctatatctagcctgagcctctcttcagctccttgggcccagtgaatagtatcagccattgcctatattgctaactaatcagttaattccctattggctataacagaggtgtatggttgggggttcctatacagggtgtaagaagggaaaagtggaaattaggaaaggcccttaaacaaactggttgcatgctcttatgtgrgtacccaccccaggcagtgacttgccccctcgtagatgagagcatttagggatcacctcgtggggcagatccgccccatacccaccacagaggctgacctagcaagactgaatagcctcgtccaaaaagagagtcctcttcgccgacaatgccagcctcttgaaagaagattggttgtagctgtargtgtctgatgttcaactggaagccagtgcttggcttggaagtgacaagtaggagggcctcagtaaatgtttgttgacagaatgactcctataaatcctggcatgtcttccgttttgccacagggagccaagctagctcagagcagcctgggcagctaatctccttcagtgaggccctgcagcacttccagactgtggacctttcccccttcaaggtatgagggtagcagggtttggagtctcaagcaaagtgccttttccctaggagccaagcctctatcccaccaggacagggcattgggcaagcaaatctcccctaagatcttggtgcccaggatcatgggtggcctaggacccatgcttcatttggggccttggtagcttttgtgggactatgcccttacagctcctgtagccctgtcattcaggggcctgtatagctgtttatctactcttcccttttagggatggggacatctagagtcaagtactaggtagatccttgcagaggcaaggcaaactgttcagggagctgagtgattcatggccagtggaggaaaaccttccattccctcaaggaaccagaagctatttaggaatttaagaaagatataagctggaaaaagaaggaatatttgggggaataaacgctaggggtgggstgggtgctgggcatagtggctcacacatgtaataccagctctttcggaggaggctgaggtgaggggtcacttgaacccaggagttcaaggctgcagtaagctatgatcacacctgggcaacagagtgaaaccctgtctccgtaaaaaaaaaaaaaaagctggggagctttctgggccatattgagtaacaatacgtttagagaaatgtgatttcaggtcttctacctaaaaccttgctcaggggagagaggctaaaaagataggaaccaagttgttttataggacccagagagccgaaagctaccgaaatcagaatattctaaggcttgcagtagtgaccctgagccatgagaagccaacatgacctcacttgggaagtgctggttgtgaccaaaagattccagctacccctcagagtcatctaactctagtgggtccccacctcctgggaaacctgtcctggcatttgtctgactgcctgggggagctgggcaggtgtaacccctgtgggagtcagtggaatacctagttctggaaaagcccagaggactaaatgcaaataatggctgataatacctacgcttggggatgtctttcaccttgcaaaaaatctgggagctggaagagcctggctctagagactcaacaggtgcctygcagcttctgcctccttcccttggcccaaaggccagccagatagctgggggagttactttctgcaagcactgcctctggtctgagcctgatgggaagttgattaagggaaatgaaccagcattctgcccattgcctgcaacttcttccccagaaaagaatccagccaactattcgaaggactgggctcrccgccctccgacactacctcttcgggcctccaaagctccaccagcgccttcgggaagaaagggacttggtcctgaccattgctcagtgtgagtgcaatgcgagcccacagggcagttgctgcatctgtggttgggcaagaccgtgtgtgctgaccctgtgaggctaagccaggaatattgcatgtaccatggttggcgggtgagagtgggagctgagaactggatgtctcacagtccagatctcacattctctgagaagcacccggttctcccatgaggggcaatctggcagagagtgtgggtgtgttttggggcaggtggcctggatagccaagacccagtgcatggccgagtcctccagaccatctataagaagctgacyggctccaagtttgactgtgcccttcatggaaaccactgggaggacctgggctttcagggtaagagggaggagtagctcatcttctttttcatgcctctgattccaggactagagtgagaggccaggtcgttctcttccagtgctatgagggggaagatcttgggggagtattccgggaagagggtgcagcaaatgcaaaagccctgagggggcgcctgctagttctgcttgaaaaatagcaagagtaggtcgggcgtggtggctcacgcctgtaatcccagcactttgggaggctgaagagggcagattacttgaggtcctgagttcgagaccagcctggccaacatgatgaaatcccatctctactaaaaatacaaatattagggtggggtgcggtggcctgtgcctgtaatcccagcactttgggaggctgaggtaggtggatcacgaggtcaagagttcgagaccaggctggccaacatggtgtaagcccgtctctactaaaaatagaaaatttagccaggcctggtggtatgcgcctgtaatcccagctactcgggaggctgaggcaggagaattgcttgaacctgggaggtggaggttgcagtgagccgagattgcgccacggcactcaagccttggtgacagagtaagactctgtctcggaaaaaaaattaaaaataaaaattagccaggcgtggtggcacgtgcctgtaatctcagctactcaggaggctgaggcaggaaaatcacttgaacccggaggcagaggttgcggtgaacagagatcgcactactgcactccagcctaggtgacaaagggagactgtctcagaaaaaaatagccagagtgtggctgaggtggagatgaaagtgacaggaggaaagatcacttggtggtcttttaggctgttgtaaacatttactgtaagtgatatggaaaacactggagtgatgtgacagaatctggcatttttgggttttttcctctctaaaaaatatttatgaaaattttatcatatattattttactttctgagtgaaacagaatcatttcaccagtttttggattgtactattttttttcaaaaccatatcaaattggctgggcatggtggctcacacctataatcccagcactttgggaggccaaggcaagtggatcacctgaggtcagcagttcaagaccagcctggccaacatggcaaaaccccaattctactaaaaatacaaaaattagtcgggtgtggtggcacgtgcctgtagtcccagctactcgggaggctgaggcaggacaatcgcttgaaaccgggaggatgaggttgcagtgagccaggattgcgccactgcactccagcctgggtgacagagcgagactctatctcaaaaaaaaaaaaaaaaaaaaagacaaaaccatatcaaattatatttgtatagaataggaaaataactttgaaaggaaactttaaggccgggtgctatggctcactcctgtaatcccagcacattgggaggccgaggcaggcagatgacttgaggtcaacagtctgagaccagcctggccaacatggcgaaaccccatctctactaaaaatatataaattagccaggcatgggggtgtgcacctgtaatcccagctactcaggaggctgaggcaggagaatcgcttgaacccaggaggcggaggatgaacccaagattgcaccactgcactccagcctgagtgacacaacaagactctgtctcaaaaaattttaaaaaaaagataaaaggaaactttatgtacccctaattaactggtggtctgttggtatggcaacatggttaagtccctgttccctctctcatctatcatgtaattgtcttaaatgtatcctctctatatattgagaatcgcaccagtaatgttaagatttttgtttcaatcaacaaacataatttttttgaggaggggttctcacgaagaaccagaaaacctgctagacaaattgtagaagagctgtgacactgcaataaacataatttctgaatctctggagaaaaaggaaaatctgggccaggcacggtggctcacacctgtaatcccagcaccttgggaggccacggcgggaggatcacgaggtcaggagttcaagaccagcctggccaaaatagtgaaaccctgtctgtactaaaaatacaaaaattagccaggcatggtggcgcgtgcctgtagtcccagctacgtgggaggctgaggcaggagaattgcttgaacccaggacgtggaggttgcagtgagccgagatctcaccactgcgctccagcttgggcaacagagtaagacttcgtctcagaaaaaaaaaaaaaagataagaaaaaggaaaatctattgtatttactctttccattgtttgttcttccttcctaaccctctttttttttttttttttttctatttcaaggacttcctttagttattctcttaggataggtctgctggctataaattgtctttgttttccttcatctgagaatgtctcaatttccccttcacttctgaattctctggatataaaattccaggttgacagttcttttttttcagcacttgaaaatgtgctacttccttctggcctgcatagtttctgatgagaaatccactgtcatttgaatgatctctcccttataagtaaggagttcatattctctttctgctttcaaaatattttttgtgccaggcatggtggctcacacctgtaatcccagcactttgggaggccaaggcaggaggactgcttgagacaaggagttcaagatcagcctgggcaacattatgagaacctatctctacaaaaaataattttttttttcttgagatggagtctcactctattgcccaggctggagtgcagtggcatgatctcagctcgctgcaacctccacctcctgggttcaagcaattctcctgcctcagccttctaagtagctgggactacaggcctgtgccaccacacccagctattttttgtatttttagcagagatggggttttaccatgttggtcaggctggtcttgaactcctgacctcaaatgatccacctgcatgagcctcccaaagtgctgggattacaggcataagccaccatgcctggccaaaaaaaaaaacttttgtttagtagccaggtgtggtggcgcatgcttatagtcccagctactggggaggctgaggcagaaggactgcttgagcccaagaagtcgaagctgcagtgagctgtgatagcaccgttacacgctagcctgggtgacaaagtgagactctgtctcaaaagaaagatctttgctggccgggcgcggtggctcatcctgtaatcccagcattttgggaggccaaggcgggtggactacgaggtcaggagttcgagtctagcctggccaatatggtgaaaccccatctctactaaaaaaatacaaaaattagccaggcatggtggcatgtgcctatagtcacagctgcttggtgtggaggcagaggttgcagtgagccaagatcgtgccactgcactccagcctgggcgacagagcgagattccatctcaaaaaaaaaaaaaatctttgctttgtctttggttttcaggaatttgactgtgatgtgtcattgtgtggatttatttgggcctctcctgtttgaggttagctcagtgtcttgagtctgtaggtttgtgtcttttgccacatttggtcaattttcagctgtgattcctttgaatactttcttcagctccacactttgtcctctcttgtgggattccaatgatacaaatgctatctttgttcattttttaaaatctttgttatagcctcagatctccaaggctctgttcattttggtttttgtttttctgtccctctgttgttcatattatgttattctattattactgtcccatattcaagttcactgattctgttgtctccgttctcctgttgaccccatccagagagtttttagttctagttcttctatttttcagttctaaagtttccatttggttcttctttatatctgctgtttctttactgaaactttctattttttcattttttcaaagtgtatttgttcataattgcttaccaaaggcattttatggtagatcctatagtcactttctatcattgctgtaacaaattaccacaaacctagtggcttaaaacaacacaaattattgtcttatagttttctagttcagaagtctgactcaggtcttactgagaacctgtggtcaagatcaaggtgttggcagcacagtgttctttttggaggctctggaagagagtccatttccttgccttttgcagcttctagaggccacctccattcttccatcttcaaagccagaaacagcatctctctgagcccgattcctcacatctctttctctggctctgggcttccrcctttcttttccacttttaaggacccttctgatgacattgggcccacccagacagtccaggatcatctccctctctgctgatcagcaaccttaattctacctgcagtcttaatcccctttgccatgttacataacatagtcatagcttctggggacatggtcatcgtggggcggggggattattttgcctaccacggctgctttaaattccttgtcaaataattccaacaactgtgtcatctctgttggtgtctgttgatcatcttttctcattcgaattgagaattacctagttcttggtgtaacaactgattttttattgtatcttagacattttgggtagtctgtatgagactctggatcttacttaaatcttctactttagcaggcctcccctgttactgtgccagcaggggaaggagggacgtcaccatgttactgccaggtgggggtggaagtccgggtatcccacttggcttgcagtaataccaagttcaagaccagcctggccaacatggctggtggggccaggggtgcctcgttactcttcctatgtggcttccacattgcagaggaggcaagggggctccttaccactgggaaagataaagtcccagctccctgcccggccttctctgacgctacccttgtggagctaaggggtgccttgatacagttaggccaggatggaagtctagggtccctgctcagccttttctggagaagagtggggatggggccacatttttctctgtggtgttttgctgcagtagggtgggtattggctaaagccttctgtcttgctacactgcctctttccccaccctttggctagagagagcagctttccttggggctttttggtctgctcccattggcatttctgggttgctgtcttctccatctgggatatattaggcaaaaagaaacccaggaattcaccagagagtcatttctcagctctcaagattcctagtaagtctgtcttccctcctttcagagccttctgtttattttatatagtaatgtccagggctttagctgtacttagtgggaggaataggcagaaagtgcattattcatcttgttccagaactgtaaattcagccttttttgtaaaggattgctttggtggttttgtgtagaagtaactatcaagggtcataggcagcagcaagaaaactgatgtgggaggctgcctccagggcgctggggtccccatttggtgcatagcccctgcttagctcattagaatgagccccacaagtgtggcagaaagtggacgtgtgctgctcatgctccgctagcctgggaagaggccagtgtcagggcagcttcccatggcaagcccttgaagcattgctcgctgccacaccctgtttcctcacggtctctgttacaggagcgaatccagccacagacctgagaggcgcaggcttccttgccctcctgcatctgctctacctggtgatggactcaaagaccttgccgatggcgcaggagattttccgcctgtctcgtcaccacatccaggtgagactttggtgggaagccagaggaaaggaaagggccgtggagctaggacctgagtggccgagagggctcccaggacagctgagataaaccaggaatgggcttccccgtcagtctgacctgcattgaaatatgagctgtaccgctcattagctgtgtagctcaagcaagttcctcgactcctcagagccttgattccctcatctgcagaatggaaatcatagtgttgttagaaatgcttgttctttggtgccgtaaagaaatagcacttgaacataaatttaatttcttcagcaaggattttttttactttctgcagaaagggtacactcactagcagttttgccacgagagtacactgaataaatgagacaggatcatttataacttgacccatatactttactgctgtgtccggtttctattggctggaatgggacttcacattcgtatttgtcttgattggctagcaacttagaactttttaaaagaagcaaaggaagaggagaacaaaggaaggaagaaataacttgtggaatgctgagaaaggtaaaaacaccttcaaataaggaagaagaataggctatgacttaatgcttgcttggacyagtataagcatgccagggcaaatatttaggctaaattgtgggagctaagaacataaagtacagtgacttcttcattatggctagcagatatttaagaatgttagcagaggtctttgaataaattttgcttctaagagaagttactatttatcttaattagatggggaggaaagtctttgaagaggaacgtctactttactttttacagtgtgaccctgaaaatctgaggtctcagttaatttagaaagtttattttgccaaggttgagaacacatgcccgtgacacagcctcaggaggtcctgatgatatgtgcccaagatagtcagagcacagcttggttttatacattttagggagacatgagacatcaattaacatatgtaagaatgaacattcattcagtccagaaaggcgggacaactagaagcaaaagcgggaggactcgaagcagggaggggactttcaggtcataggtagataagagacaaataattacatttgagtttctgcttagggtctccaaaggaggcaatcagatatgcatttatctcagtgagcagaggggcaactttgaatagaatgggaggcaggtttgccctaagcagttcctggcttgacatttccctttagcttagtgattttgggggcccaagatattttcctttcacattttcccccttttcttttttaaaatcttttggagaaagcattttagaagaaaatgaatctctggtcttaggtttcatctgatctcttacggctaggatggtttattcctagacggataggtccccgagttattaggaaagttcatttttagaaggttgtgaagtctcatgtcctatgaagagaaaatacggggaggaagtgaaaacaacaacaacaaacaaaagaacaatcctggatatcaatataggccacattcttctgaagtctatacatcagtaggcaggtatgaaagtggcttatgtatgtaaataggttgctgttattttcttctgaagttgtctggcttcagtttgcagggctgtaagaaagtacggcttaattttcagtgactccaaattaggaaaatggaaaaaaaaaggaggaaaagaaatttaaaacattattttgttttgttttgttttgtttttttggagacggagtctcgctgtgtcctgttgcccaggctggagtgcagtggcgcgatagcacactgcagccttcgcctcccaggttcaagtgattctcctgcctcagcctcctgagtagctgggattataggcacatgccaccacgtccggctaatttttgtatttttagtaaagacggggtttcaccatgttggtcaggctggtctcgagctccagacctcgtgatctgcccgcctcagcctcccagagtgctgggattacaggtgtgagccaccgtgcctggctgaaaacattattttgaagacttgtagccaagaaaaattagaattcagcccaaactgtagaaaattattaaaattgaaaaacattaggcaagactaggatctaatgacaggtgtactatagtttttgaaacataatttttctttctccagtttcctgtttttactaaagacaaatcatggtaggaccgatttgctttataatacttagccagattatttgtataaagtacagcaagaatagttatttttcacataggctttttttaaaaattggctttgatggaactttgttatatagaaggaatctcaggcaagacttttttttaaagccaagccttgccatggatttgtaccatcaaatatctatgagttgggtgaatttcctctcctcttgaggttccaggataaacctggggctcctgggcctgycataaagtaacattctttacttaacacaagtcagaaaccctgttcagggactgtgtacacaaaatatgaggccagtttcccaagggcgttattggcttcataaatcaagtttgagttcttaaaagaaatgacatggttccagtcaaagccttggtaaaataattagtttctccagttgtgtcctattagcagtgaaaacagattcttattgtatttatgcaaataactgtattgccataaattaagaatactcacaaatagtttccaaattctggagaactcaggtagagagaaacaaatatgttccaaattttggtcatagcagtatactaaattgttaaaagctgtcaatagctcaaaagagaagtttgaagactctgaaaaacaaaacaaaggatcagcaacgttttaagcaaaaggycaaaaaaattagttcaatccatgcagttaattcctgttctgctttgatattcatgaacattttagctctccatgagtctgaaagtttttcctctattctgatgtcacaatctccaaagttatcagaaacctkcattcaagagcccctgttagagttttaagatgatgattattatttatttatttatttttagactactcttgctctgtcgcgcagggtgaagtgcaagtggtgcaattttggctcatggcaacctccacctcccaggttcaagcgattctactgcctcagcctccgagtagctgggattacaggcacctgccaccacacccagttaatttttgtattattagtagagacagggttttgccatgttggccaggctggtcttgaactcctgacctcaagtgatgtgctcgcctcagtctcccaaagtgctgagattacaggcatgagccaccatgcctggccttttatagctgattataaaaccaccttctaaagaggaccaaacaacacaacaattgtctgtggatgacaaaaagttttagggaagccattgttgaagacccagttgacaaggaaatttgttatctctgtggcacagaataatttaacataacaattataattattactgataatgtacactaagttatatcagaattttaggagtttcccataattttggaacacataccaataacacatttatacaaatacagcccaaagaaaatcgtacaccatttcatatttgacaatgcttcctgtataatttttataccaaataagccaaattatgtcatttttggactttatggagcctaatatcttaaaggatttatcaggtcagaaaaagacataatttatgatttgattttggaaagtttgtcaaatatcaaaggtttaaaacttgatatcacaaaataggatcacaggtcattataagataagtcattcttttaaccaaagcaataactcaaggatttcaaaaagaaggtgaaaatctccattccttgagagcggagacttgatttttcaatcaataagccctaataaaaacagcatgaagccaattaaatttatttttcaaaattttgtaaacaatctataaaattttaatcttgaccataagatataacttccataagccttttataacctttataacctttattaaggggctggttaatgcttcaagaaaatcttgttaatctgatgcaggggctcatgtgctgcttttgcatcagtgtgcctttgacattcatgattaatttataaagaaacttaacctattttatctttaaaaaatcagctcttgcaatctcatgcacccacctcttccgcaatagtccctgggccttgaagagttgagtagctttaatttctggccccgtgtcttaggaatgcagtttattctgattggcatcttctaccaggcctgaagatgaggctttaattgctgtcaatgtttaagatttgggctgggcgcggtggctcacacctgtaatcccagcactttgggaggccgaggcaggcagatcgtgaggtcaggagatcaagaccatcctggccaacacggtgaaaccccgtctctactaaaaatacaaaaaattagctgggcgtggtggcgggtgcctgtaatcccagctactcgggaggctgaggcaggagaatggcgtgaacccaggaggtggagcttgcagcgagccgagatcttgccactgcactccagcctgggtgacaaagcaagactccttctcaaaaaaaaaaaaaaaaaaaaaaaagatttggcaggacatagggctgggtgcagcggctcatgagtgtaatcccagcactttaggaggccgaggcgggcagatcacgaggtcaggaggtcaagaccatcctgcctaacgtggtgaaaccccgtctctactaaaaatacaaaaaattagctgggtgtgatggtgggtgcctgtagtcccagctactcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaaaaaaaaaaaacatttggcaggacacggtgttccttttagacccaggagttaaagccctgtaactcaatgtcacaaggactttttttttttgagacagagtctcacttttgtcacacaggctggagtgcagtggcgcaatcttggctcactgcaacctccacctctcgagttcaagtgattcttctgcctcagcctcccgagtagctgggactacaggcgcgtgccactatgtccatctaatttttgtatttttagtagagatagggtttcactatgttgaacaggctggtctcgaactctggacctcaggtgatccacacgccttggcctcccaaagtactgggattacaggcgtgagccaccgcgtctggccagcactttaaaagcacatacagaaagatacacggatgtaataaccttaatttaaaaacaagacaattcagttacttatctagggatgggtctcgggctgtagactctaccatcccagaagcaggaaaaaaaaaaaaaaacaaaaaaaactcatcttccctgttagaagtgagctcaaactccataaagaaattacctgccttccattgtcatggaaacaggaaatcttaccttccttgttaaaagcaagtaaaactccaaaaaaaaaaaaaagaggagttgtacaacaaaataaactttagatcttttttgtttttttgtttgtttgttttgagatggagtttcactctgtcacccaggctggagtgcagtggcgtaatcttggctcactgcaacctccacctcccaggttcaagcaactctcctgcctcagtcttctgagtagctggggttacaggcgcccaccaccacgcctggctaacttttgtatttttagtagagacagggtttcaccatatcatattgcttgatcctgggaggtcgaggttgcagtgagctgtgattgtgtcactgcattccagcctgggtgacagggcgagactctgtttcaaaaaataaaaataaaatggagggattgctacattttgctacttgagaaaaccataaaacccaaccccagagggcaggtccagacagagatagagaagctactggtctcaggctggtcttgaactccttacctcaggtgatccacccgccttggcctcccaaagtgttgggattataggtgtgagccaccacgcccagccaaagatcttgaacaaatttggggagatcagggattctctggagggtgtactcccagacctcagcaaattgttctgttgttttgagccataaagttagctcatgctggtaccaagcatggataggagatttgtcaaaggccaggggtacctccactcagaatccctctgtggttaccaaaatgtgaaccctgaaaatctgagacaggtctcagttaatttagaaagtttgtttttccaaggttgggaatgcgcacctgtgacacagcctcaggaggtgctgatgacatgtgcctaagktcatcagagcacagcttggttttacagttttagggagatatgagacatcaattaacacatgtaagatgagcattggttcctccggaaaggtgggaggactggaagcaaaagcgggatgactgaaagcagggagggggtttccaggtcataggtagataagggacaaatggttgtgttctttgagcatctgattagcctttccaaaggaggcaatcagatatgcgtttatctcagtgagcagaggggtaactttgaatagagtgggaggcaggtttgccctaagcagtttccagcttgacatttccctttagcttagtgatttggggaacccaagatattttgttttcacaatagaaacttcagctggctcattgggaaaattagagacaatgtacaaaagtagcaagcacagctgtgctgttgctgtttcaactctctgccctccctgaggaaatgcyttgcacaggggtagcatctcttggccctgaaagagaagagttagcctccacgggcccaagaggaggagatggacctccatgggttatgtgagccacagacttaccaacaggccagaggtgcttcagtagctcctctgtctctgtctggacctgccctctggggttgggttttatggttttctcaagtagcaaaaggtagcaatccctccattttatttttattttttaaaacagtctcaccctgtcacccaggctggaatgcagtggcacaatcacaactcactgcaacctctacctcccaggctcaagcaatcctcccacctcagcctcggctgggactacaggtgtgccgtaccatgcccagctaattttatttttttaatagtctctccattttagaaaacaaatttgacctgtttcctgccatctgtctatcccatattcatgggacctaggattcattcattcactgaatgaatattttttcagcatcccttggtgctattcttcttggtacttgggatacatcagtaaataaaacaaagattcttccagcagagatgaccataagctcaatatatcaatacattatagagtgctctagaaggtaataagtactaaggaaaaataaataggatagagttgagagaatgtggagagacagttacagtatttttatagggtggtcagggtagctgtcatgagagagtgagacttaaaccaaaccttggaggtgggaatgttagccaagctgatatctgggagaagaacataccaggcagagggattagctagaactaaggtctcaagaaaggagtgtgtctagcataggtaatgagtagtagggaagccaccggagtgaaaagaacacaggaagtttcactcatgtctgtatgaagagaccaccaaacaggctttgtgtgagcaacaaggctgtttatttcacctgggtgcaggcgggctgagtccgaaaagagtcagcgaagggagataggggtggggccattttataggatttggttaggtagtggaaaattacagtcaaagggggttgttctctggctggcaggggtgggggtcacagtgctcagttggggagcttttgagccaggatgagccaggagaaggaattttacaaggtaatgtcatcagctaaggcaggaacaggccattttcacttcttttgtcattcttcagttacttcaggccatctggatttatacgtacaggtttgggcccagaggcctgacaggaagggcagtaggagaggtggtcgtagatgatgggccagagggcgcagggcctagcaggccatggaaaggactctaggttttacgctaggtaaaatgaggaggcactgcagggctttgagcagcagagtaacacagtctaacttactttttttttttaatggatcctaccagctgctaagttaagaataatttccagtgagggcttttgtagtaaattagagatgatgctggtttgtcaatctccccttccagcagaggaatgtgtgggtaagagagtcacaatgtttctgaacaaagccatagctcctaagtggtgaagctgggcctagagcccctgtttcctgacagctggcctggcggtgggctctgtacagcattgattcccagccagcagcacaccctgaaaagtcacatagcagtgggagtgcagatgcttagactctccccatcagaaccactcagttggaatcttcagggttggggccaggtcagcagcagccgcagaagatactctggtcttcctgcttcagcagacaaaggtttctaagcccaaacgtgaggcatgaggataaatgaaattgtaaatggaagcagaaaaatgtccaggtctgagttcctctgctgtgttttagtcagtttcagtgcagtattttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcgtttcaccatgttggtcaggctagtcttgaactcctgacctcaagtgatgtgcccacctcggcctccaaaaatgctgggattacaggagtgagccaccatgcctggccaatcagtgggctttttaagaatgttcccgggctgggtgtggtggctcacgcctgtaatcccagcactttggaaggccgagacaagcagatcacctgaggtcgggaggtcgagaccagcctgatcaacagatcaacatggagaaaccttgtctctactaaaaatacaaaattagccaggcatggtggtgcatgcctgtaatcccagctactcgggaggctaaggcaggagaatcgcttgaacctgggaggcagaggttgtgggagccgagatcgtgccattgcactccagcctgagcaacaagagcgaaactccgtctcaaaaaaagaatgttcctgagaatggatgaacactaagttcaggtcctctgttaataatgttgttaccatactgtttttctcatatttatttttagattgaaagaaatcaagggaagggatgatattatgcaagtatatatgatcattaaataggcaatacctgaaggtacagaggtatacatgaaggtcagcatcaatggtgttctcagctacccatgttgaggcaagtataataacgacgaacatttgttaatacctacttgggccaggtgttgtgcctagtactttgcacatgtgatcttaagtaatgctcacagcaactctgtgaggtgggtagtgggataaaatgttaagtgttgacaaaatctgtctcataaggccaggcgcagtggctcatgcctgtaatcccagcgctttgggaggctgaggtgggcagatcacttgaggtcaggacttcaaaaccagcttggccaacatggtgaaaccctgtctctactcaaaatacaaaaattagctgggcgtggtggcacgtgcctatagtcccagctatttgggaggctgaggcaggaaaatcccttgaacccaggagacagaggttgcagtgaaccgagatcacgccactgccctgcactccagcctgggcgacagagcaagactccatctcaaaaaaaaaaaaaaaaaaaaaatctgtctcttggagttgttgtaatgattagtgacttaactctacccagtgtggcactagcgctggatttccaagaccacctgcaggttcaatgattcctgagagactcaagggactctacgtatagttatacttaacagttctgatttagtacaacagaagcaaaatcagcaaagggaagaattacatgggacaaattccayaggaaaccaggtggtgatgtccaagaggcctctcccagtggaatcacacagaacacacttcattcttccactgccaaattgtgcaatacgtataaaatgtcaccaatcagggaagctcattagaggtacccagtactcaaggtttttaccatgacatgctggtcatgtaggcaccctctgcctagcacataccaaaactctggaatcacagagggaaagctggtgttctgcataaagtatcttttttgtgtttgtttttttgaaaaaaaaaaaawwtttttgtagagacaggatctcaccatgttgcccaggctggtcttgaactcctagactcaagtgatccatccgcctgtaatcccaaagtgttggattgtgagccctgggcccagccagcaaaaactatcttgtttgcatgagcagttgaggaacaatgttagggaatgatgggaaccatctcaaaatccaagttctcagctgtcagccatggcctgatctaagaattttctaaggctcaggctctaaggagtctcaggcctgctgtgttaacttttttctgcacagcactcaaagtttatgtcctttttgattttgagagatgggaagactgagtttcacagaggttgggtgaccttctcaaggacacacagctaccaggtagccaggccaagatctggaattcaggtatcatggaagaccctgagaaaaatctctgtggagccagaagaccttctgcagttcagcactgtccagaactttctgcagtgacagaagtggtctagatattggaaatgcaccatccagtacagcagccactaagcacacgtgactactgagcactggaaatgtggctagtaccactaaggagctgaatttatatttgtttttcatctttaactcatttaaatagctacatgcagctggttgccaccatactgggcagtacagttctatactataatgtaatggatttttcttcaactgggaagcaggtgggataaatagaccttggttcttgttctgtactaaggaatgcactggtctatgtgttcctctcactgggtgtccttgtgtatgtgcaacaggggaaaataacatgtcatgtctgcaagttccctgaaaaaaaggccctttccattcagggattttgcaagcttggtttcattgttattaaagaaaggagcttgcctgactaaacatagagcattaaagctgtccctgtaggggattctgaggcccttcctggtgaagctcccctgccagactcaggctgcctcctcttggggtctgacccgcacagctggctctcaggcctctgtgttatcgtgagatggggtgtccccccaagtcaggatgaccttctacccacgtgcgtcttctctgtcttaggatgaggtgctcacgatcagccagacaaccagaagcccaaagaaggggagaggagactttaagaacccgtagggctagttagagcaccgagcctctcacttctgtcttcatcctgacaccaggagatgatgtgggcccaggggttgggtctgctgcaggccaaggagagctgacgggtcaggatgatgaagaggctggagagctagcacgggggttatgcacatcagctctggagcaaataacctcagttggtatcctggttcccatgccttaggaaagttactaaaggtcactgagccttagttcctcatctgtaagatgggaagaagattattaggaaaattaagtggaagcaataataatatcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagggyctggacaaagtccccatgcaccggtctccccaggacatcccttctcccacccctggccttagatgtcaggctcctggggaatggtgggggcatcctgggtttgggctggctcccctsgggaaatggggaaggaaggcgggagggaacctaggtctcagccttcatccaccgctgagcaggtcaccttgcctttttcctgcagagagtgtaatcggcagcagaaggtcatccccgtggtgaacagcttctatrccgccacattcctccayctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccacccsctggagtctgctagttctcctttctctgccctgactgtygcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatkggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaattaagcgtctcaggtgtttttttccaagacaagtcttgcaccatcctgtggtcctgtcattccggaacctggttagagccaggcacacctaagggtgaaggcataggtgggttccagcctggtcatgggctccaggagacagaaggttgcctgtgctgcagccaaaccttgctgaattcataggatgtccatcctctgctatacttacaagcccagagactccttgcaagctctagccagtggacgaggtagcccagctcttgttaagattgactggtataaggcatccacaccacgtttttcctgcatttgcttctggcgaaggccagcactgttggttccttcccaaaagagcctccagactgggcgcagtggctcacgcctgtaatcccagcactttgggaggccgaggcgggtggatcacgaggtcaggagatcgagaccatcctggctaacacagtgaaaccccgtctctactgaaaatgcaaaaaattagccgggcgtggtggcggatgcctgtagtcccagctactcaagaggctgaggcaggaaaatggtgtgaacccgggaggcggagtttgcagtgagtcgagactgtgccattgcactccggcctgggcagcagagcgagactccgtctcaaaaaaaaaaaaaaaaaagagcctccaggccagggtacctgagctggggagtggggggcaggtgagagccccactatgctaccttctgtcctccggaccccctcaagtggaatgctatggaagaccactatctggccctgcaggcctctttaagtctgacccactgcagggggaaacatcacagaggtagggaagagaggtggccacccaggcgtggaggggaactcctgactgctgtcagcaggatgcctcaagggtggggctggtaacaaaccccatagtttgccttgtgttgtctgcctgacctgaactaaccccttcattcacaatacttcctccagtctggtcctcagctaaccaacagagatagcagggagattgctgggcatggcatggcaggagttgaattgcaggggagaaaagctgcagctcggcctccactttggagtatcaggttgggtgattcttccctctgcagggtcctttctgcccaccatccacctgtttagtgccccccagatgacagagtactcacagcttcagaccctggaacattagcaataatgtagtctggcaattttaaatttacagttctgttaatgaactggttgtgaggggtacctgaaccctctgaaagcagatgcaaaaatctttttttttttttgaaatgggatctcactctgtcacccaggctggagtgcagtggcgcgatctcggctcactgcaatctccacctcccgggctcaagccatcctcccacttcagcctcctgagtagctgggactacaggtttgtgccaccatgcccagctaagttttgtatttttggtagagatggggtttcaccatggtccccaggctggtctcaaaccccagagcttaaggagtccgcctgcctctgcctcccaaaatgctgggattataggcatgagccaccgtgcccagccacaaaaatcttaatctgtgtatatttatagggaaaggggctaggcctttcataggagacttaaaatactccccgtctctacaaaggttgtcagaaccactaatgtagtgcaacctttattctctcccctttaaaaaaccatccctggcacctgctctttgtgtaggctgtcaagtagggctaagaagtctatggagaagacatggaggcagatccacagaggagctcatttcttttttatttttattttttgagtcggagtctctgtcacccaggctggagtgcagtggtgcaatctcggctcactgcaacctctacctcccgggtttaagcgattctcctgcctcagcctcccaagtagctgagattacaggcatgcgcaaccatgcccggctaattttttgtatttttagtagagaaagggtttccatgttggccagactggtctcaaactcctgatcacaaatgatccgcccgtcttgccctcccaaagtgctggggttataggcgtgaaccaccgcacccggctggggtatctatggtatggttcttggcacaaatcagcaagttcaacttgccaattgatcagaatttttgttttgggatgaaagaatccaatttctggagctcagaagccacatagtccagaggacctgggggtgaggatgagtcagggtggttgcagccttgccaggcctcacggcctctggtccaagctgacacaggctcactcacaccctgctcttggcccctgggcatgccttctcagatgggacctcttcttggctactgcattctccctgctatttagctctctagcctctgacatcccaccaccacttcattacccaagagaatgaactaaggtctagcaaaggaaagtaacttgcctaggatcacagaggcagggtaagaaccagactgaagactgtccatgctagcctggtgcttttcgcacagccctgcagtggccctgggctcaccagccaaacatgctgggcaatgtgcctacgaagtaataagccaggcttggtacaattgtgaaaggctgtcctctcttgctcagtgggcatatgtcacttgaagctgcctggcagtgctttattagggcatccgaagaaatactgccttaaatggaactgcatcccaagcccattgccacaaccttctccctgttgggaatgtgagactgaactgaacacccggatgcaactgatcctgaggcctggcactgtgccacctccctattgggttcatggcagtccctgcaagcctggctgggactcctctgtcatgcaaagcagctctggcccctccaaggctgtccaattgtcatctgtgtgctactccacccccagcatggggatgaacccaggtgaataggtgggtgacagtgagaatcagcccagggcaggtggtgcaggaaaagagctgggaaagcacttgtctcctttattgaacatctgcagggggcacctctgcactgaccaggcagccagagaagcaagcaggcaggtggtggggggcaggggagcatggggcaggaagacgcccaccctcatttccagtccttgaaaaattgcttgaagatgggactctcacggccctgaggcagaatctccacctgcagggacagcgggggagaagtctggttcacaaagttgccacctctgcctctgcccaggaggacaggagggggccagagccagggaggagggtgtgggcgcctggcctgaatccatgtgcagtccaggctgggaaagctcccctggatgagccatgagatgagaaccaagatttcagggacacagacagaggcaacagactgcttcaagggcgtgggtgcacagtttaataaatgccaccaacggtagctgagccctgtcagctccccacgggatgacttgtggacactgtgctgcggcaggaggggtggcaccagccagggacaacggcccagaggaggagtacccagttctctgggcacccaggagagtgctgcccaacatcctctttgaaaataataagtattttgacattttgaaggattgagatgggctttcccactggatgggtctaagagggaggcctggttgttcctgacagtgcccaaggctctcctgcccttcctggccaatttgaggggtcaggggccacaggaagagccctaggaagagggctgtggttgtgcgcatctcctcacctgagtgttcggggcgtactgcatgcgcgagatgaagccctcggccacctgcagggctgcctgccgctccttctcattcgcttttcgccctagatcataggaaggagatttttaaaaagagcagggaccctctttagctgccatcccatttttcttgaggaaatttaagggagtccacagaagagccagcaatttttacaataaatggaccaggggtcccaagaatgccgaggggctctttggagatgtggagtcagtcccttaagaattttcccaaaccggcagcaccaaggtagatgaaaacccctcgtctgcccgggtctgatcatgcaaaactctgctctgacctgggcccctggaatatttcagggaggggaacaggtgttcaccctagcatcagactgtgaggccgcaggtctccttttcctctaggacccctcacctcttgaattcatcaagccttttctgaaaaactaaataagacaaagggtacaatttattatagaggtgatttactcccataatgccagcagggctacactggcctaacagttatgctaactaagcacttacaaaaatgaagaccccacgtaatccagtcatttctgctagcagtcctgagaactcaaactgctcattccaggcttttttatttttattttttctgagacgcagtctcgttctgtcgcccgggctggagtgcagcggcaccaacacggctcactacagcctcaacctcccaggctcaagcaatctgcccacctcagcctctcgtgtagctgggaccacaggtgcacgccaccacactcagctaattttggggggttttttttttgtagagaagtgatatttcgccatgttgcccaggctgccagacatttttccaaggaaatgataccgaaacgatgccgtgatgtggttggctctctaggcaggctataaaatgccatgaactacaatgtatctgaaattaatatgctggattccttcctctgtcaactgaccagctgcccccctacccatgagatccttctcttcctggcctcccaagtttcctgtttttcctctgatttctctttccatagttgttgggttccttgctccggtttatacatgcttctgtgggcctctgtgaacccccctctgcttggcattggttccatgggatatgtgccctctggcaggagagaaaaggcagccctgcagcacacgcctctcgctttccactcttttgctgctcccagctcctccctttcacttctatccctgctgagtttcagaagcaatactatgaaatgcctggtagcagctatctgtagatacccacctacttgtctgccttcctgaccaggctaggggctggcattttctccaccttggttgaccccacaactgggtgttgagcaaatgctattgctgaaaattctcagaccccaggcagagactgagaacaagtttgtttcattttcagtcaaaccaagcagaacaggctctgcccaacagtgtttctatttccagaagatagaatcttttggaaaaacaagttctacaggttcaccactcactgcataaaatgatgtttaatttgtctaaaattcatttctgtcaaaccttgagacagaatcccaggatcaggggtcccagaagccccaaaggtctagagctgggctagggcagtggttctcaaagtgtgatccctggaaccagcagcacagacataacccataaccttgttagagatgcatgttctgccccactccagacctagtgaatcagaatctatgggggtggagcccagccatctaaacaggccgtggggtgattctgaggcttgctgtagtttcagagccattgtctagaatttaggaggtgggaacagcaaagagaaaatggcgaggcagtggctcacatctgtaatcccagcactttgggaggccgaggccggtgcatcacttgaggtcagaagttcgagaccagcctggtagtgaaaccccatctctactaaaaatacaaaaattagccaggtgtggtggcacgcacctgtactcccagctactcgggaggctaaggcaggagaattgcttgaacccaggaggcagaggttgcagtgagccaagatcgtgccactgcactccagcctgggtaacagagcaagattccttctcaaaaagaaagaaagaaagaaagaaagaaaatagcaaggcctat

SEQ ID NO: 12577 - DNA, 14399 bp, Homo sapiens
gttttctatctatcctgccccttctatccttcatatcacaatggagcacaaattataattaagagatacaaaagcattcagtcacttccatttttttctttagatacttactatattaagtcttaaatgaacatattggcattccaaattattaagataatgtcatgctggtcattgaaatgctaaattaacatgaagactacatttcaaaaatacaaaagtataaataggagtgttttgtatattcataccacgatttttgcccttagaggaactctgaagtacattgttatatgtctgactaatgtattcaaccctggaatttttggggaagcatttgtttttttctgaaatatactgtcccactaaagtatcaaattgggcatacatgatgacatgaaaagcatttcccaaaccatagttaatttaagtaaaatgaacttaatattatacagccttaactagaaatgagatgtcttgccacactaccagttctgtcaatagaagttgagtgaatagatttatatctattaactagaaaaaagtataggcataaattaacatgtcatctgatgtgagcagattgagaaagccaacaaatttctagttattcaatttaaaggacactgaagtaccacaatgtatacattcaatttgactacataataatagctgctatttacttagcacttcttcatctacatattctgtaatcttcattactatcctgtattagtccattctgacactgctataaagatactatctgagactgggtaatttatacggaaaggaggtttaattgactcacagttctgcatggctggggaggcctcaggaaacttatgatcatggtggaaggggcaggggaagcaagacacgtctcacctggcagcaggagagagaaagagcacaagggaaactgccacatttaaaccatcaactctcctgagaactccctatcacaagaacagcatggaaaaaacccccccatgatccaactgcctcccaccaggtccctcccccaaaacatgcgggttacaattcaagattagatttgggtggggacacagagccaaaccatattattttgcacttgctccctctcaaatcccatgtctttttacattttaaaaccaattatgccttcacaacagtcccccaaagtcttattacagcattaactcaaaagtccaagaccaaagtctcatctgagacatggcaagtcccttccacgtatgagcctataaaatcaaaagcaagttagttacttccaagatacaatgagggaacaggcattgggtaaatgttcctgttccaaatgggagaaactggtcaaaccaagggccacaggccccatgaaatctgaaacccagctgggcagcccttaaatctaaaagctccaaaatctcctttgactccatgtctcacattcagggcacactgaagtaaggggtgggctttcatacccttgggcagctccgcccctgtggctcagcagggtacccctgtggctttcacaggctggcattctgtggcttttccagacgtatactgcaaactgtcggtgaatctacctttctggggcctggaggacagaggccctcttctcacagctccactaggtagtgccccagtggggactctgtatgagggatccaaccccatatttcccttccgcattgccctagcagaggttctccatgaaggctctgcctccatggcagacttctgcctggacatccaggcgtttctatacatcctcttaaatataggcacaggttcccaaacctcaactcttgtcttctgcgcacctgcaggcccaacaccacgtgaaagctgccaaagcttggggcttgcaccctctgaagcaatggtgcgagctgtaacttggccccttacagccacagctggagctggagcatcagggatgcagggcaccatgtcgtgaggctgtacagagcagcaaggccctgagcaggaaaccatttttccctcctagttctcaggcctgtgatgggaggggctgccccgaagatctctgccatgccctggagacattttctccattgtcttggttattaacatttggctccttgttacttattacttattactttttacttattattacttattactccttgttacttattcagatttctgcagctggcttgaattcctccccagaaaatggggttttcttttctactacatggtcaggctgcaaattttccaaacctttatgttctgcttcacttctaaacctaagttccaatttcagaccatatcttcgtgaatgcacatgactgaacgctttcagaatcagccaagtcaccactaggatgctttgctgcttagaaattttcttctgccaaataccctaaatcatctcaaagttcatcagttctctagggcaggggtaaaatgctgccagtctttttgctaaagcatagcaaaaataacctttgctccagttcccaataagttcctcatctctgggaccatttcagcctggacttcattgtccacgtcactatcagcattttggtcaaaagtattcaaaacaagtctctaggacgttccaaactttcctatatcttccagttttcttctgagccctccaaactgttctaaccactgcctgttacccagttccaaagtcacttccgcattttcagattatctttatagcagtacccaaccctgccagtaccaattctctgtattagtcagtttttacactactataaagaatatctgagactgggtaatttataagggaggtttaatttactcatagttctgcatagctggggaggcctcaagaaacatacaatcatggcagaaggcaaagaggaagcaaggaaagtcttacatggtggcaggagagagagaaagcacaggggaaactgccatatttaaaccatcagatgttttgcgatctcccacactatcacgagaacagcatggaggaaatcacttccatgatccaaacacctcacaccaggtccctccctcaatatatggggattacaattcaagataagatttgggtggggacacagagccaaaccatatcacatcctgaaagtaggtatctctaatcccatttgacagatgcagaaactaggactcagaaatgttagagaattggtcccagaacactatattatacatttattaagaggcaaaatctaaatttgcattcaagattccaagtctactgctgctttatttttttgcacatgccaatagtaaaagcttggttttcaaactgtatcacagattaagatagattaaattagaacaatattataataattagaggatgttagaactcctctatttcacagaaataaaggttaaatgatacccaaagtaacaggtatcataggtaagaaattaacacctttttttaaataccaatactcatgtattattcctttaccctgcattctccagatacagataaaagggctgactacattttttttaaatatgtgaattgttctaaaattcaatacttttctacattctggtgagatcctcttggtaaattatataattaaatatcagtcaaaacatactaaaaaatgtattgtggtgctgcatataatgtatatgtactctgattttcacatatttgtctacatatacatttgtcaattcacaataacagagtgatgtgccaagtaaactatcgtgtagtttcacttttgaaaatttaacaatagaatataagttttgtttttcacagtctaagtaagtataggttactgtggttcattttagaacattcattagaaaagtaacgtgtctcttctaaaatgctatttgctaacattttagaaactgtatgttaaataaagaagaaacatttaaagcaagtgatgatgtaatttttgttttaaaattttagggatattctgcacaatgtaaaaatttcaagggcacacttagcactttttttgagaaagaataaatggtagctactgttgtagtgggagatgtgcaatgtggaagctttaaaattgataaacatttataagcaaaataatagtaaataatattttccttttttctaaaataattgtcagatttacaagtgaaatcaatactgtattctctcaaacttgttttaaaagctttgtcagagtttgtatcttcataaaagtattgcaaaaattaattttaacaaaccaaatccctcttgaaaagaatcaaaaggaataagaatgtgaatgtcagccataagaaagcatttttaaaactgtgttttcatataagcagttctgcatgcaggaaacagaaactgctgagtaccactgcagattggacactgctgttaacagctccaaagtctaagagaagtggaatctctgaaaataaaagtcattacttaaaattttaattaccaacataatttttagagttgtcactttcaacaaaatcatccctgaaaaaacttcacaagtaaaaatagttaaatacaacaacaaagaattgcaggggatagaaagaatcgatattgttaaaatcgccatactgcccaaagcaattagcgggttcagtgctattgctctcaaaataccaatgacattcatcacagaattagaaaaaaactattttaaaattcatatagaatcaaaaaagggcacaaatagccaaagcaatcctaagccaaaagaacaaagctggaggcaccgtattacccgacttcaaactactacaaggctaaagtaaccaaaacagcatggtattggtacaaaacagacacatagaccaatgcaacagaatagagcccagaaataagaccacacacttaaaaccatccaatcttcaacaaagtcaacaaaaacaagtaatggggaaaggactccctattcaataaatggtgctgggataccatctcacaccagtcagaacagctattattaaaaagtcagaaaataatagatcctggtgaggttgcagagaaagggaaatgcttatacactcctggtggaagtgtaaattaatccagccattgtggaaagcagtttgatgatttctcaaagaacttaaaacagaactaccattcgacccagcaatcccatcactgggtatatacccagaggaatataaatgattctaccataaagacgcatgcatgtgtatgttcactgcagtactactcacaatagcaaagacatagaatcaacctaaaagcccatcaacagaagactgcataaagaaaatgtggtacatatacaccatggaattctacacagcgataaaaagaatgaaatcatgtcctttgcggcaacatggatggagctggcagccattatcctaagcaaactaacacaggaatagaaaaccaaataccacatgttcttctcagttataactaggaactaaacattgagtacacagggacacaaagaagggaaggacagacactggggcctacttgagggtgggaagagaatgaagactaaaaacctatccatcaagtactgtgtttatttcctgggtgatgaaataatctgtacagcaaacccctgtggcacaaaatttgcctatataacaaacctgcacatgtacctctgaacctaaaataaaagtttaacaaaaaagaattgcagggttttttggggagtgggcaggggagaaaaggaaccaataaaacaatgattatgacaaaacctttatccatagtttaaaattagaacacaaaacatctaaccacctgccaaaacatgaatcacaaaattgatattttaaggacaagtcattaatttgtagcataaatagctgacaaccttagactaaatgtgtcattgctgataaatgattcacatcttcaatactgaaagctgacaagcattcagaacattaaaacaatatatcacaacacagactgttaaatattaggtggacagtcagtgcatgagtttagctgtaccaggattattttaagaaagttcgggcactttgagtgtttttttttttttttaatccataactttctgtaagaaccacactgtggatcataacatctgagctataaggattaagagtgtaactggggcccgttgggtgggggggcgggacagcattaggaaaaatagctaacgcatgccgggcttaatacctgatgagttgataggtacagcaaaccaccatgrccacatgtttacctatgtaacctgcamatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgatggcgtgagtttacgggtgcagagaaccactgcaagacttcgcctaaagaaaatttttagtggtatctttgtaaaagttaccccctagaatctaaaaatgctgcatatagtggaaccttatgtgacctggggatttccaaatctgaagtctgtccgagaactcattttgaaacgtggacaagccaaggtcaagaataagaccatccctctgacagacaacacagtgattgaggagcacctggggaagtttggcttcatttgcttggaagacctcattcatgaaattgccttcccagggaagcatttccaggagatctcatggttcttgcgccctttccacctctcagtggcccatcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaaagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagactgcagtgagccaagattgcgccagtgcactccagctgggcgacagagcgagactccatctcaaaaaacaaacaaacaaacaaacaaacaaacaaaaaactattgctgcagtcattcagatggaaatggggaaagaataatattaataactgatttcaaaaaggacttgaagatgtgaatcatctattttgctgaagaaatcttaactttttgaaattactttttattgctgttgtcatactcttaggtgacaaactgcggtaaattttttatcagtgaagtggaagcatgcgttttgttgttttgggaatttttatcaagtatcttcagagaagattatttcctgctttatcttcaaaaactggaaaggaagggtcaaagaaaagacagtagctggccggtcgtggtggctcatgcctgtaatcccaacactttgggaggctgaggcaggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcttatgttcatgtcaagcacctctcatcacagtctagttccaaggaaaaattccagcgttttctacattgggtgctgtgtcatctgaaatcggcacattccatggaggaaggagtcctgctttgttgcatgtatcctagggtttaatgttggtaaatgagtcactctagcatttgtagaaggctccctgagactcctacagcagtcgaccaagcccaaggacataattgaatctggagagtcctggggccttgttttgataaagacttgaaatacacataggaagaaaggcataaaaataaatgttcacttgtctctgctgtgaaaaaaaaaaaaaagaattaagagtacagagagcaatagaaagagggagatcttttaaattacattggaagcagtaagttttcttagttagcctgaggaggaactctgtccctgtccctgcctcccaaaagggagcaaaagggtataaatagtttataagaagcatccacttgaaagtttaatttttctcacagtgcgaaaaagaataaaataataccagaaaaggttattatgatttctgaaatgtagcataaagccaaaacctgaaaagaagaagaaacactgaattagacaagggtatgcaatagagaacatgaggggttcacaccttcttgacactgcagggagtagctgaaatgactggttgacgctatttgtgggtcttggtttgaataggaggcaatttgattctctccctactagcatcaagaaatcacatcatacacagtacagtggtacatgccgaggcccttccagttgtaggctggccccatttttcattcatgtgggaaaggaaaactgaataaactcaatacagctatgatccccacactgaggaaaactctctgtaaccataaagcccaactcatgtttttacatctaatccgtagtctactctaagattattgttgtaaattcatctgctctaagattactgctgtaaattcatttagaattacatagctagatagaatgaaaaggtaatttgtcaaatgaagctaaattggaagatacttttacattataaaaactataactatttagacaatttagaaaacagcaaaaagtttaaattagaaaataaagtcgccattcttttgacagaaaaccagcaaacacttccatatatagcctgcatcttttaaaaaaactgcatctatttattttggggataacaatataaatggctaatttgcaccttgctttttatgtgtggtactattcatctgtatacttcacattttgataaaactcctatgtcaatagatattttacatgattctttagtagttgtaaagtatttggctgtaacttccattctcccgttattggtcattctttggtttttcactattataaataccactgtacacacctttgcaaatgtctgattatttccctaagttaaattcctagaagggactggaaagccgatggacaactttagggtttatcacatggatccttaaactgcctctccttacctgctccaggaaaagtaggcaaaacatggacacatgtatttccccatattcgcttctaacagaaaacaaatctggtgaactggctattgataaaatttgcctatttctctgttggggtgtttgtcttctcttgattagtaagaatgttttggatgttaagtacttaaacacttagtccattgaggacatagctataaagctctcattttgaatcaaaatttcaaatatttcaagtatgatgatataatctgtgatgttcagagccctggctgttgttcacatgataattcctttagccatatctctgtttgaagtgtatgtgagcttgaaaataaaatgaccagtcaaatgtagttctggttaaagatggtatatttaacacatgcttttatttcagctccctctcaaacccagtatatgtttttaaaagcatacacctctaagaataaagagaagagacaataccagcaacagttcacaagacagaaagcagatggacaaggattgttggcttcctaagatctgttaagtcaccagtggggaaagctaagaagcaacctaattattatgaaaaaaaattctgaaaggctcaaaaactgggggtaaaggtaggggttcaaaatcaggaagactggttcaaagtctgtttaagaacatttacaggtttctttttatagaaatggtaggtcagactatgagtgccaacctgcctgccaaaaaccaaagtgctagataaaaaatatttttaaaaaatatccaggccaggcgcggtagctcatgcctgtaatcccagcactttgggaggctaaagcaggcagatcacttgacgtgaggagttcaagtgaggagttcaagtccagcctgtcaacatggcgaaaccctgtttctattaaatacaaaaattagcgggtatggtggcatacctgtaatcctagctactcgggttgctgagacagggaaaagcttgaacccaggaggtggaggctgcagtgagccaagactgtgccgctgcactccagcctgggtgacagagtgagaccctgtctcaaaaaatacatacatacatatacatatatatatatacacacacgcacatgtgtgcgcacacacacatatatatctccttaaaagcaccatcaagctgacaaaatgataaagaattaggctaaatctaaaggaaagcatcccaagttacttgtgctcagagaataacagatttaggcaaatttggatttcaactaaaaggacagaaaactagaaaaatggacaaaaaaacttatactttacaatacaggaactccaaatggccaataaacatatgaaaagttactcagcttaattagtaatcagggaaatgcaaattaaaacgacaataaaataacttacatacccatcagactgacaaaaattaaacatttgacaataagatgtgtcctgagtttaaggatgtaatcattttggaagacagtttggtattatccagtaaagtcaaagacaagaatgtcctatgatgtagcaactccatcaatagatatgtattcaaaaagaaatttatacttgtaaataaattaatgtgcatatacagtaaaatgtgtaagaatgttggcagcagcatttttttggttaaataaaaactacaaactagtcaaatgttcataatagtggaatgatttataaacatccatatatcttatctctgaggatataattctatacagcaatgaataaacgacagctgtacactacaacatgaatgaatcctacaatgttgaatgaaaaaagcaagatgcaaaatgacatatataatattctattcacataaaattcatatacatatgatattctattaacatggaattcaaaatatacaaactgagttatattgtttaaggatgtttatataggtagtaagaaaaacaagaaaacaacgatcacatttgtcagggcagtggttacctctggggaggaggaacaaaataggatttgtaaacttatatggtcatactggaggcctccaaggtattggcaatattctatttcttgccctggttggtaattacacactgctagctttattattattatttttcattaaattgtatgtatggtcatgcacgacataaatttcagtcaatgatggacagcatttatagtgatggtcccataaaattataatggagctgaaaaagtcctatcacttagctgcagctgtgcattgtaatacaacaccatgcttatgtttgtggtgatgctggtataaacaaacctaccgtgctaccagttatagaaaagtacagcaaatacaactgtgtacagtacataatactcgataatgataataaatgactatgttggtggtttatgtatttactgtattatacttttttcattattttagagtgtacttcttgtccttttttttttttgttaactgtcaaacactctcagccaggtctttcagtaggtatatcagaaaaaggcactgttatcacagaaaacgacagctctgtgtttgttattgcccctgaaggccttccagtgggataacatgtgaaggttgaacactgatgacactgactttgtataggcctaggttaatgtgtgtgtttgtgtattagtttttagtaacagttttaaaaataaaaacatcttaaaaatggaaaaaagcttacagaagaaggacataaaattttctttacagctgtacaatgtgtgtgttttaagctaagtgttactaaaaaggagtcaaaatgttaaaaaaattaaaagtttacaaagtaaaaaagttacagtaggctaaggttaatttattattgaagaaaatttttctataaatttagtgtagcctaagtctacagagtttacactacagtagacttcatataataaatgtcctaggccttcacattcactcactactcaatgactcacagcaacttccaatcctggaagccctattcacagtaagcacctatacaggtgtactatttttttcctcttttatattgtatttttattgtaccttttctatgtttagatacataaatacttaccgatgtattagaggtgcctgcagtgttcagtacagtaacatgctgtaagtttgtggcctggaagcaacagctataccatatggtccaggtgtactgtaggacataccattcagatttgtgtaagttcactctatgatgtctgcacaatgatgacatcgcctaatgatgcatttctcagaacctatctctgttgttaagcaatacatgactgcatatttgttttgttcattctcatgtacatatgcttgtttcacagtaaaaaaaaatgtaactcaaaataaaaaatagaaaaagaaacagatagcatgacctcccctactccagtctttgatgatttcttaccttttgttgtctacattttctctttctagaactcctaagctggttctctaattctcttatcttctcccctattttacattgctgtctttttgctcttatttctgggatattttcttacttttatctttcaatccttcaactgagcttttcatttatgttatcatccttttaactttcaagagtttagttttattctctgaatgttccctttttcaaaatcctttaatttgataaatgcattatttttcttatttctgaggatataagtaataggtttgagggaagtttccttatccaagatgactgctctgttgtttgttctgatctctgtcctgaagctagaagctctccccttcctttcaccctatccttctcctccttccttctaggctgagggttggtggggctccggactaaaggattccagacacagctgagagtagaaatatcttaaaaacaaaaggaagtttaagtgagccattacataccaaattattaatggcattcattcagttgaagaacacagagaaaaagaagaatgaagaaaaattaacagaacttcatggacctgagagacagtatcaaatggccttacatatgaatggagtcccagaaggggaagacaatgaaaattcaagagaaagataatgaagacataatgactagaattagttaatttagcatggtcacaggacacaatatttttaaaacattctatatatgcgacaaacaattggaaaataaaatttatattaatataatttaataactagcaaaacacatatacacaatagatatgggacaaaagatgtgcaagagctttacaggaaaaatgagaaaatattgctgaaaggaactaaagatctgaaaatattgttgaaataaactaaatatctgactaaatggagagatatacagtgttcctggattggaagactcaatatagactcaatccccaaattgaagtctcttatacccaaattgatttaatttcaatgcaataccaatcataatcccagcaggctttttttgtgtgtgtatagaaattgacaggctgactctaaaatttatagggaatacaaaggacctggaagaaccttagactttggccctgccttctggggaagggttagttatctctttaaagatgattttttttttttttttttttttttgagacagagtctcgctctgtcgcccaggctggagtccaatggcacaatcttggctcactgcaacctccgcctcctgggttgaagagattcccctgcctcagcctcccgagtagctgggattacaggtgcgcgccaccacgcccagctattttttgtatttttagtagagacagggtttcaccatgttggccaggctggtcttgaactcctgacctcgtgatccgc

SEQ ID NO: 12578 - DNA, 88144 bp, Homo sapiens
ctaattttttgtatttttagtagagacggggtttcaccttgttagccagaatggtctcgatctcctgacctcgtgatctgcccgcctcggcctctcaaagtgctgggattacagacgtgagccaccatgcccagccgattatagtatatttttctacttttcaatggcaagtgtgaaactgtataacttaagttccttctattcaacctaaggaatttagcaagattctcttcattattttttaatatttcaaaaacttcttgagttctagtcttgtacattattctttccaatctagatttaagttgttatagcccatgaaacttcttgacttttgattgagcaaagaatttccagagttattgatgaagaattaacatttctataatgttaatgcttcccctccaggaatacggtagcgtctgtttttgtttttgttttcttcaggtcttcttttagatttttcagtaaagttttatagctttttgatgcaggttttgacatttcttattaagtttattcccagctgttttataatttttgtagtgagagtgagttgaatcttttttccctcattacattttccagctttttattactggtcgtgtttacatgcctgcatcctaacaccggggaactgacttgaaatgggcctttctccccgcagagacgcaccaagaatgaggtttaaaagagaatggaagaaggatgtatgtggggctttttatttttgttttttaattgacacatatttagggagtacaatttgatatttcaatatatatttatgttgcacaatggtccaagcagggtagttaatatatccatcagctcatgcatgtaccatttctttgttgtgggaactttcaaaagtctctcttctaggtattttgtaacatacaatatattgctgtcaaccatagtcaccctgctgtgcaatagaacaacataatttttttttttgagacagaatctcgctgtgtcacccaggctggagtgcagtggtgtgatctcagctcaccaggttgctctgcctcctgggttcgagcgattctcctgcctcagcctcccaagcagctgggactataggcacccgccgccatgcccagctaatttttgtatttttagtagaaatggggtttcaccatgttggccaggctgcactcaagctcctgacctcaagtgagtcacccacctcagtctcccaaagtgctgggattacaagcgtgagccactgcacctggtcaaaacaccagaatttattcatcttatctaataataactttgtacctgttgaccaacctctgcccatcctcctctccccgatcctctccccagtctctggtaactactgttctactctctgcttctatgatatcaactcttttttgtttttgagattccacatatgactgagatcatgtggtatttgtctttctgtttctggtttatttcccttaactttatgtcctccaggttcattcatgttgtcttaagtgacaggatttcattcttttttatggccgaatattattccattgcatatatgtaccacattttctttatccattcacctgttggtggacacctaagttgattctgtatctggctattgtgaatagtcattcaataaaaatgggagtgcagataactcttccacatactgatttcatttcctttggatatataccggtagtaggattgctggtagttctattttcaatttattgagaaacctccatactgttctccatagttgactatactaacttactaccccaccaacagtatgaaagtattcccttttctccacatctttgccaacttgtcttcttttgtctttttgattaaagccattctaactgaattgaaggggtatctcattgggcttttgatttgaatttccctgatgatgagtgatgttgaactttttttcccctccctccctccctcccttccttctctttcttttttcgagacagggtctcactctgtcacccaggccaaagtgcaatggcacgatcctggctcattgcagcctcaaactcctgggctcaagtgatcctcccaccccagcctcccaagaagctgagatgacaagtgtgcacaaccatgcctggctaattttttgtttttttagagacagtggtcttgccatgttaaccaggctggccttgaactcctggactcaagtgatcttcccacctcggcctaccaaagtgctgggattacaggtgtgagccaaggtgcctggcgagatttttcccatatacctgttggtcatttaaatgttttcttttgagaaatgtctattcaggttttttgccctctcctaaccttttattttatctatctatctatctgtctgtctgtctgtctgtctatctatctatctatctgtctatccatccatccatccatccatccatccatctatttcgagatggagtctcgctctgtcacccaggctgtagtgcaatggcacgatctcggcttactgcaacctccacctcccaggttcaagcgattctcctgcctcagcctccagagtagctgggactacaggtgcgtgccaccacgcccggctaatttttttttgtatttttagtagagatggggtttcaccattttagccaggatcatctcaatcccctgatctcgtgatccgcctgcctcggcctcccaaagtgctgagattacaggcgtgagccgtcgtgcctggtcacctttttttttttttttttttttttaaagacagggtcttgctttgttgcccaggctagagtgcaatgtgcaatcatagctcactgcagcctcaaactcctgggctcaagtgatccttccacctcagctttccagggagctgggactacaggtgtgtgccaccacgtctgtctaatttttaaattttttttgtaaagacggggtcttgcttcttgctatgttgcccaggcttgtcttgaactccagttctctgatttttaaaaaaaatcataagtagatgttgaattttatcaaatgctttttctgcatctattgaaataattatgtagtgtttttccccttaagtttgttaaggttgggtttctaattttaaaccatatttgcattcttaggataaaactcaactcggttgtgatagatcatatactgcaggattcagtttatttgtctagaattttaaaacttatttccacatcttgtgtcatacttttcttggctcatcatagtagatatattagtctagtaaaataagtttggagacatttatttcttttctgtgtatgattggaattgcctactcattaaagatttggtagaagtcatccataaagccctcttggtctgtttctctctctctctctctctctctctctgtgtgcgtgtgtgtctgtgtgtgtctgcgtgtctgtgtctgtgtgtaggaggatgggtagctttttaaatacatagtcaatttcattgtggttacagggattttctgtttctaaagtcggttttggtaagctgtactttcctaggaatgtattccttttgcttatgttttcaaatttactgacacacagtgcataataaaaccttttcatgagtaacataatttacttttctcttttctctttatatccagcttgttagagggttggcttttgtttttcagcttttcaaagaagcaggtttaaaattttctcaatcctctccatcatttgtttctatttcattaagttttattcatccttatttttctttcttctacttttgcaggcttactctgtcatttctttatggcttcttgaattggatgttcagcgtgatgacttttggactgctttagccgcatctctatacttcagcatcgcacacccaatggcttactcaacatctccactttcacaccactgggcaccccaagcttaatacagccaaagcagaactcttgatctgcacctctgaaaatgtacttttcctgtagttctccccactatggtgaaaagcacccttatttccccagttgctcaggccccaatctcaggaatcatccttgtttcttcccttgctctatgccctacatccaatccttttgttcagttctgaaaacatatcttgaatctcacaacttctcagagctgcactgctgccaccctagttaaagctaccatcaactctttctcctagactgttccagggccttgcaactagccttgtgctgtagttttgtttcatcacgtccagttctccactctacacctgcaacatagatcagacagctcctggctcaaaatcctctgagggcttctcatcttagaataaactctcggttctggccgggtgcggtggcttacgcctgtagtcccagcactttgggagtccgaggcgggcggatcacttgaactcaggagtttgagaccagcctgggcaacatggtgaactcccatctctatcaaaaatacaaaaacttagccaggcgtggtggttcgcatctgtggtcccagctacttaggacgctgaggagggaggatcgcttgagctcagggtggacgttgcagtgagccaagattgcgccactgcactgcagcctgggtgacagaatgagaccccatccccaccccccccaaaaaagaatgaactcccagttctcatagtggccccagctgcctttccaatcacattccctaccactctccagcaacactgacttcctcgttagtccccaacatgccaggcatagtctctcctcatgtcctttgaacttgcctggaatgttctttccccagatattcatatgagggagtaaaatgagggtgaaaaccagcagatatctaaatagcacccccttcacttagtttatctttctcaaagcccttatcactatgtgaaatgatatattatacttatttgtatgctagtatgaatcttcccggcaagaatgttagtttgctgtctgttcagtaccgtgcatccagagcctggaagagtgcctggcacatagcaggtagtcaataaatgaatgggggcaagcagccaaatcagaatcaggttttcttgctaagcatagaactaacagaaggatcattgaatggattggataatgactggcatcagggtaaggtccccttaacaaacactcctgtcctgaacacctggttagctaacagttttctcatactcttattttcccaaaacacaattgctggatctcagctccaaatcaactcttctaggaaagtgaaaaattgctggatctcagctcccaaatcatatcttccaggcagagctaacattgccccttattcacacctccaccaaaccatctgatccaacagtgacaggtgtcacgaggccttggcatgcactctcttcccccgccagagttctgcgaaagccagggttgcgatttgttgtcagtttattccccgcctctatgagagtgtgagcactgggcaggctcggatgaaataatgcattgagtaggcctctgaaaccaaggcccctcagctggggcaacgtcaggctccagggtgggcaactttgctgcttctgccgaagatagtgatattgagaaaatgtgggtgcaatgaaacgcttattgcagcgcactcggtgcatctgtggacagagggtcaatcgcccctcagagcagcgcaaacaggcgtcccaagcctaggccttcacttgccccagcatccgcaagggtccattaatccttaacattcaaattccgcccactaaaccagtccctccgcgcccaagccgcctcttttccccaaacgacggccgaaagcagccaatcaacagctggaggggtccgcccccttttccctggccgaaatggacaggaaatctcgccaattgacggcatcgccgctgagacctcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttyacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtattttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctytggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttwtagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattcttttgctttcatacttaggaaatccttttttactctttttttttttttttttttttttttttgagacggagtctcgctctgtcgcccaggttggagtgcaatggcgtgatcttggctcactgcaagctccatctcccgggttcattccattctcctgcctcagcctcccgagtagctgggactacaggcgcccgccaccacgcctggctaatttttttgtatttttagtagagacagggtttcaccatgttagccaggctggtctcgatctcctgaccttgtgatccgcccgtctctgcctcccaaagtgctgggattacaggcgtgagccaccgcgccccgccaggaaatcctttcctactcttaacaacagatcaatagtcatctatattttcttcctaaaaaacctgatgatgtattatattcatacatacgtatttaatacatacaaaagggccagatgcggtggctcatgcctgtaatcccagcactttgggaggctgaggcgggtggatcacctgaggtcaagagttcaagaccagcctggccaagatggtgaaatcccgtctctactaaaaatacaaaaattagccaggcgtggtggcgggcacctgtaatctcaactactggggtgactgaggcaggagaatcgcttgaacccaggaggcagaagtttcggtgagccaagatcacgccactgcactcctgcctgggcgatagagtgaggctctgtctcaaaaataaaaaataaaaataataattttatagttaagttgccctgtgtttttcctgtgattaaaaaaaaaaatacctgttttgtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacacctgataaaaatagaggggccaggcatggtggctcatgcctgtagtcccagctactcgggaggatgaggtgagaggatcccatgagcccaggagttttaggctacagtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccagtactttgggaggccgaggtgggtggatcacctgaggtcaggagttcgagaccagcctagccaacatgacgaaacatcatttctactaaaaatacaaaaattagctgggcttggtggtatgcacctgtaatccagctactcgggaggctgaggcagaagaatcgtttgaacccaggaggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtyccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttctttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatctacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtaytgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtcaggagtttgagaccagcctgaccaacatggtgaaatcctgtctctactaaaaatacaaaaatcagccgggcatggtggtgggcgcctgtaatcccagctactccggaggctgaggcaggagaatcacttgaacccggaaggtagaggttgcagtgagccaagatcacaccattgcactccagcctgggcgacagagcgagactctgtctcaaaaaaaaaaaaaaaaatccacattttcttcaatgacaattgtaagcaacagatcatggtagtattagaatagcagtgactgtcaccagtagagatcaaagatactttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatattgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttyccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgtttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacrgtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaattttttttttgagatggagtctcactctgtcgcccaggctggagtgcagtgatgtgatctcggctcactgaaacctctgcctcccgggttcaagcaattctcgtgcctcagcctcctgagtagctgggactacaggcgcacaccagtgcactgggctaatttttgtatttttagtagaggcggggtttcaccatgttggccaggctggtcttaaactcctgacctcaggtgatctgcctgccttggcctcccaaagtgctgggattacaggtgtgagctaccatgccaagcccacatttctctgtaaattttaaacagtattttagtccatatgtcagttcccctctktttaagataaggatattaataaccctacttttccttccactttccctccttaacttctgcgtcttaaaagctgtacttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttcacatggtttactccctcgttttctggactgcatccttaaataatgtgctcagatagagtgcatggggagtaaactgtagtggataccgttgtcacctaccccatatccatttcttctttgcccattcctaacagaatcctgatattattcacctttctaccttattcccaacttcagaaaggatccttaagtcattccacacattgcattcctttggcaactgttactggtcaaggatggacatacgatctaagttggttcactcagactgaagggaaggacttccatggcacgttcagggaagactttctctttttctctcactggagtaagtgagaaaggtgttgctgggggctcttctgtaacctcagactgagggacaaagcctgaggataaagcctgctcaccaaggaaggcggagcagagaaacgggaagaacctgggtcttgatgccgttgcttagctggtgattgcactgtggctggggcctgtcctacctgagctagggactcagataggatggactttcttactgaatgagccagcttcagttttcttttctgttacttgtaaccaaaagcattgtaacagataggtcttctgagtcactgcatgcctgaaatacctttcttctactcttacacttgattggctgagtatagggttccaagttgaaaatcattttttctcctaactttggaggcatctcttctagtatgcagagtaacaaatgcaacaaatgcctgatgccaatcttattatggttcttttgtaggtgcccttcttttctcttccttccctggaagtttttaggatttcgtctccttatttttagtgtcctgaaatctcatgagaatatgtctagagttgtgtcttgttcactcgttgtactgtggtcattcaatctgaatacttttgtcaactcttttttttaaaaaaaaattactaatttacatgctttcattttctctatggggactactgtttaactttggacctcttatattggtcttctgtcttctctcatatttttcatttattgggcggtggggggtgctctgaattttggaagatctcctgcatttattttctttttccttttttctttttttttgaggcagagtcttgctctgtcacccaggctggagtgcagtagcctgatctcggctcactgcaacctctgccttccaggttcaagcaattctgcctctgcctcccacgtagctgggattacagacctgcaccaccacgcccggctaatttttgtatttttaatagagatggggtttcaccatgttgccaggctggtctcgaactcctgacctcaagtgatccgcccgcctcagcctcccaaagtggtgtgagccaccgcacccagcctcctgactttattttctatcccttctgttaaattctttatttcagccaaacctttttttttttttttttaacttactgtgaagcctgtgtgcctactgcctagattagacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctccaaagcaattaagatttatacattgcatttgaatatgcttcctttgtctcttatttatttatttattttattttgagacagagtctcgctgtctcccaggctggagtgcagtggtgtgatctcagctcactgcaacctccgccttccaggttcaagcgattctcctgcctcagcctcccaaatagctgggattacaggtacgcaccaccacgcccagctaacttttttgtatttttagtagagacagggtttctactaaaccatgttggccaggctggttttgaactcctgacctcaagtgatctgcccgcctcggcctcccaaagttctaggattataggcgtgagccacyatgcccagcccctttgtctcttttaacaagaacagcctacccacctctccttcacttgtgatactgactttttgaagcagtcagcccaattgtcatctagaagggcccacattttaagatacatatttttagagatggcgtgtcactatgttgcctaggctggccttgaactcctggcctcaagtaatcctcctgcctcagcctcccaggtagctgggactacaggcttgtgccaccacgactagctggcccacattttagatgtctctcttttcttgtgatataatttaacttgtttgtccatatatattacttgtagrcaagaagttaggtctacaggcatgttcaggttaaacattttgggcaagaatatttcataggcagtactgtgtacttcatatagcatcagctcaccaggcacttaatggttggttaccctgtggtttgtgatgctacgttttaacacttgattaaagaaggaggtgactgccaaatctccccattgtagacatacagttttcctgtggtaattgatatataatctgtgatgtgatgctttggcaccatacaaatatcctattgcccaacagccatttgcataattattttagcattcattgatccttgcctgaaaccattattacattgggggttgcaaaatgatagtttttttaattgtcacctcttctacatttagtactgtcattcctctgtaatgaattttccctcatcaaataaggaggcattatatttcctcctaaaaagacagtatagatgcttaatctttgcctttattacatttcagagtaaggagttggtagaataatcacctcaaatggtggcaaaatatttgctgttgtgtttccttttctctttcatgtcaatatggactcatagggatttatttattaaatgttttacaattcaaattgggtcaacaagagtcccttcatgttggttcctatattctcctggcataccctcattaattagtctttgagcaatttcttgttttctggcacaagatattccatcccaatatgtgcttttcgtgtcctagaactgattccaaggagctctggttccttatagtggcaacggtatttagaatccaacatgtgggtactaaatgtgctgattcttactggggtaacattatatctaggcactttcagaggacatcgctagaaaatatattcagtttttattttttatttttaatttttttgtagagacaaggtctcactatgttgcccaagctggtttcgaactgagctcaagcgatcctcccacctcagcctcccaaagtgctgggattacatctgtcagggcaaactgctggtaaatattttcacaaaagaaaaataaaaaaaccaaagtgctgggattacagatgtgagccactgtgccctccattttttttttaagtcataaatacataatgatgtcttctatggcaatttaacattacagggttcttccttaactttttttttttttttcttttttttgaggcagggtcttgctctattgcccaggctggagtggtgcagtggtacaatcctaattcactgcagcttcaaatgcctaggcttcaaacaatcctcctccctcagcctcccgagtagctaagactacaggtgcatatcaccatgcccagctaatttttaaaaattttttgtagagatggggggtctcgttgcgttgcccaggctggtctcgaactcctggcctcaagtgatcctcccatctcgatttcccaaagtgctgggattacaggtgtgagccaccatgcctggccaacttttatttgatctgtatatatcttttccttacactgaaaatgttgggtcttactaatgttaacatagttacttatttgctttatcttgtaatagacataaaattacaaaattataataccaatattacgataaatagctgggcatggcggcgctcgcctgtagtcccagctactcaggaagctgaggtggagggactgcttgaacctaagagtttgaagctgcagtgagctgtggttgtgccactgtactcctacccggacaacagagtgagtggggggaaaaaaaagaaataatggaagatccagagaaagccccaaatatttaaaaattaaacaatacactttgcagcttcctcacctctctcagccttcatagaattgaagagagttagggccttgcactagattaggctttgccttaaggaaatgttgtgtttgatttgatcttttatccagaccattaaaacttccttaacgtttattagtaataaggctatttcactttcatatcatttgtgtgttcactggagtagcacttttagtttccttcaagaactttgattcacaacttggctaactttggtacaagaggcctagcttttggcttctcggctttcaacatgcctctcactaagcctgatcatttggtttttggtttaaagagaaagacatatgactcttccttttacttgaatgcttagaggccattgtagggttattaattggcctaatttcagtactgtcttgtccaagggaatagggaggcccaaggagagagagagagatgggggaacagctgattggtggagtagtcagaatatacacatttatcacttaagttttgccatcttttctttttctttttcttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggccaggctggtctcgaattcctgacctcaagtgatccacccgccttggcctcccaaagtgcggggattacaggcgtaagccactgccgcctggccaagtttgccaccttttttattttttttattttttgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaaaatagaaaaattagccgggcagggtggcacgcacctttagtcccagctattcgggaggctgaggcaggtgaatccttgaaaccaagaggcggaggttgcagtaagctgagatcacgccaatgcattctagcctgggcaacagtgagacccagtwtccaaaaaaaaaaaaaaaaaaaaaaaagataataaaggagaaaaaccatatagtctattcaataaatacagaaaacgcatctgacaaaattcagtgccctttcatgataaaaattcagcagattagaaatagaggaagtgcatgtatgaaagagctacagatagattgtacttaattgtgaaatattgaacatgttaccccgaaaatcaggaaaaaggcaaagatgtccactctaaccacttctattcaacattatactagaggtcatagccagtataatgaggcaagaaaaaacataagaggcattaatatttaaaggaagtaaaactgtttctatttgtaggtaatgtcgaaaatgtgaaagaaactatcagaacctgctagaactaaaaagtgaattcagcaaggtctcagggtacgagatcattcaaaaactaatcagaaatgaaatttcaaatgcaatatcgttaggaataatttaataagaaatgtacaagatttacacgctgaaactgaaaatgttgctgaaagaaattaaagacctaaataaatggaatgttgtaccatgttcatcagctgaaagactaagtgtctttacagtgtcagttctcccttcattgaactgtagattcataaccccagtcataactgcagggttttttttgtagaaattgattgtaaaatgtatatggaagctgggcacggtggcttatgcctgtaaaccagcactttgggaggctgaggcagacagatgacttgaggtcaggaatttgagaccagcctggctaacatgacgaaaccccgtctctacaaaaaatacaaaaattagccagacatggtggcacacacctgtaatcccagctacttgggaggctgaggcatgagaatcacttgaacccggaggtggaggttgcagtgagccaagatcatgccactgcacgcccgcctgggcaacagagtgagactttgcctcaaataaataaataaataaaacgtatatggaaatgcaaaggacctagaacatccaaagtaaacttgaaagagaacaaaattaaggggcttatgtgatgtgactttatagtcatttgatttttaacagaggcaccagaacagtccggtgcgggaaaggaaagtcttttagcacgtgccggatgatggcaaatgacatccataccagacaaaaatgaaccttgaccttaccctaaatattagtttcttagagttgccacaaactaggtggcttaaaaccacagaaatttggctgggtgcggtggctgacgcctgtaatcccggcctttgggaggccgagtcgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgaacctgggaggttgcactgagccaagattgcaccactgcactccagcctgggtgacagagtgagactccgtctcaaaacaaaaccacagaaatttgctgtctcataattccagagtctagaagtccaaaatcaactgtcatcagggccatggtctctgtgaaacctgtaggggagtccttccttgcctcttcctagcttccagtggttggcaacctttggcattctttgatttgcagctgcattacttcaatatctgtcttcctcatcacacagcattctccatgtatgtctctgtctttacatggcctccttcttgtaagaacaacagtaatattggattggggcctgccctactccagtgtgacctcaccttaactaattacacctgcaacaacgctgtttccaactaaggtctcagtgtgaggtactgagggttaggacttcaacatatcttttttgggggacatagtccaacccatgacactacttcacaccatacataaaaattaattcatgagagattatagacctaaatgttttaaaagctaaaaatataaagcttctgcaagaaaacataggagaatatctgtgcagtccaaagaataaggttttttttaaacacaatttcactctgttgcccaggctggagtgcagtggtgcgatctcagctcactgcaacctctgcctcccgagttcaagcgattcccatgcctcagccttccaagtagstgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgygccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtstctgtgttgtctaggctggtcttgaactcctgggctcaagtgatcctcccacctctgccccccaaagtgctgggccaccacgcctggtgtggtgtcaccagagatgagccaccatgccctgcctgatactttwcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtgrtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaagcaaagaccttccaaataaggtcagagccacagggtctgggggttaagacatacacctaactattcggggctaccatcgaacccctgtagaagcctgtccatttccaggatagcagagcccaaggaagggccagaagtccccccaaaacagttgtttgcattcaccagattctaagctataagcagatgggcagtggcagtcggtcctaatccatataccattggcaacaatagtttagttcactgtagacataatgagatgcttatcttctgctaagtagtcctcatggtaacagccatattactcctggctttgagtgacagcgctgtgctcttgtctggtgcccatatacttcagcagctggaaacaagacagtgctcatgattcaccggaaagtttctgtagttaaaatcaagtgatcccttgagtctattctaatatttgtctgtaccatgttctgtgacgagacatggaaacaaaacattaagaagtgaaagtatctttgattatgctcttgaagacaactttttgtttgtttgttttgtttgagacggagtttcactcttgttgcccagsctggagtgcaatggtgtgatctcggctcactgcaacctccgcattcccgggttcaagcgattctcctgcctcagcctcccaagtagccaggattacaggcatgcaccaccacgcctggctaattttttttattttagtagagacggggtttcaccatgctagtcagactggtctcaaactcctgacctcaggtgatccgcctgcctctgcctcccaaagtgccgggattacaggtgtgagccaccgtgcctggccgaagacaactttttaaagatgcatatgctctgggctgggtgtggtggctcacacctgtaatcccagcactttgggaggccaaggcgggcagatcacctgaggtcaggggttcaagaccagcctggccaacatggtgaaacaccgtctctactaaaagtataaaaattagccgggtgtggtggcgggtgcctgtaatcacagctactcaggaggctgaggcaggagaatcgcttgaaccccagaggcggaggttgcagtgaattgagactgtgccactgcactccagcctgggcgacagagtgagacttggtctcaataaataaaataaaataaagatgcatatatgctctgaaggctggctacattttattttttctcaaacaacttttacagtggatagtgctgtaaaagttgtttagctctggtcattttatcttttttgtgatctgcaaaaggagatccttttccttttcactgcctctaatacccaactccaatactcctttgacctcacaggcacttagaatccatcagtggctccatcttttctcagacttcacctccttcgtatccttattcctctcctttgtagcttcagtgccagtcagacgtcgttactccctggcacactacctcagcccttcggcactttcttgctttgttatattcagtcgacaaagccccagcctcatgaaattcagtcatgtctgccccatgcctgctccgtcctgaagctgaatgtgactccttcattgattccccctttaagttcatgtctaccccaggtaaacttcttgccgccaagcccacctgcatactgcagttccccggtctctcctagcccctcccaccctcctcatcagctgtcacacctccttgcagctgatatcttagttcccagagagcacagaagcaagctcaagagagtgtctacaggccagcgtctactccttcgctctgcctccctcatgctgtcacggagcgcctgtcccaggccctcactcctgttctaaggcatctctccagtcctctactgcactctcccccatcagagattcctccctcgcctgccctagaaacttgttgctacttctcccaccttgacaaaagctgctcccaaccccccacctgtctagcatctctgttttcctttaccagcaagactccagtccctgtctccacaccctcttcaaccttctccagttgttcctttgctgccacagctctgccaagctgctccatgaggtctccagtgatgaccttcatgttgttaaatctgggagctgcttgtcacttcttttcccagagctgtcgtcgtcagttaaccccaatacccatacgagacaatcctttccctcccttgagtctctgcactgatgtgcaccttctcagtgcaaaccacagcttttgtctctttctagctgaatacatgactgactgtgcttatcttagctgtcacccctgctggagcagaagctccacaggacaggattgtctccttgattcacagatgtagctcaagctcctagaacagtgcctggtgtctgtgggtcctcaggaagtcctaggtgagtgtgtgaatgtctgtcctcctcggtcttttctgtttcgcatgtgatgttggaaggcctcaggttcaggcttttcttctccaccctcactcccgaagtgattccgtccagcctcatggctcccaaatttatgtctccaggctgactgggtcacgggaactccttatcctccctagaccttctctttccctggtcttctcctttccagtaaacagcaactccaactcctgctcctcaggccagaaacctggcgctggttacctcatttgttcacaaatactgttactccacctgcaagatggatacaaaatctcatgagttcccctgcctccayggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagcacagtttcccagtgcagctttgcgaaacaagagaaatgaattttaaaggctgtcaggtgcctttgcaatctgtggcttagtatttgtgtaacaacatttgtgttttgccaacagakgtactgcttaaagtacccatgagaatggcctctgtggttttctactttctcggatggaaccttaggaactgattattgagaagaggctgatactgcccacctcagctcccaggcaggcttcagggccttggttactactcctttgggccctcactgacccttgcagacgtcttttgcaacctctgtagccagaagagacaactgctttctggcatgttgctctttccctaatggctttatgagcttcttgaacaccaaagcatgtgtgacttcctcacgccttcccctgtatagtatagcacccctaactgtatgtgtaaggagaaggagtgagcaattgatggcgtccccctggatctccaagggaatgggaaggggcagggtttctggattcagtcatgtggaatctggtcgttggtgtctaaatgtgcctgttacttgtgcccaatgtccaggttcaccaggaggcttagcctgctcatttccctgctagtagctatattttgggagagcattttttatgctctaattgaactttgtgggtctcagcaatttgaacaatgttttgtttttcttctggtcaggttacaaaggaaagaaaaggaatctggtgttgtaggaggtggtgtgttgtgtaattacttgttttttttttttaagtttttttatatttttgcaacaaggcaagttttctttgaataaataatgctgggagcttatcacatagaaggcatatgtgttgtactcagtacattctgaattatctgggtttatttttatctcttgaattcacttataaacaattcaaaggctgcttttttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtccatgaccactgcagtggctttgtaaggatccaggacccagggcccctcagtgggtgtcttccatttctcaagattgcctcttggttgtgagatgacggttgctgctctagtcattgcatccactcctccaggtaggaagaaagaggtcataggggaaaggcaaaatggcacttgacatcttaacttctaggcccattcaatatttccatttccatcttcacacccatcatcttgtcctagggaacaaacagcaccagcagctcagtagctataacagcaattattatttctcacacatgggtctgggtcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacgtgagcaagcccagagtcagtgggtgggaggtgtgctccgcccatagtcagtagaacaagagcaagcttgaaagagaacgatgaacaggagtgcactcggccactgtctccttagccataacgtagtcccatggtctgctgggaagcggggaataactctccttagctgagcgcagggtctcattagtaaggcagatggagaacatggatgttgggggacaactggcagtgcctgccacaggggaatggatatattccctccccttgctctctggaaactaggggatggcgatgaagcctaggtttggccaaacccattctgccttcagggactttgactcttgagggacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtaycatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttcatacctgcacctgctcggtagcttgctaatgttctgcctgctccacacgccaggccagcctccacggcgcagccaggtgaggcctttccttgtatacaggcacgtttggattcactgttgcataagtgagacatgtgcatgcttcacaattcaggaagtgcaaactccagagtgatgcaaggtctgagtgtccctgctgccctggtctcccagctgcctaggcctctcttcagggaacggctgcatccagggtcttgtctgtgtcttttgaggtgttctatgtacacgcagacacatctaaacctatttttattttccctgcacctgcttgggctactgtaagctgttaaatttttttttctaggaatttgtccattttgtctgactagcataaagttgttcatgttatagtttatacatttgcaacatctgtaattatgtctgctttttcattcctagtgtttgttgtttacttgtaccttctcccgtttttccttgtcttggtaaaagctcattaggttcattggtcttacaagaagcagacatgtaggcattattgccctgtattactctgtgtctcttttctagttcattaaattctgcttttgcttttatctttattattttttctatggtcttagagtacattctctgtgttttgttgttgttgttgttgttgtttgttttttgttttgagagagagagtcttgctctgtcgcccaggctggagtgcagtagtgcaatctcagctcactgcaacctccacctcctgggttcaagtgattctcgtgcctcaacctcccgagtagctgagatttacaggcatttgccccacacccggcaaattttttgtatttttagtagagatggggttttggcatgttgaccaggcgggtctcgaactgctgacgccaggtgctccacccgccttggcctcccaaagtgctgggattacaggcatgagccaccacgcctggccctaacttcttaagttataaatttggttcattgatttttctacccttttttcaaatgtaaacatttaaggctaaccctctggaactacttcaactgtatctagcaagttctgatagtattgtcactttaagttagcccaaagatattttaaattttctttgtttcttcctttgactcacatattattttaaaatgtgtttttcaatttccaagcacatggctttgggtttgtttttttttttycctagttgctctagaaaaaaaaattgactgcatgaggtggctcatgcctgtaatcccagcactttgggaggccgaggcgggcagatcacctgaggtcaggagttcgagaccagcctggccaacatgccaaaacctcgtctctactaaaaatacaaaattagccgggcatggtggcacacacctgtagttccagctactcgggakgctgaggcaggagaatcacttgaaccgggaggcagtggtcacagtgagccaagattgtgccagtgtactccagcctgggcaacaagagcaatactccgtctcaaaaaaaaaaaagaaaaaaagaaaaaatcaacttctaactaaatggcactgtgatcaaagaacttggtctgtgtgacaccagttcttgcagttggttgagaagtgctccatgacacattatccacaaccagtggacagaatatgtcaccaccaagcatgggtgcaggattctacatatattcattacctctgtcttatccgtttgttgtgaaagtattttctcttcttactgtcattttgtttacttgatttatcaactgatggaatacgtgttaaaacctactgtggtgatggacacatcagtttctccacagagtttggtcattttcattttattatttattttgaggccacattttcagttttagatacagtttcacattcctggtgtattgaaccctttggtattatgaagcgaccatactaatatgttatttttttttaaattattatttattttatttatttttctttcttttttttttttttgagacagggtctccctctgtcacccagtctggagtgcagtggtgcaatctcagctcactgcaacctccgcctcctgggctcaagtggtcctcccacctcagcctcctgagtagctgggattacaggcttgcaccagcgcgcctggctaagtttttgtatttttagtagagacagggttttgccatgttgcccagactggtctcaaactcctgggctcaagcagttcaccagccttggcctctaaaagtgttgggattacaggtgtgagccaccacgcccggccatcccagttttttattttcctcctttctgtgtctttatgcatcagtgaggtggagcttttgaaaatgtcagatagctagattttttttttttgagacggagttttgctcttgttgcccaggctggagtgcaatggcgtgatctcggctcactgcaacctccacctcccaggttcaaaacaattctcctgccgcagcctcctgagtagctgggactacaggcacgtgccaccacacccggctaattttgtatttttagtagagatgtggtttcaccatgttggccaggctggtctcaaactcctcacctcagctgatcacccgcctcagcctcccaaagtgttggaattacagacgtgagccaccatgcccagctgatagctagattttttttttttttttttttttgagacggagtcttgctctgtcgcccaggctggagtgcggtggcgcgatctcggctcactgcaagctccgccccccgggttcatgccattctcctgcttcagcctccagagtagctgggactacaggtgcccgccaccacgcgtggctgattttttttttttttttttttttgkatttttagtagagacggggtttcaccgtgtcagccaggatggtctcgatctcctgacctcgtgatccgcccgcctcagcctcccaaagtgctgggattacaggcgtgagccaccgcacccggcctcgagattttttaaaaaatccattgtctgtttcgtcctttaacatctatttgatttctgatgtatttagattcatttatagcatatttgtgcattctatttttccatattttctgttcttttaaattttccttctcctttcttgccttctcttagacttttaaaaaaattgtagtaaaatacacatcacctaaaatttaccatttttaaatgtacagttcagtggcattaaatacaaattggaggccaggcatggtggctcatgcctggaatcccagcactttgagaggctgaggtgggaggattgcttgaacctggaggtcgaggttgcagtgaggtgtgatcacactactgctatagcccaggcaacagagtgagaacctatctaaaaaaacaaacaaacaaacaaacaaacagattggcatcacacagtgtgtgtgctgctgtgctgtgctgttatcatttaacattaaaacataaacatcagcactgttatggactgaatgtttgtgtcccccaaaattccagtgttgaagctcaaacctccaatgtgatgttatttggagatggggtatttgagaggtggttaggtttagatgaaatcaggagggagggtgggtttcgcatgatgagattagtgtccttataacaagagacagcagagagcttgctttctccaccatgtgagtatgcaatgagaaggcagccatctccaagtcagaaagagagccctcaccaggggctgaatgtgctgacaccttgatcttggacttctagcctccagaactgtgagaaatttcagttgaataggccccccagtctgtactattttgttatagcttgagcagactaatacacccatgttatgaaaagctataaacatccctttaaaggccacctaacgcgtcgtattacctcatgcatcttctctgctgagctttccaaaagagtggcttaggctgggcctggtggctcatgcctgtaatcccagcactttgggaggccaaggcaggtggatcacctgaggtcaggagttcaagaccagcctgaccaacatggagaaatcccgtccctactaaaaatacaaaattagctgggcgtggtggcgcatgcctgtaatcccagctacttgggaggctgagccaggagaatcacttgaacctgggagatggagggtgcagtgagccgagatcgtgccattgcattccagcccggccaacaagagcgaaactccatctcaaaaaaaaagagtggctggccgggcgcagtggctcacgcctgtaatccccgcactgtgggaggccgaggtgggtggatcacgaggtcaggagttcaaaaccagcctggccgagatggtgaaaccccgtctctactaaaaatagaaaaactagccaggcgcagtggcaggcgcctgtaatcccagctacttgggtggctgaggcaggagaatcgcttgaacctggggggcggaggttgcagtgagccaagatggtgccactgcactccagcctgggtgacacagtgagaccccgtctcaaaaaaaaaaaaaaaaaaaaaaaaagtggcgtatgttcccggtctccacctctcattcgccagcccctgtgaccaaacccctgggattagatctccatcgggtccctcccctcaccctaacctcacatgcagtggttcctgagaagctgctgtttatctgatcacgggakccagcaggatctgagggctcattcactgaatctgtactacccaacaaggcaggcttgtccttacccacacttttcaggtgaaaacttaatcagattcaagcgtttatcttagtggcctcttcgtggtgtgtgatttccttcttgcagctctttactggctaaaactcttcactgggagttaaaccaggtgtggtccttgaccctcatcattttgtcccatctcctatgctgggctctgtatccttgtctccaagcagtctcgtgtgacagggaagttacctattattgtatggtcccctcttcttgtcacctctggtgtggcwcttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacstaaacttagaggtggtgtgttaaatgctagaacttaaaactgagttcagctaggctcaagtgccccacaatttttgtcccaccagacaatttcatgaatatctacagattgttccctcaatatrcctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagstgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacasgcccctgcccttcactgcccacatccaagggagccaccaagtcccacaaattgttcctttawctgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttstcattggctcccctgcccaagtccccttctcttctcctttccttcccctgtggccttgccttgtcgtgcttatccttgaagaccctgtcaggyatctcttccccaaagagccctgcctaaccaccgcccccctcccccccgcgacacacacacctgggttagkccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgakgattccgtgccagttcctgwctccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggccyacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcrcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatgggctctttgaaaaatgtttattagatcaggttactcccttgagaaaaaccctctcagaataaaacccgaagtccattacttgaaagcagagccagcttcatgggcctttgtaactgcccatgggcttgctggaacccaggcttggtttaatactctactctcaccatctcaaaattcttaatttttgaacaagaggccctgcattttcattttgcaccaggctccacaaattgtgtaactgggcctgcctcagcagccacatggaacatgatccctccttgcctatttgagctcattctctaccattctctcccttgctcacctggctcccactgctcttgctcttcctggaacttgccataatgttgctagagtcagagccttggctcttgctgctcctcattggctggacccctctttacttgacctgctccctcaccactcacttccttcagatctgtgttcagatttcgtcttctcagagaggcttttggcccctgtccatctctctgaatttacctctgacctctcccccaccaccactgcgctaagctgcctcagaactttgtagacattctgtctggtcttctgatgtttcccccttggaagaatcccaaggtgcctgaagaatgctttctttatccttgaagttgagtaggttgactagagtctggcttgctattgagcattctttatcaaattgtcctgggaacatggtgtattctttcagtctgcagatgtagtcgttgctgtttcaggtcagctctcttatggatctttgacagcatcttctgttccatttgttgagttctgtacttcagggacacaaattcctcatgttggattgtctttgtctctcttccaatgctattagctttgccgtaattggtttagcttttgtctttttcatctgcattcactttgtctaatttgattttcagctatgtatattctgtttctggctgtttttcaatgtatttattagtttcataatgatgtgttttggtctgcagtttgtttctctaggttggaaatttgtcttttcatcttattctgttttatcatcccatctttgaactcttttattgggaacatgttcttatgaagttgtggggaatttttttcccttccttgtgtattctcttcttggtgggagactttgcctttctcgtgccatctccctccctgggcctcttttttttcttctggccataatatgtttgcctagttaccatgtcacttcttttcgtcttggctcaggcttggatggctctgcatagtcgttctgtttgctttgagacagtggaggaattcttggctctctcttcccagtttcttggcatcttctcttgctgttttcccctctgagctatcgcgtgcaggcttgttatcttgtatccggagagaatttgcacgctggagggagctgcagccatgtagtyttcagccctatctggattcttctctttgttctaagaactgtgttggwtgtcttactaaggctcactctagctgcacgagggatgtgtgtgccatttccatggggatagggggcacctcagtctctgggtggttccataatctgtgtatacctaagagcagttgcttcccacagagctgggctggctcactgggcactttgccatttctcctgcacctcccagctggagtttctgggtctaaaaggaaaaagtgaaggactcccacttggttgcttctctccagcttactgactgcaaattcccagggcgttgcccgctccctagggtggtttctgggggacggggcaggagcctggctttgctgctgctttgtcctctggagtcttttctcagactgctttgaattacacccctttcctttgtgtgctgaaatcttcccttcacactctccttccctgcctttcttttgtgtcttatcttactaggactggaagagggcagttgtgcaggaggtctgcatctaattccctaatccatgtgagagtgctcctgttgtgtgctttgtgacatgatggtgagaaatactccctagagcagtggctaccagaaggaagccatcccccccctgccacacacacacacacacacacacacacacacacacacacacacactccttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcytgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagtgagacgcaagatgacgaaaacaagggcactcactccaagttactgatgagatgtttggatcaaatgagccagtccttaagcagagttctctagtaaaagagatctcctttctgccctttcttgttccccaaaatgtgttgccttcatggtgaaaatttattttggcagattttctcttctttgataaaagcagccaacactttgttaaaagtctgtgaaacttatttacatgaagtatgtaaaggtaagaaaaaaacattatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggggaaatcattggagaagttaccagggaatgatgagctaatctgaaaaaaatacatgtttctaagttgggcgtggtagctcatctgtagtcccagctacttgagagcctgaggcaggaggatcgcttgagcccagcctgggcagcacagcragaccctatctccctaaaaaaaactttttcgttgtttagttttgggatttttttttttcctggtcttttttccccctttttgtgaataacgggatctcactatgttgcccaggcagatctcgaactcctgggcccaagcaatcctcctgcctctgccttcctaagattacaggtatgagccactgtgttaagcaaaaaaacttttttaaatgaaaatcattttttaaaagacaggctttccaggggagggtattattccacttatatgaagtgtcaacagtaggcagatttgtggagacaaatagattagtggttaccaggggctgagaggagtgggagtggggagcaactgcttaatgggtaaagggttgtctttggaactagagagtagtgatggtcgcatgacattgtgaatgtactaaatgctattaatgataaattttatgttatgtgtattttaccacaattaaaaaaaaaagatcaaatgtcctcagaatagccaacaaccttccacttggctaaatgcctactcattaaacttcttgaactaaattcctttctgattgtcatggttattgtgtcctgggcttcagagtttcacattcaggttggcttggtccagtctgtcatgtatcactataggtccccacattggcctcttcctcagacggacagcccatctatctgccggggctctgtgccacagccagatagacttgctctgagacagctgtgtgggctctgagcactggccaggcatcacaaaacctatctttatgatttagaataattggtggtcagctgctgttttaatgttgttgttttttttaatttagatataattcacataccatgaaatttactcatttaaagtgtacaattcattcttcagtataattcataggctcacagaaaaaattgtttaaaaataaaatgtgcaattcagtgtcttttagtacattcacagagttgtgcaaccatcgcctctgtgtcattccagaacactttcagcacccaaaagaaaccccagacacaggagcagtcacctcttattacccgcagcccctggcaacaactcatccacttcctgtctctatggatttgcctattctggacatttcctataaatggaattatgcactatttggccttttgtgtctggcctctttcactgagcgtaatgtcctcaaggttcatctgcattgtagcatgtgtcagaatttctttcctttttgaggctgaatgatattatatcctatagataatgaggttttgattatccacccatcccttgggaatgcatatttgggttgcccccaccatttggctgttgtaaactgtgctgccatgaacactggtgtacggatatctgtttggttactggttttggttttttgtttgtttgttttggttttttgagacaaggtcttgctctgtcgcccaggctggattacagtggcaygatctctgctcactgcaacctccacctcccaggttcaagcaattctcctgcctcagtctcctgagtagctgggactacaggtagcactcaccaccatgcccggctaaatttttttgtatttttagtagagacaaggtttcgccatattggccaggctggtctcaaactcctgacctcaggtgatccacccacctcagcctcccaaagtgctgggattacagacgtgagccaccgcacccggcatagttgtggctttttgagagtgtatggctaggagtaaaattgccaggtcatatggtaactccatgtttaacatttgagaaactgccaaactgttctccacagcaggaattttttaacctgtatgtggtgggcttgtgtttcggttttcattttacacatctataaagatgagatttgctgtatggcactggttgcctgtatttggggagggttctgcttttggttggcaagaactgcattttatttaagcttagcaaaacataactggtttctcgcatcttctcaaaagtggaggaytaagaaatggactgcgaattcagagcagggcagctgaacctcaggctccacccttgtagccttcaagctgaacctcattctctcttgctccctggagaccactgagacactctgcctgtgccagtttgatttctcacatttttaaagggccaaagcttgtgtctcaaagtgctatagcctttattgattcatgcagagaagcctccttgattccgtaattctgcagctaatactggaagtagaaagaattggaaacaccatctggatgacactttagggtggaagcagccagtacaagggggggctcattatttcctctggtcccagactgttcacctggagctgtagccaccaccctgcccttaggttaactgcctcgagtggtagtttagctctttgtgctgtgccgagggataactggaagtgaaaggtgctgagaaatgccatctcctgaaagtggcgagcatgagtgaatttacgaaaggttgggatattgctggggctctggaagtttctctggagctcactccaggggacagggagggggctggattccaattcaagtgaaaaatacctttcatctgccttgttcacctggcttttttgcctttttgtaaaatctgaaaacctcagggattgagtagtctttccttaactgcagttgcctgtctggccacacctgccagctgttgcttgtacccctgtaatttgcacggccttccgggcctttctcacaagatcactgcaggtcacattcatgaggaaaatgcaggcagttcctgccatcagacccctcaggatgtcatggtttggcctgaaaacaagattcctgcaactctaattttcctttgctagatcaaatgaaggatttgatctaatgtttgcattctagcagcaaaatcattgaatattttatttcttaagagccttacttcatattttgtaggtattttaagattttgtaaaggcctttctgcttcaacgtgtgatgtgtgcattcttagaaaaagatcttgtgttctgtaawtcacacaataaaaacatgagttcgtgcaggaaaaactggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcgccaccacacctggctaattttttatttttagtagagagggggtttcaccatgttggtcaggatggcctcgaactgacctcgtgatccgcccacctcagcctcccaaagtgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttaccatattggcactgtatttcccctagcccattgatcacttgagagttagtcatagtcctcgtgctgtttcactcctaaacgtttaagcatgcctttcctaagagcagacagtacagttaagacactcaggaagtttagcaatgagctaacacagaaccttacatttctccacataccccataaatgccttttttagagcctttgagcctggaatgcagagtccaggactgtgtgttgtattcgattgtgtcatcccttcagtctcctttatcagaaatgttcccccacccccttgttttctctcatcatcttgagtccagaccgtggttgcatggcacrccctctctggactcttcctgctgtctcctcacggtaagcttcagtctcctactcgtgatgctggttcatctcagcagcactgaggggcctgagctcagtttggtcgtgtgttaaggtggtgcctgccagatttctccacagaaaagggccccgtacttttatttgctcttcagcctgtgtattccttcctttcttgccagcttgtgggtggcttctctagcagcttctgtaagatactcagtttggcagttgtagttgtttcagcaggagaggtgtctgcatacctgaccaccacatggctagaagtcgatccatcctctggcgtaaccatcctccatgctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattatgcattgagcggggagatgggggttggcacgcacagtggggtgttctaagtacactgagggctcgggtgccctggctcatagagcagggagggaggcaggagcagggaaggtgtctcagaagtgccatctttttttttttttttttgggaagtggaatcttgttctatcgcctggtctggagtgcaatggcactatctcaactcactgcagcctccgcctcccaggttcaagcgattctcatgcctcagtccccgagtagctgggaccacaggcgcacaccaccacacccggcaaatattttgtatttttagtagaggcggagttttgccatgttggccaggctggtcttaaactcctggcctcaagtgatctgctcacctcggcctcctaaggtgttgggattacaggcatgagccactgcgcccggtctagaagtgccatcctaactgaacctgaaagatgaaagttctccagatgaacctgaaagttctccaaatgaaaaggtgggagggggtgacagggttaggcccagagcctctggtgacacagggtgggcatcattggtcactttttcctcgagggaggggcgtcacacgggtgatagggtgggagctataaccatgttgatagtgccgcctctgcccatctggcctggcatgccctgagccctctgtcccacctgtggaactcataagccctgacagcccactcactcctgattcattatccacacccctgtgcttccrctgtgcctggagcaagctttcttcagggggaagggaggctggaactatgttgtagttacctatttgtcctcccttccaaactgtgagttcttggaggtggaaggatgctgcaggatctggctcaggacgaaggcagttggtgaacagacacgtgtgtttttgactcacggtgatctcagacaagttcctctgtctagtcgaacttctttttttccatctgtaacactcaggagttgaataggtggtttttctgaggatacttcaactgtaaaatgtatgaacttgtgaactagctatttagttctcctcataatcaagattgtgtgtgtgtggggggttctgattagagggaggatgaagagaggtgtatggggttttttttgttttgttttctgtttgtttgtttgtttttgagatggagtctcactctgtcacccaggctggagtgcagtggcacgatttcggttcactgcaacctctgcctcctgggttcaagtgattctcctgcctcagcctcctgagtaactgggattacaggcatgcaccaccatgcccagctaatttttgtatttttaatagagatggggttttcgccatgttggccaggctggtctcgaactcctgacctcaggtgatccacctgcctcggcctcccaaagtgctgggattataggcatgagccaccacacctggcaggtttctttgaaaaagtttgtgtttcggcaaacaccataaaccccctgggggacagccttggggagtcacctggcaccctagcccagcctccctcccttgggtcctgcagtgaaggcttagtgagggtgtgcaaatgcccaggtcaccctgggactgggcaggccctctgggctaagggtaaactcatttggaatacctgttttctatcattgttttttatttgttaaatttaaagggtacaagtgcagttttgttgcgtggatatattgtatagtagtgaagtctgagctttcagtgtaaccatcacctgaatagtggacattgtacccgttaagtaatgtctcatccctcaccccctcccacccttcccagtctctccagtgtctgccattcctcactctgtccatgtgcacatgctattcagctcctgcttctaagtgagaacgtacggtatttgactttctgtgtctgagctgtgtcactgaagacaatggactccagctccatccacgttttttatcatttttacctgcactccacacccagcacaatccaggcttctttgtgggttttttgaaatttgtctttaattataaaagtagcagccagcaaattaacaaacacccatgtgcctttcattgcacagaattgaaaatcatcatactatatttgcttcaagtaatttccattagaaagaactagaatattacagtagagttaaagaccctttatttcccatcttcagtgctcttaaaagttcatttagggccaggcatggtggctcacacctataatcccagcactttgagaggcccaggtgggtggatcacctgaggtcaggagttcaagaccagcctggccaacatggcgaaaccccatctctactaaaaatacaaaaattagctgggcgtggtggtgcgcatctgtaatctcagctactcgggaggctgaggcaggagaatcgcttgaactcaggagggaggcagagcctgtatgcagtaagccgagattgcgccaccacaccccagcatgggtgacagagcaagactccgtctcaaaaaaaaaaaaaaaaaagttcattcattgtacacttagaaatagttaaaaaggtaaactttgttttgtgtgtgtgtrtatatatatatatatatatatatgtatttttttttgagacatatatgtgtctggtttgttcgcccaggcaggagtgcagtggcatgatcaacggctcactgcagcctcaacttcctaggctcaagtgatcctcctgcctcagcctcccgagtagctaggattacaggcacacaccaccatgcccagctaattttttttttttttttttttttttgtagagacagggttttgctatgttgcccaggctggtctcaaactcctgagctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctctgtgggtgttgctcccctgccgctccagtggttttgtttttgtttttgtttttttgagacggagtcttgcgatctcagctcactgcgacctctgcctcctgggttcaggcgattcttctccctcagccttccatgtagctgggacttacaggcacctgccaccacgcccggctcatttttgtatttttagtagagacggagtttcaccatgttggccaggttgggctcgaactccagacctcaggtgatccacctgcctcagcctcccacagtgctgggattacaggtgagagccactgcacccagccggcccctcagtcttttccttctcaatcagtggcaccaccatcttcccaggctttggacatggtccctgactcacccttgcccctcacccccacactaatccacctgcgagctctgttgcttcaccacctagaccagccccaaatcctcaactgcccccaccctggkccacacctggaccactgctagaggcctctcatgggccctccctgtttttctcttgcactccccgggctttctggcacaagatgccccagaagcagaatcacatatctctcctgggagccaatctagtgtgtttactgcccctggagtgttattgttggccttagaatatgtcccactacaggtttgcagagcactgtagtcaaaagtcatttgaaataaatcttttctctgtggtatattgtcaatttgatatagaattaaatttgtttcttttcttttttcttttctttttttttttttttaagagacagggtcttggccaggcgtggtgtctcatgcctgtaatcccggcactttgggaagccaaggtgggtggatcgcctgaggtcaggaattcaagaccaacctggccagcatggtgaaaccccgtctctgctaaaaatacaaaaattagccgggcgtgatggcaggtacctgtaatcccagctactcgggaagctgaggcaggagaaggcttgaactcaggagtcggaggttgcagtgagccaagatcacgccatggcactctagcaagactctgtctcaaaaaaaaaaaaagagagagagagagacagggtcttgctctgtcactcaggctggagtgcagtgatgtagtcatggctcactgcagcctcatactcctgacctcaggtgatcgacccgcctcggcctcccaaagtgctgggatcgtaggctgaagccaccatgcctggcccgaactcatttgtttttatttgcattaagtgtaataaggttttgttacttttagtttgaattttattttgggtaatataaacatttacatgattcagaagtcagaattacactgaggcatgttcagctaggcctcactcctgtgcctgtacccttacctttttccccctaccccatgcagggaatcaatttcattagttcctggtgtgtccttccttaatacccccccttctttctttggtagaatgcagtagatatgtttgcgctttgctccctttgcttcacagtggatcctggaaatgactccatcgcagttcttagagctcttgtttagtccctttggatctgcacagtactccagtgtgtgggcgcaccataagtttattcagcaagtgccctggtgatagggatcgggggtattggaagcctttggctggtaaaaataatgttgtagcaaataacatcatgcatatgttctttgagatttctggaggtgtctctttagcatagatttctagaaggcattccttacgtcacgtttaggtttatagtttgacctcatggtgattaaggtatttgggaaatgcaaatgagagtttcgaagaagccagatctttcccattagttcactgtttttctctgacattaggaccgtccgggttctagggagcagccctggcgttaggcagtgccatgatggattgtgtagaagtagcgattcccatctgtctgctttcttggcccactctgctggtggctccccttccctccctcctttatggggagctggggagctgcctaggggtccattctcaaaggctgatctctggtgggcaacaggccacacctagctttccagggttcttcgtcatttcccattgagagctgtaagactcagagacttgaaaaggaagctctggctgggcacggtggctcacgcctgtaatcccagcactttgggaggctgaggcgggtygatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggsgtgagtcatggtggggacaagacattccctcactctaagaccttgtcactagattggaacatctsttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctscaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaagscccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcagggaagaaaagtcagaagaccaggacctccagggcctcwaggacaaacccctcaagtttaaaaaggtgaagaaagataagaaagaagagaaagagggcaagcatgagcccgtgcagccatmagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatkamcccaccstghstgaaggcyggacayrgaagcttaagcaarggaaatctggccgctctgctgggaagkatgatgtgtatttsatcargtaagtaagagcaactcctatstctacrgggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatggaatagctgcggaagcagaggaacttgcagagcyaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaaycsttctgtaccaggcctgactctttggttgctgaactttggagaggcctgggggggtcagcggcaggcagacgagtgagtggctttggtgacaggtcctcaggggcagccaggcagtgtgactctcgttcartagtaacgtttgtcagagygttgtcaccaccatcygctctgccctatctctgacattgctatggagagcctctaattgttccttgtgtctttctgtttgtccccacagtcyccagggaaaagcctttykctctaaagtggagttgattgygtasttcgaawaggtaggcgacacatccctggaccstaatgatwbtgrmttsryggtaactdkgagagggagcccctccyggygagagyagaaaccacctaagaagcccwaatctcccaaagctccaggaactggcagaggccggggacgccccaaagggagcggcaccacgwgacccaaggcggccacgtmakagggtgtgyaggtgawaagggtcctggagaaaagtcctgggaagctccttgtcaagatgcsttttcaaasttcgccagggggcaaggctgaggggggtggggccaccacatccaccyaggtcatggtgatcaaaygccccggcaggaagygawaagctgaggcygaccctyaggccattcccaagaaayggggcygaaagccggggagtgtggtggcagccgctgccgccgaggccraaaagaragccgtgaaggagtcttctatcygatctgtgyaggagaccrtactcsscatcmrgargyrcaagacccgggagacggtcagcatcgaggtcaaggmagtggtgaagsycctgctggtgtccaccctcggtgagaagagcgggaaaggactgaagacctgtaagagccctgggcggaaaagcaaggagagcagccccaaggggcgcagcagcagcgcctcctmaccccccaagaaggagcaccaccaccatcaccaccactcagagtccccaaaggsccccgtgccactgctcccacccytgccccyacctccacctgagcccgagagctccgaggaccycaccagcccccctgagcccyaggacttgagcagcagygtctgcaaagaggagaagatgcccagaggaggctcactggagagcgacrgctgccccaaggagccagctaagactcagcccgcggttgccaccgccgccacrgccgcagaaaagtacaaacacyraggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccracaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtrgcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtstgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccrtcctcctccttcctagttcatcccttctcttccaggcagccgcggtgcccaaccacacttgtcggctccagtccccagaactctgcctgccctttgtcctcctgctgccagtaccagccccacsctgttttgagccctgaggaggccttgggctctgctgagtccracctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcrgtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttstgtttgtagagtctcatagttggactttctagcatatatgtgtccatttccttaygctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcraactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtstgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagrcacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggmaaacctagaaaacatttggcagaaaattacatttcgatgtttttgaatgaatacragcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatsctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattyggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgwttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatyctccagggctcaacactgtgacatctctattccccaccctccccttcccagggcaataaaatgaccatggagggggcttgcactctcttggctgtcaccygatcgccmgcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacargccacccwgtgcagaagggagctgrctccagcctggaaacctgtctgaggttgggagaggtgcacttggggcacagggagargccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggraatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggact

SEQ ID NO: 12579 - DNA, 40394 bp, Homo sapiens
  misc_feature (1)...(40394): n = A,T,C or G, or insertion/deletion polymorphism (see Tables 1-2)
gatcagagtttttaaagatagtttggtgctgggtgtggtggctcacgcttgtaatcccggcactttgggaggctgaggcaggcggatcacctgaggtcaggagttcaagaccagcctggccaacatggcgaaaccccatctgtactaaaaatacaaaaaattagctgggcgtggtggcacttgcctgtaaacccaggtactcgggagattgaggctggagactcacttgaacccaggaggcggaggttgcagtgagctgagattgtgccactgcactccagcctgggcaacagagtgagactccatcacaaacaaacaaacaaacataatttggcaggtaggggctcaggaagcagagtgctgattggtcaaggttggagatggaatcctaggggggtcgaactgaggttttcttgctgttttctactcctagatgggatggcagaactgattggcccagattaccggtctggatggtgtcagctgatccatccagtataggatctacaaaatatctcaaacactgatcttaggttttacaatagtgatgctatccccaaaagcaatttggggcggttcagactcttggagccagaggctgcatgacccctaaaccgtaatttctaatcttgtagctaacttgttagtcctgcaaaggcagactggtccccaggcaagaagggagtcttttcgggaaagcgctattattaattttgtttcagagtcaaactatgaactgaattccttcccaaatgcccagcaatgaacaaggacagcttaaaggttagaagcaagatggagtcggttaggtctgatctctttcactgttataatttcttcagttataatttttgcaaaggcagttgaaactgtgtctttgaaaagacacagcagaaacatctgttacataaacaacagaaatgaggaagaaagtatctgactcagtagcaaaggaaatccacagaaagaatgttctgagaacggaagcaatgatcagaccaggtagggatatgatagaaagaaaattctcatctaattcaaattctggccagtccttttggtgatttccatactaatactaggcactttaaaatgtgagttctggtaacacatggaacctcaaagtagaaatgtctgttgttcatttttaaaagactatttgcagagttttgatgtttatcaatgaaaagagttttttttttaaatttatgaagaatagggaatcctatatgggcatggggcaaataatcaaactgttttaatgcagaaaaaaatgtgcaacagaaagagatagctcatggagggataaagactttattctggaccctctagattctgtggggcctgcagtagcttcaagatgccccagcatgtcctgcgcccacacccctgtcaagatcactgtggtcagggcgtcttgcccatggccagtgtattagtctgcttgggttgccacaacaaaataccacagactgaggttgaaaacatttattttctcacagttttggaggctagaagtcctagatcaaggtgccagcagcgttgcttcctctgaggcagctcttcttggcctgtaggtggcgccttcttgctgtgtcttcacatgggcggcccctcagtctgtgtgtctaggtcctaatcttctcttataaacacaccagtcatactggattagggtccatcattttaccttaacggcctatttaaaggccttatctccaaatacagatgcattttgaaatactaagggttagtacctcaacatctgaattctggggggacacacttcaacccataacatgcaggcagacctcaatgctgcttgcagacccaaggcgaactgcacaacaatcaagcctggctcttaggacaaaaacatctgccagagtcaaccaaactgaattctctgggaaggacgagatgcctggtgtcataaaaagaccatagtcttttttaagtgtgatgcatgcgcacacaggcacgcatacacacacgcgcacacacgcgcacacactgcactgctgccctgtccttggcagacattcctgtggggtcatgttcgaaatatgcacttctgtggagtagcttgggttttcttggaagtctctttttctaaacttgtacctaagctgatggcctgtgcctgcttgggcatgaggggtcggagtggggatgggtcaagactgactcctgttcactgtgaagtagaggaaggcagtgatagccagacagggacgtgtgtttagggaagtcctctgtgttttcagttctgtttttgttttgtttttatgatgggagagatgagcaaatataaaggctgcttctaggagcaggagtgaggagaggttgcctatatgagagaaacgggatggtcaatactgtaggtttttttgagaaggtgaaatatggaattcattttttaaattttttaaatttttttttttttgagacagagtctcgctctgtcacccaggctggagtgcagtgatgtgatctctgctcattgcaacttctgcctcctgtttatataaacaggccaaaccctgtatgtatgtatgtatttatttatttttgagatggagtttcgctcttgttccacttgttgcccaggctggagtgcaatggcacgatcttggctcactgcaacctgcaactcccgggttcaagcgattctcctgcctcagcctcccaagtagctgggattaccagcactcaccaccacagccggctaatttttttgtatttttagtagagacggggtttcaccatgttggccaggctggtctcgaactcttgacctcaggtgatccacctgcctcagcttcccaaagtgctaggattacaggcatgagccactgcacccagccgaaagatggaattcaaagaagtgctggtaagtcactgtggtatttgtgaaaaaataaaaataaagagggtttgggctaggcgcggtggctcatgcctgtaatctcagcactttgggaggccaaggggggtggatcacctgaggttgggagttcgagaccagcctgaccaacatggagaaaccctgtctctactgaaaatacaaaattagccgggtgtggtggcgcatgcctgtaatcccagctactcgggaggctgaggcaggagaatcacttgaaccgagaggtagaggttgcagtgagccaagattgtgccactgcactccagcctgggcaacaagaggaacaagagcaaaactccatcaaataaataaataaataaataaataaaaacagggtttggccttgggcaggatggaccgttttctagaaggacagccgtggtgcgctgcacaactggtatgaagcccagtttccatctgaagtcctcgatgttcatggaaataggggcgagacagtctgaggagtgtgaagaaggcctgaaaatatccttgcagagaacaggagagacaatgactgggacagccaggcagggctgagggcccatttgaatttcccgcagtgccctctgtcctgttgtgtgacccctccagcagtaggtactgggaaagcaggtggctgagttcatccaggactgaggctctgccagacaagaacagtgcagcaaggatgttgaaggtaatggcaaaaaataactggaatgcagagaaatgaaatcaaagctgatgaggagggaagggaagagaggagagggcagatagacttgggtagagaggacagaacaatgacagggcaaactggtgatgttgaggaagagtcacagggagcagctaaacaagccagctgcagggatggcactgtgtggctggagagcagggttctggagttatcggtttttccatgtgtgacatgggcctgggtgggtgaggctgagtgtagaagtcttacatttccagtcttgtcactcctctgatgagtttcagaccaatatatccatctgcctagatgtcatttctccttggattcacatgctccaaaccaaactcctgggctcagacatcaaagccactcaaaaatagctctctgagaaatagaactaccatatgatccagtaatccaacttttgggtatagacccaaaagaattaaaaacagaatattgaacagatatttgcatagctttattcacaacagccaaaggtgggaacaacccacatgcccatcaacagacgaatggataaacaaaatgtgctatatacataaaatggaatctttttcggccttaatgaaggaaggaaatcctgacacatgctacatggatgaaccttgaggatattttgctaagcaaaagaagccagacactaatggacaaatactataaaatccacttatatgagatacttagagtagtcaaatttagggacagaatcagatttgcaagataaaaagtttctggaaacgtatttcacaataatgtgaatatgcctgatactactgaacacctcaaaaagggttaacacggggccgggcgcggtggctcatgcctgtaatctcatcactgtgggaggccaaggtgggcagatcacctgaggttaggagttggagaccagcctggccaacatggtgaaacccggtctctgctaaaaatacacacaaaaaaattagctgggcatggtggcaggtgcctgtaatcccagctacttgggaggctgatgcgggagaatcgcttgaacccgggaggtggaggttgcagtgaaccgagacagggccattgcactccagcctgggcaacaagaacgaaattccgtctcaaaataaaataaaataaacaataaaaataaagggttaacatgggggctgagcacggtcagcgagagaatcacttgaggccaggagtctgagaccagcctgggcaacagagaacgctgtctctacaaagcataataataaaaaaatgagccaggtgtggtggcatgcacccgtggtcccagctacttgtgaggctgagatgggaggttgagactgcagtgagccgtgttcgcatcactgctctccagcctgggcacagagacactctgtctctgaaacaaacaaaaaaagaggggctaacatggtaaatttcatgtttcttatcaagtaaaaaggcttgctgacccacaatctatattaggtttccctgttactagcaaggagtgaaggatgtgctatcccaaaatatgtccaaaaattggtatattattttgagctaaaaacaccggagaaattgtagtttcagaaagggctagatgacctgtcgtttcctacagggaataagcagtaaagattcctctgggagtggcaccctctctgtacccgggtcagaaaatagcccttatcaccagagactgggagttggggctgcaatggacctgaataaatgaacttcccaagtaacacttaccttccactaattttacaccctccccaatatttctcctagtgactctcttagaaatgtatcgccccagccagatgccttttgtgctttcttctcaaatgcatcattctttgtctaaaaagtataaaagcatcttgctgtggccacttcttcagacctcactctcttttgaaggtccccatgaaaaactaataaagtgtgtatgcttttcttttgtttatctgcctcttgtcaattcggtttctggctccagcggaagagcccgcagaagcgctgaggggactggagacggtctctggcgcccctacacctgctcagtgagccttcagccccttctccctgacgaagctcccagaggctggaactctggcgcgggaggcacttgggaaatcctcccgaaagcaaggaggagcctttcctagaccgggagcggtcccacgcgggggtacaggttggggcaggggcgaccgagccgggcacaggaactcgcagcagggtagggttggcggctacgccgccctcggtccgcggggaaccacgcgggcttccgggtcacgccgccgcgttccgaccgccctcggggagaggggaggagcctccagcgccgggcggggcgtggttaaggccggtgggccccaccgcagccagacgctgcccgtttaagcgcagagggccgcgggtcacgtggtgggcggggtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtccggcgcgcccgcgcttcctcccccgcgcggccctgccggggtcgtgggcgygccaaggccggtcccgcgcgaccaggcccgagcgtcccctcctgtcctgtcccgtcccgtcccagcgcgggaggcggcgcgcgctccttccttgttgggtgggctcagccgcggccaggtgtcctcgcaggtgacctcggggctggacccccgagccagctgcgcggatgcagtggccccgtggccagtgtctcaattgttggcgcgcccgtcttatctaggcttcttttgttgtgtttgtcattagttacactcgtagtcaagggtttagacgtcgagattttcattttccttgaaattttgtaaagggggaaaagactgtacttcaggcgtatcagcggcgccgatgcgcgaaccggygttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccacygtaacactggtgcttacagaaggtgaaagtataatgtaggccctcaattcagtagtgacttaaaaaattttactgttggtctgtgttaatgagaaactgtccttttttgagagggagcctccctctgttccccagggtggagtgcagtggtgcratcttggctgactgcaacctccgcctcccaggttcaagtgattctcctgcttcagcttcccaagtagctgggattagaggcgcccaccaccacgcccggctaattttttttgtatttttagtagagatggggtttcaccgtgttggccaggctggtttcgaactcctgacctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacrgggtctcactgtgttgctgaggctggtctcgaattcctgtgatcctcctgcttcatcctctcacagtgctgggattacaggtgtaggccgctgtgcccagctgagttcactttttaacatctgtctgaggcggtcatgagacactgtagtggagccatctgggttgcataatgaatgtgctgtgagatgcacaagtagatagttctttccagaagctttgctgtgagagagaaacagcagttacggagaaggctcctgagcgggtctatagttatttatgttggaacaattctcaggtgatatgtgtgtgtgatctgaattcttcaatcacttgttacccataatactgtaagtttcccagcaagttctttccagttggatttggtagtttgaaaagaggtcctactgatggcttccgaaacataattttaattttagactagaatttgctgcctcctgaatatagattgtgtcttttgccttttcaataaatggtagtagctagaattcggttatttaactactaacacaatctttcttcttaaagaatggatgacaaaggagaagtgaagtgcattaagttttccttagaaaataagatattggctgttcagaggacctcaaagactgtggtaagacttatctttaaaatacagcattaaagggcattagaaatacatttggaagagaaggaatcgcaaattttcagtgttaaaggaaacttttattatcttactgttgtgaaaggtatagttatgttgcattgtattagagccttcaaaaacgaaaaagacatttgagtgggttaaaaaaatgaccttagtttgatttttaaattaaattaaaaatttttttttgagccagtcttcctttgttgcccaggctggagtgcagtgatgtgatctcggctcactgcagcctcgatctctcaggctcaagtgattctctcgcctcagtctcccttaaaaattgttaaaaaataatttggaacttcrtgtgtcttttgtattgcttgatagcagcatagaatatgtgaggtatttttggctactttgtgaattagccttttcatctctcatttctgagtgctagatctgataggagcagatattccaagttgaagcagcctacaggcactttagccygtgtaaatgttcaccattgccgtttgtagagtagagggaaggctgttagaaacaggcagaatcctctgttagtttcttccatcagttttaagtgttaaagtcttggggaagcctcttagtgcagcaacacatttctctgacatcagctgcttgaggaatgaatttttgaaaggagttactaaactgtaactgaatatttgtattaacttaaaaaaaawtgaatcgtaagcctgctgctgttgagacagatgatccgaattggtctttttatctttcctgtgttttggttgtcttcagttattttctggtcaytttttaagttaatatttatttttcttgtcttgtagtatgccaacgtaggttggcagtatgctgcctaatccaaatttgtgtgtgtctgtgtgtttttcctttcaggatttttgtaattttatccctgataattcccagctggaatacacacaggagtgcaaggtatgaccccaggccctttctcagctgctggtgtcagtggtgttgagctgggttatgtagtggagagcggggcatyggggtcgcagggagcacagacttgaagtcagactgtccctcatgttgattcccaaactggagtcaggcggggtgtttgctttgtgacactgaacagttttctaagtttgaaagcttgttcctttggagggggagggttcaatggatgatgcgtggtgaacacccagtagtgctagcccttggggctgtcgtctgtcttgccctttttctcctcactgggctgacagcacatctgggtctgggccctgggatgcctcacagccacctggagtggaggtttctggtgaggagtttctttttctgtttcctgaagtttcctttcctcaatttgttgtctttgtcttgtccttactctttctttcttctcctaggtgttgattctaatccacattaatgagatttgctgggtgtagtaaactaggctagagggagctgagctaaaattggcagtgtggcaccttgggcgctgacagaagctgctagtggttggggtagggctttctgcatttttgtgactgttttgctcaatggagttcagggcggactctttggtgaggagaggtgcatccccaccactgtcctgcctgccctgcagtggccccgtgtgaagagaccctcagcccggcccttctcaaacctgtctgccctcaagcgagtcgggtgtgtgtctcagggtcctcaacccattttagtcaacactcactaaagacccttaggcctttgtacatttttaataaccatttttataacgtgggtgactaagaatgttggcagtatggtgattcctgcaggtagaagctgctgtctgtgagctctggtcagttacttttctacaaaacacagacttctcctgttctgtttagtagaaggaattaggattcaggttcttgaatgaagagttatgggcaaaaatcagggaacattgtatttaaaagaaaatttgttttgttaattagtaaacattccggggaacgttcattaaagaatgacaaacygcagagtttgtgaagcttttgaagagagttatatgtgttttttcttattaattaaaaatatttttaaaaaatttttcttagactaagaatgccaacattctaggattctgctggactagttcaactgaaattgtcttcataacagatcaaggaatcgaattttaccaggtattatgtttatcatttatgtttgttggttaaagttcagtgatagcattctggcagccttttgaattcagtactgaatatatatatatatattttaaacattttctagagatggagtcttgctctgttgcccaggctgcagtgcagtggcaccatcatggctcactgtaatctcaaactcctgggctcaagcaatcctcctgcctcagtctcctgagtaggtgggactacaggcatgtaccaccatgcctggctaatttttctttttattattttattttattttattttatttttgagacggagtttcgctcttgttgcccaggctggtggagtgcaatggcgcgatctcggctcaccgcaacctccgcctcccaggttcaagcgattctcctgtctcagcctcgtgagtagatgggattacaggcatgcatcaccatgcccgggtaattttgtatttttagtagagacgggatttctccatgttgagactggtctcgaactcccgacctcaggtgatccacccgcctcggcctcccaaagtgctgggattacaggcgtgagccactgcgcccggccctggctaatttttaaacttttttgtagagacgaagtcttgctatgttgcccaggctggtgtcaaactcctaacctcaactcctgccttggccactcagctttagtctcttgctggggattttattctttttttttttttttataattgcaagtaataaattaaaaaaaaaaaaaagaaaagaaaaagggcttggtggcccrtgcctgtaattccagctctttggaaggccaaggtgggtggatggcttgagtccaggagtctgagaccagccaggccaacatgatgaaatcccatctctataaaaaatacaaaatgttagtcaggcatggtggtgtgcgcctgtagtcccagctacttgggaggctgaagtgggaggattgcttgagcctgggaggcaggaggttgcagtgagccaagatcacagcactgcactccagcctggatgacagtgagaccccatctcaaaaaaaaaaacaaaaacacaacaacattaaaaagtgggcaaaggccaggtacagtggctcacacctgtaatcccagcactttgggagaccgaggtgggcagatcacctgaggtcaggagttcgagaccagcatggccaacatgacgaaaccctgtctctattaaaaatacaaaaattagccaggttggtggcaggcacctgtaatcccagctactagggaggctgaggccagggaattgcttgaacctggaaggcggagcttgtagtgagctgagatggtgccactgcactccagcctgggcaacagagcgagactccgtctcaaaaaaaaaaaagtgggcaaaggacatgagcagacactttttaaaagaagacacacatgcgaccaacaaacataaaagagctcaacatcactgatcattagagaaatgcaaatcaaaaccacaatgagaaactatctcacactagtcagcatagccattataaaaaagtcaaagaataacagatactggcaaggttgtggagaaaagggaacccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgttctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatctatccctgaacctaaaagttaaaacaaaaaacattcaaacattgcaagatatgtaatatggaaagcaaatgttccctataatcccgataaataattattatgaacagtttggtgcatattcctctatttttaaaaataaatacaaacttctttttaacaaaaaggggaatgttgtatataaacttttgcagctagctttttttttttttgtccaaagtgtatcttggacatctttctatattttattctgactgggtagtatyccactgtatggatggactgcagtttaaaaattttcttgttatkggacattggctggttttccatttttttgtgattacaaataacccttcagtaacatgcttgtacacacttctttatattagagggagagttgcagtataggtacgaacatctgaaaagctgaaccagtatcgccaaatttcttctagacatgtgtattttcactagcaatataggaacttctgcttttcatacctttaggaggactggatattatcagtctatagacatttgccaacctgagaggtagaaagacttttttttttttttttttttctgagacagagtctcactccgtcgcccaggctggagtgcaatggtgcgatctcggctcacggcaacctccacctcctgggttcaagcaattctcctgcctcagcctcccaagtagctgggtctacaggcgcccagcaccacgcctggctaatttttgtatttttagaagaggtggggtttcaccatgttggccaggctggtcttgaacccctggcctcaaataatccacctatctcggccccctaaagtgctgggattacaggcgtgagccaccatgcctggccgaaagacattttaatttgcattttacattactagggaagtaagcatcttttcatttgtatattgtccatttgtattttgttaacttcctcttaaaatttttttattttgtaataattattttgagacaggatctctgtcacccaggctggagtacagtggcacaatcacggctcactgcagcctcgacctcctagcctcacgtagtcctcccacctcagcttcctgagtagctggaactacaggtgtgtgccagcacgcccaacttaatttttttttcctttttttttttttgtagagatgaggtcttgctgtgttgcctagactggtcttgaactcctaggttcaagccattcttctgccttggcctcccagagtgctgggatttatgggcatgagccactgtgtgtggtcaaaaatattttttttactgtggtaaaaaaacatacaacatttattatcttaactgtttttaagtgttcagttcagtagtgttaagtatattcattcacattgttatgaaatagctccagaacttttttcatcttgtgaaaccaaaactatccagtaaacaactccccttatcccttccctgcagccccagcaatctctattttactttctgtttctatgaatttgactcctttttttttaagatggagtcttgctctgttgcccaggctggagtgcagtggcgtgatctcagctcactgcaacctctgtctcctgggttcaggcgattctcctgtctcagcttcctgaatagctgggattacaggtgtgcgccaccacgcctggctaatttttgtatttttggtagagatggggtttcaccatgttggccaagctggtcttgaactcctgacttcaggtgatccactcacctcagcctcccaaagtgctgggattacaggcgtgagccactgtgtccggccgaatttgattaccttttatacttcatataagtgaaattatacagtatttgtccctttgtgactggcttatttcatctaccataatttcctacaggttcccccatgccatagcatgtgatagggtttcctttttaagactgataataccgcactgagcgtatacaccacattttgcttatccattcatctgttgagggacatttgggttgcttctgcctcttggccattgtgaatagtgctgctgtcaatacaggtatgcagataccgcttcaagatcccgttttcagttcttttagatttatacccagagtgagattgctggagcagatggtagttctgtttctgaatattttagggaaccgctatactgttttccatagcagttacaccattttgcaatccctccaagtgtacaagggtcccagtttctccatatcctcaccaacacttgctgttttgttttgttttgtttttgatactagccatcttaattgtggttttgatttgcgctctttgttgattagtgatgttgagcacttttgtgtgtgtgttttggccactttgtgtatcatctttggagaaatgactaattcgggtcattgtgcctatttttaaaatcaaattactattatttgttgaattgtagttctttatatattctgatattarcaccttcttagagatacaatttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagagtgaaactccgtctcaaaaaaaaaaaaaatttgtaatgaccaataggagaactttaaacaaactttagacaaattccatacacacagaaatagaattttgtacatgtgattgcatgggaaggatggcttgctttctgggggagttccctatggtaatcatttaaaagtctgtctttctgttctctgcagtgggaaagtataccttaaggttacctagatggcttcagatcttcaagaaaaaagttaaaaagaaagaagactctagcacatcctaattattatagttcttaagaagcttacggctcctgcccctgacttgcgcagcagttcttcagtgcagtgtaccatgagcattaatgtcttgggggctctgtacagtgttctgtaatatcggaatatttagggtacattgaaaatgtgcctggattataaagtactgcatttgtatggagtcttatgaacacatctgctagaagaagggagctcctcccaggcccagtgtagactggagtcgaggtggaggccaagcagaaggcagatctgccatggtctgggaggtggccgagttaacacatggggtcctggaggtgtcagtttcttttggccgtttcctggatgaggagaaatttgttgtaaattgctcttaggtgtatccatgtgctccacatgcccaggcatgtggaggcacagataaggattttggagggaaacagcctacccaggctataattgctttgttaaggggcaggttccctaatccactcttggagccttgtttctcatctggctaatagggccagtgatgcctgcctctcagtcgtggcaaagagtaaatgagttaggaggctctgtaaagcaccaagcatagggctggttaagtagtagctgtaataagtacaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacrgtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaattccatcctgtgattgctttcagtaatataaataatagaaggagtgtgttacaagcaccacgtgatgccctgacccctagaacacataaggaggactccccttgttctgggtattcagtgtataggtcctgtgaacatagaaaacctgcagtgtttttggcattcctttttgatttttatcagctttgtgatgctaaggaattcctttacctttctagcctgataaaacaagaacattgaaccaatttatttcttagtatctttgttttagaatttcttcttctttttttttttttttcgagacagagtcttgttctgtcccctaggctggagtgcagtggtgcagtgtcggctcactgcagcctccacctcccaggctcaaacgattcttctgcttcagcctcccaagtagctgggattacaagtgtgcgtcacctcgcccggctagtctttgtatttttggtagagacagggcttcaccatgttggccaggctggtctcgaactcctgacctcaagtgatccacctgccttggcttcccaaagtgctgggattacaggcatgagccactgtgcctggccaagtttattttttttaaaagctcagttaaataataattgttctaaataagaaaatagattaagattttatgtaacagacatggaactaaattacgtatatatagaggtatattttcttttactttttttttttgtttgtttttgtgatggagtcttgctctgttgccaggctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacrtactcttctgtggcattcctgtttatttttaaattttttttggagagtgtcgctctgttgcccaggctggagtgcagtgttacaatctcagctcaccacaacctccgccttctaggttcaagtgattttcctgccacagtctcccaagtagctgggactacaggcgcatgccaccacatctggataatttttgtattttctgaagagatggagtttcaccatgttgcccaggctggtcttgaactcctgggctcgggtgatcctcccgcctcatcctcccaaagtgctgggtttataggcatgagccgccgtgcccagccagcattcctgtttagacaatagataaagtgagagcagtcctggctgaagtggaggtggggacctgttccctcccaccttggtctcctccttgtccctgggcaggcccagcacagagtttaccactggactagaatatgcattcaggaactgttcacagcaacatttattagatggcacttaaatagaaaaggctgagcatggtggcacacacctgtaataccagtgactggggaggccaaggcagggggatcgccttgaggccaggagttcaagaccagcccgggcaacatagtgagaccctgtttctacaaaaaaatttaaaaattagccaggcacggtggcacgtgcatgtagtcctagctactggggaggctgaggtgagggaagatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgyagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccaggaggtcggggcttcagtgagtggagatcgcgccactgcactccagcctgggtgatggagcaagatcctgtctccgaaaaaaaaaaaaaattggcaaaatgtctgaataagactagaaagtgcatttttatgctaagagttttggtcttccagatggaaatgggtttggtagtctyaagtagtttagaaaaaagtgattgtgtcagttgattaaagataattcaaaactatttcagaaactaacgcttgagatttgaccttggaagaaggtgggaatccgctccattccacgagtacttgaactctstgttgcaattgtgagcatggatgacagtgctgggggataatggttttgaggccgtgtggaccaggacaactagaatgggtcctgtgggctgggcctctgatataaagaagctgcttmcctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatsacaaattccttctcaagtaagagctagcctgtagggwggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacartctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggttcaagtgattctcctgcctcagcctcccaagtagctgggattacaggcgtgcaccaccacgcccagctaatttttttgtatttttagtagagatggggtttcaccatgttggccaggctggtcttgaacttctggcctcaagtgatctgcccaccttggcctctcaaagtggtgggattacaggcatgagccaccacgcctggcccaaatttttatatttttggtagagatgggatttcaccatgttggccagactggtcttgaactcctgacctcaggtgatccgcctgcctcgctctcccaaagtgctaggattacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaaygctgaaattaactttggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctrgtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttkgctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgygtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctrtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactraggtgtggcaccgtgcacaacagggcaagtggtcaccctcagagagtggtcctgaagtcctcctccgggcagctgtgaataamactccgagagccaccccgcaggcagcttccctgactgtccaggggcctygcgtttagcgtggacycagtacatggtgggcaggggcgagtgctagcggaaactgggtttgctttttgtttycatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatamgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcraccttcccaccggtgtccgtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctmcaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtggkggatagtggaggagtagtaaattcagggtccctgcatcccackagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggcyragtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgcygaagatcatagtttgtggtttttttctttcaggcrgtggaagcagggcagarccgaagcagcccgctcctcaagaggccggtgcggacccaggcggtgctggaccagtcagatgtgtacacccatgtcctgtcagccttngtggaaaagaaggtgggcygcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagrgagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattayctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctcttttttttttttttttttcttaaaaggaactagtatattagattgtaatagaactactttctatcccccggagatgataaaaagcccctcattttcttaatcttctacttcagtgcttcaatttagtgacaaagctataaatgaagcaaatcagtattgttctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttctattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacaaggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgctggggttataggcatgagccaccgtggccagcccttatggggatttcttaatattcaaggttcaaagcaatgggaactgaacccaggtagcatcatctactacctaacactatttgctgccttatgatcctgggggagaggtatgaccaagttaaaagctgtgtattctgcacagacactgcatcgtgtctcccaattgattatctttctttatattctcaggtgaaaacttaaatatttaaaagtgttacgaaacaaagttttagtttttactctttaccaggtattttctacagtggtaaagagataggctaagccagggtgtagagttgaaccaagacgactctccaggcaccaaccgcacatcacacgctgggttctggcccgggctcccctgcattttaaatgggaaagactgccagctgtctcatgtttaacttgtctgttattttcctgcttcagcacactgccacctaaaaaggagccgtaccaacaggtacagttccacagaacgtccgttctgtccacgatgtggcagctaattcatgaattgcctgaaagcttgcaatccttagaagctgctttgtaagtacaggatccagactcttcagtcactgaggaggattactttgtggtgcgactctgccggcgtggccctgctcagggtactcacggagctgcccatgtgggcaagtgcctcttccgcgcgctccacgcggctgcctttcatgctcaccgtgaacgctctggttatgtggctgcagaactccacggagatgccacagctctgaaataaagcacttcctttaggatggctctcttcctgttgaagaccctaggcagccaccccgttctgaggatgggtgctaattacccagggcaccctgggtgctagaggaggccaagcatcccattggacttacaaggcctccatcacaccaatcttactgtaccaggaactttttggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcgagtgctctcatctttaatgattaaaagtacctgataaccacataggaggcaaaaggcactggtcggagagctcctggggcggggtgcaattttctaagtaaaaagtgaacatcctgctgtcatcaggctacaggcttgtgcaatctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcctctccatgtgtgccaagagcaagcgccagacttggtatcttactccatctttagggtttacatggaatctaagacagccaattcccccaagtgaaacaggagctagggacaaactgagactgtatgaggactcaccatcaccaggttgaccaaggatacagcgttcagactgatgccccagagccacataactccaaacatgttgaccaagaccatggcgatggtggcacacatgatgactgcagaccagagctcacagcccaggaggaccatggtcaccagaaatatcgcgcccagggacacaccgaggttgaagatagtgtcgtcaatgatggtcaggtactgttcgtagaagacataaaacacactggaggggagaggggaggcctcattaaagctcgctctcactcccgaacactgcgtgttcatcctgtcaccactgccaagtggtcagactcctttgggaaacatcccttgcagaaaaccttgctggctgtctacaagactcaccgaaagcaactcacttgacctctcatggccactgaccacccagagaagggcccagcagtgatgcaaaatgtatatttttgataaagtttctgtttataagcccaatctatgctattttatagacatttacagagagcattccacagcattctgaaaaaacacaaaaaaacaaagaatcctgatctatcctgagacactacctcaggctcagcggggtccgtgcaaggcctgaggaaaacatgctttcatttattttctgccagagctaaccggctcttaacttcttccaaacaaatccaggccttcctgctttaagcgagatcatggggaggcaggaaaaataaatcacttgtttctcctacctttctacagtttctaaattcagtagttcatacataatacttttcttcctgggaaaaaaaacccctaacaatataaaaagtctacatacaggcagcatcccaaataaccagcagttagggattctggttcattgttggccaagaatgtgggccgggccctgctctgagccgcctgctctccaagcgccccctgccttaagccattttccagtgtgtgtctcttgcagctgtgcagtggcgcagagatcaagttttgcgtctctagccctcaggccttcacagagactttagattctgaactcctttgcccagcacccatttcctttgatatactgccctgtgctcagaatggagcaggggccagaacccaacctgaaaatcagcatcttgccaagggaaccctccccactcccacccagtgtaggccctttgctgggtaaaccccattgaaaaagggcaggctttacctgtaaggaaatactcggtaggcactgccgttaatgcccatggtttcggtgacattactggctataagtcgggctttcttcagagcgtcaataaagtcagcagaggtctgcagcacggtgtggtaggtcatgaagtacgtggctccgaccctggtgccatggccaaggaggatgttaactgcagaactataggcagcatgtcccctgaggaaagaatcctgggtgtcaagagagtccaggtcttgcaaaatatcagcagaatctgagcacttgaggctaagcaaaatcacctgaccctggactcagaggtcagacccagctgtacatttcagggatgaagaaggcccccagataagggaacaccaaaggtttagcttgttctctcccagactggcttctttttttttttattttgagacagagtcttgctctgtagcccaggctggagtgcagtggcgtgatctcggctcactgcaacctccacctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaaggtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtataccaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaaagcatccagtcagtgagtaaatcaagctgcaagattca

SEQ ID NO: 12580 - DNA, 53323 bp, Homo sapiens
  misc_feature (1)...(53323): n = A,T,C or G, or insertion/deletion polymorphism (see Tables 1-2)
tctatatataagatcatgttgtctgaaatcatagacaagttcttgtgatttggatgtcttttatttctttctcttgcccaattactctggcttggatttccagtactgtgctgcatagaagtggcaaaagtgaatatccttgccttgctcctgatcttacaggaaaagctttcaacctttcactattgactataatgttagctgtgggcttatgtatatggcctttattttgttgaagttactttctttccacacctgagggtattattccttcctattgcctgagggcactattccttctttaccaattgttatcataaaattatggtaaaatttgtcaaatgctttttctgcatatattgagatgattatatggcttttgtccttcattctgctaatgtgtgtatcacatttatagattttcttatgttgaaccatccttgcatcccaggggtaaattacacatgatcatggtgaataatccttttaatgtgatgttgttgctttgtagttactgtgagacttagataaaacatataatagttataacaggctattttaagctgataaaatttaacttcaaggataaaaaaactccacacttttactctccctccacattttataggtttttaatatttttcagactttatgtttttgatgttataatttacatcttttatattgtgtatctgttaacttattgtggttataattatttttaatagttttgtcttttaaccttcattctaaagatataagtgatttatacagcacaattataatattggaaaattctgaatttgactgtatttttatttttacctgtgacttttatactttcgtagattttcatgtaattaattaacatccctttctttcagcttgaagaattccctttaacatttcttgtaaggcaggtctcgtgttgatgaactacctcagcttttatttgtttgggaaagtctttatctcttctttatttctgaaggatgggactcttggttggcagttttttctctttcaacactttgaatatatcatctcactctctctgggcctagaagcattctgctgagaaatcttgtgatagccttattgcaattcttgtctgtgatatgcttcttttctcttgctgattttaggatcctgtctttgtctttgatttttgatagtttgattattatgtcttggtgtagtcttttttggattgaacctgactggagatttttaagcttcctgtacctgaatattaatattttatttcagatttgggaaattttcagctagcaatctttaaatatgctttctgacccccttttcctctattttctccttcttaaactactgtaatgtgaacattagctctcttttttaatttttaatttaatttttgtttttattttttgagatgcagtctcactctgtcacccaggctggagtgcagtggcatgatctcagctcactgcaacctttgccttctaggttgaagagattctgctgcctcagtctccccagtagctgggattacaggcatgtgccacaatccctggctaatttttttgtatttttagtagagactgggtttcaccatgttggtcaggctggtcttgactcctgacctcaggtgatccactcaccttggcctcccaaagcgctgggattatggcatgagccactgagtctggctgaatgttagctctcttgatgctgtcccataaatcttgtaggctttcatcatttcttttcattcttttttctcctctcactgtatattttcaaaaacctgtcttcagttcacagattctttcttctgcttgatcaagtctgctactggtgatttctactgcatttctcacttcattcattatatttttcagctccaatttcttttatgatttcaatctttctgttacatttcttatgttgtgcatttattgtttctctgatttcaccaaattgtttctctgtgtttgcttcaaagtaactgagcttctttaaaaacaattatcttgaatccattgtcaggccatttgtagtactccatttcttttgggtcagctactgggaaattattgtgtttcttaggtggtgatattttaatttgggttttcatgtttcttgctgccttacactgctgtctgagcatctggtggatctgccccaatttcaggctgtatgggctgactttggtggagaaataccttcttatgtggaataatgcgaggatgctggctgggtgggatgcaaaagttctgacttcagtaggggcaaagctgtgtggtctccatgcagatctgtcagctgaggttggtgttagtgaatactacagggatccttagaggccaacactgtgggtatctacagtggcaatgaggctgttgaggttttcaattgtgacaagtcctccatatctctttttttccccacctgggaagtcatgactgaggacatccctcttggaattaggtctaacttgcaggcctgctcctggtggtggtgacactggtgtctgatgaacagtgcccatggagtggccaagagccaaggcctgaagcatgggcatgcatggagggaccacagcaccagattcaattgtagcaatggtaccagtgcccaaggcacaggcatacttactatcacattgataatggtgtgtaaaatgcaggtacttataaagcagctaaggagccagggactttactgcatgcatacgcagagctacagtggctccaggatccagggtgtgggctagctctccttggtggctgagctggtgactagagcatggacaggcacagagaaaccttgactctaggacccagggtgttcactagctcactatagtggtggctctggtgttggaggtgtgggtgtgtgtagtacagcctcagagacagggtctggagcgcaggtgtgcacattactacagcagctctggagttgagaatatgggttacctttctacagtggctgaactagtgtctggagcaaagactttcacagagagaacttggcttggggttccagggtgagatctagttcacaacagcagtgactccagtgtctgagacatgaggaggtgcactgcagccacagagccacagtccagagtgtgaatatctgtagagcagccacaacttttggggatcaggaacacacatagacttgtgagaggtggtaaccctggccccagtcctggggcagtgcaacaatagctgcttcttggtgagggggtgtgaggggtagtgcaactgtgtttccctttttagcatcctgctatgggaatggctgttggacaaaagatgccagtgtcctctgtggagcaggacactgggggcctcagtggctctgtgtcacatgactgacacagatagcctacaaatttctttattcgtagctatctcctggtgtctcatatatgccagtctcaccggtgattcttctacatggatattctttcttttctccattgtgttgttccaaattctttaacaggctcttgagccccatcccccaactccccacccttgtgagggctattttggtttgtgtataactgtctatgtttgtttttttgttggggcataaggctgacatctcctactccaccatcttgctaatgtcacctgcataggaatctttttatgctttccttatattcactaaaatttaacaatatcaaacttaaaaacatatgatcaattgaacttattaatatcaaacttattataaataagaaactaccaggctgggcatggtggctcatgcctgtaatcccaacattttgggaggctgaggtgaaaggatcacttgagcccaggaattcaagaccagcctgggaaatatagagagaccctatctctagagatttttttttttaattagccagtagtgatggcacacatctatagtcccagctactcaggaggctgaggtgggagaattgcttgagcccaggaggtcaaggctggagcaagcagtaatcatgccactgcactccagcctgggccgcagagtgagaccctgtctcaaaaaaagaacctactagtctacataccacacttcctcatccccatctgagactatatatattttttctaacatgaggcaatgccaaaaagaggggctggtgagtgaaagtaagaacagaaagacatggaggcaagtcttatagaataatagccaacacttaaacttacacttaacagcgtgataggtattgttccaaacacattaaattcatttaatggtccttacatgtctatgtatttggtgattattatccttattattcacattgctgagtgtattattctgttctcatgatgctgatagagacatacccgagactggataacttattaaaaaaaaaaaggtttaatggactcacagttccacgtggatggggagtcctcacaatcatggtagaaagcaaaagacacgtcttacatggcagcagggaagagagagaaatgagaaccaaacaaaaggggtttccccttataaaaccatcagctctcatgcgacttattcactaccatgagaacagtatgggggaaaccacccccatgattcaatgatctaccaggtgcctcccacaacctgtgggaattatgggagctacaattccagatgagatttgggtggggacacagccaaaccacatcactgaggaaactgagttatagggagattagtaacgcccaacacagctggtaggtggtggagccaggcagtctgactctagggtctggactctgaactgcatcatgctgccaagaagttcctcattttttcctctctctaagtttcccttattcccctacagtcattccttcaacagcatttccttcaccatcttttctacttctactatataattaattttttcttcttggtcccaaattccaacgtgcaaatgcagccttatataccctaattcatctttacctttagactttcttccaatgtttctacttcattccattttaaatttatccatgagatgcctatttacaagctgtaaccatcatgaagtgaatgaagaataatacctactactgtacaatagaattccaagagtataaataggagttatggctttctgacttgaaactaaatacttgatacttgattttgctgtctgagatcaatctgaaaagtaataataatcactaacatttgttgagcatcaattgtgggccaagtgtcatttcaatcactctgtacatattaactcatttcatcctacaacaacccggtgaggcaagttctgttattctgttttacagttgaggaaacagaggcatagagagcttaagtagtttgcccagtagatagccagaagaggagccaggatgggtctcgggcagtttaacagcacagctgaagtcttaaccactatgccaacagctttttggtcctacacatcccatgggaagaggaaaataaaaaggtatctatttgtatacctttttatttctgatataagaagcagaattcctttcacatgacctatgtctatttaatacgtcattttgaaacttaccaataaaatttcccaagcgccagaaaactgttagtggctttttccatttctctctatttttttttgtgctactaattttgcttctttccctcagaaggctgccggaatagtaaacattcactgacatgtcataattactggaaaatgggcactggaaaatcacattgtaattaattcaaagcatgttttccaaatgtactactttaaattggagcttatatcataatccaaggaaacctttgtgtgtgtactgttcccacattgctcagcctgggatatccaggagtaattcaccttgcgcctgcctccagaccatcttccatggaagggggtgaccccttgcctcttggcaaccactatttctaagctgccaacattactcttgcattatcaacattctaacttcatgggaagggctgtggtgagtttctggaatgtgaataggaagttgtttttctaaacagcctgacactgaggggaggcagtgagactgtaagcagtctgggttgggcagaaggcagaaaaccagcagagtcacagaggagatggtgagtttatttttttctgcatgggaagtggttgaagtgagttgragtggtatggrgtaaagtcaggcaggtaaaggttcagaaagtgaggaacagcgatagccatggagttttatgttgaattgcctattagattttgtgagtacttttaaacttgctgtccactttgaccctcccaacacccttgtgagttgaggttgctatttctattttacaaataaagccatcgtggtttacagaggctgtgttttatctaagcttcactgttaggctacatgatgttgggatctggggcctgtcctctggctccgcagstgctgttcctcctactagaatttataggggmtctctgagaatagatcatggtaaacctgtcaccccattttccaagactgtacttctctctgggataaatgatggaataaatggaagactgggtaggtgccctgggacaagcttacaattgaatagtttctcatccccatccctcccatttctttctgtgagcctatgaatcttctgggactgatctggaatatccacatagtttccttttctgccctaagactcaatcttgttaatgactcagtttcttcttctataaaatggatatagtaataatactctatagtttcatcatgaggattaaataagattttgctgaaaagcatccagatctgagcctgacacatagtaagtgattagtaaatgttagccattattgttacaataaaaagaaaattcttaggaatagtggggtttaggattcagggaagatccaaggatagctaggcattttgaactcagcaatgttatatgctcatggataagatgcacgtggttaggctacttctaattcagggaagatccaaggatagctaggcattttgaactcagcaatgttatatgcacctagataaaatgcacatggttaagctacttccaattttcctcagactttccaagagtatcccacatagtcccagggtccgaaatcctgcagtctgtggctatggaggaaccaggcaggtctctgtttttgagcacctttctgtgggactccagaaaaaagtaccgcatacacctgattcatcctactgctttgctttactatagcacacttttcaagtacttataatgtgggtttctgtgttggggaaaacaggaataagagtatgataaagagaagaggaaggagtttgagcctgtcttaagtttgaaccacaatgacctaaggatatgaattacttttgtcctgtctttttgcatgtcatacttctgaattggttaacttaaatgagcagttattcctctcttccttctactctccttggcatcctcctctatttcaaaggtatgaacttattggatcagagagttctttgagattttgatgaaagttacaacttgtctttcccagatgaaagcaaaaacatcgacataaacaccaacctttagagacaaccacaggaggttcccagacctccatgtggatcccagggtaagaacccttctcgattgcctsctgggctttatgttcagaagcccctctcttggtaccctgaaattaggcttgagctctacagcgaagtgctaaggccccagccctggaatggtttttaatatttcaaagacaagacctcttccttttcctctgagcacatttggccccaaagattcagaaacctcaaactgcctgtgtaaattttgcttcaagttcagagagtggctttaattaacttttaggacctgagaaaatgaggataaggtttttctggtggggtattttcaatcasatagatctcagaggagtagctcttgattgggaacttatagttaaattgcactgatgtttgtcaaagttttagcgggctatggccgggctcagtggctcatgcctgtaatcccagcactttgggaggccgaggcgcatagatcacttgaagtcgagagttcaagagcagcctggccaacatggtgaaacaccatatttactaaacttacaaaaactggctgggcatgttggcatgtgcctgtaatcccagctactcaggaggctgaggcaggacaawctcttgaacccaggaggtggaggtggcagtgagttgagatcacaccactgaactccagcctgggtgacagagcaagacttgtctcaaaaacaaaacaaaaaaaaagttttagtgggctaaggagcaggtctggattttcgtccatttataccttttaaccaccttatgtggcttccagtccttactcttcttttcattacctgtttttcaaaatgcaactaaaatagttcagactctcctgggctagccaccagctcttagaatgtgcatcttcagagatctttaagtagaagcttattgatcaaatcctcaaaaatcaaaatgacttactacataaaaaactgtgtttagaaaaaaccctggacctaaacctagagagtaggcacacagtggttttataaatgacattcattatattgtcttcaaggtgtctaatctttttgattaaaaagtaaatcagaaacttcatgaagtcaaatacagagcaaatcctcactatttgtagagatataactcatctctgatccaatagactttttaaaaaattttaagtgtcgtactttatttttaatgctaatattttactcaaaataatggcaattggtagtctaaattaaatatatgcttggattctaagtgttgatgtcctgggtcccttcttgtctatattcataatttgctctttggcttagagacaacctcttttctcactgtatttctttttccacccctaagctgggctaccaatatctgtgccacaccactaacaccaccacygtccagaaacataagggaactaatgtattagctgtaatagcttgtaacatctgggctttgctaccaacaagttgtatagttctgcatcctcaacaactctcatattcacctcccctatttgcattcccactgatgccagaccaaaccwgtccctctttaactctcactgggaccattgcaatagcctcttcttttgcagtgcaatctccctgattgtaactcatttaaaaaaaaaaaagtatcgcactactctcacccctataatatcagcatttttggaggccaaagaaaaagtattgcttgagcccaggggctccaggccagcctgggcaatatagtgagaacttatctctacaaaaaattagccgggtgtggtgatgcatgcctgtagtcccagttactcaggaggctgagatgggaagatcacttgaggccaggaggtggaggtttcagtgaacccagatcatgccactgcacttcagcctgggcaacagagcaagaccctgtcccccagccccacaaaaaaaatcataccaccattaagtgcatgtgttcatgatacttctctgttcagaagtatcccttctgccaactggtatttgtgacccacaagatatggtctcaaactaccttttcagttaacctctaggatctcccaatcttcagcaggctggagtgcagtagtgccatctcagctcactgcaacctctgtctcctgggttcaagcgattctcctgtctcagcctyctgagtagctgggattasaggsatrhrccaccatgcccagctaatttttgtattttttagtggagttggtttcgccatgttggcaaggctggtcttgaacttctgacctcaagggatctgcctgccttggcctcataaagtgttgggattacagatgtgagccaccgtgcccagcttccgttggcttatcattgcacttagaataaaatctcatccccttgttttggatcccaaagcccgatgtgatctgtcactacccccggctcrtatttttctctccattgctcattccattctggccacactaatgtcttcatgttctttgaacacactgcagtttgcttccaccttaaggcctttgaaatagctttttcttcttcctttaatgctcttcttcctgcttctcactggctggtttcttgcagtcattcttctctccacttaaacattatctcattaawgaggtcttccctgacgttcctgaccaacatagtgacacagtcattctatcacataagtttcatttcctacctagcacttatggctatattctgttaatatttttcatgtttacttgtttagtactgttgtgtagttattagtatttgtttcattgtcttctctaccaatagaatgtgcattctatgaggactggaattatgtctgttttcaccattttatttgttcacttagctattatcactactgtaaaagtaatgcattcagttataattattatgtatttttccaacattttcttatttagcatatttttgtcttactttcagttattcctctgccattattcattcatatatttatccataaaatgtttattgagtattgagtatgtgccctaccatggctggggattcagacctgagtaagtaatagtccttgcccttgagaagcctctgtcagtagcttcctcagctgtatgctcacatgtttgttgcgcatttaaattgtggacctcctgctcaagagaatattcagaaacggagatgctgattagaggacaytggaaacagatgaccataaggaggtcatctttacttcccaggaaagcagaagaatgagaagagaatagggccatggaggtgggaacctagagaaacacttacctctgcaagggaaggcagaggattgaggtagattcagaagaagactcagaaaagtttctcaaacattagagcagaagaacaacagaagagctaagggaagcattttaggcaaaaggaagtagtggtatttactgctacagaaaggtcaaggaagataagggtggaaagtcttcatttggtttggtaatgaggatgtcagcaatgaagtttgcagggacactttgataggatggtcgggcagtgggctggagagtaagggggaggcaaggaagttaagaaagtttagctataagaggaaggagagaaacaggcagatgtgggcaggaggacaaagggtcaagggagggacattgtttgattccgcctttctaaaagcacaaagctgtggtctacaatgtagacaaaaagaacaagatctcctttctgtggcactattcttgccaactttgtaagccacctggaacgtggcaagccatgggacacctactagcctctggtacctccttgtgtgaaaagttaggtcaaggcatttgcttcttccactttctctctgcttttctcttcaccctgcaatcattattagtttttttgcttgtttgtttgttttgttttttgagaaagagtctcactctgttgccaaggctggagtgtctcggctcactgccacctctgccttctgggttcaagcgattctcctgcctcagcctcccaagtagctgggactacagacatgtgccactatgcctggctaatttttgcatttttagtagagacgaggttttaccatgttgccaggctgttctcgaactcctgacctcaagtgatctgcccaccttggcctcccaaagtgctgrgattagaggcatgagccactgcaccagcccagttctttattaaagtaaaattaaagataatcatggtacttaatgaaggcttacacaggcacaggatgttattctaatgacccagtctctgactcctttccagcaacttccagttgaaccagccttccagagaacattaaagactagcagagcatgtggatgcttctagagaggaatttcctcttgttttagtatttaacttgcttagtaacacaggacagagcagcatcctgcagactataatgcagagtaggagcaggtatgagaaggcctgcccaccccaagcaggtttcagaggaaaactgttactcaaagaagatttttaaacatcatccattctccatacctccacacaaaatccctatcagttgccttacagttaacacagaatcttgaacttgggccacattaaacatggacagacttagtaggtcatgaaccatctgagattctctaaactactgcaagcatgcatttgttttgaagaaatctgaccacggcttttatcagattttcaaaattcataagccctggaagaataagaataactgtgttaaccctatgcacattcatgtgagcaagcttgggcaaatcatttacgctcactgagtctcagtggtggggagtggtggctgccccatcttaggcattcgaagtctgaaagacttcctgcagaacagcagataaatgctaagttggcttggaagtgacctttatgktctccyatagctctgaaataacctgtaagaggtgaatcttggtatttggtgatgcatagaaacagaaaagtatgtcagattaaagcaggggatgcacactgacttgcattttcctttcttagatgttgtgccttcatcaaaagcactgtaccagtcctctaaaaccttcaaatgtttaaaacaagttgtctcgctctctctcactttgttttatcttgtgtggtagagaatttgctgatgaaattttgcttaaaaaaagttcaaacaaacaaacaaacaggttaaaatgggaaacatctctttttggaaattttgtttaaaccaaatcttatttaaaagtttaaacaaacaagtcaaagcaggaaacagtgggtagggttggccactgtgatgggagactgggagcctcaccgactccttcgccctacacactcttgtgagctggccccaaagccagggaaatccctagaaatamkctgttcagggagaaaaccacttccacaggaagagtaccactaaatttaaaatcgttgcactccttctgcaatctgtctgaatagaggcaaagcccaggttcaaaggcaagcactcaggtccccttcatgaaggctgcagagttgtgctcttcagcagcaatatttttgctcctatacctccaaaaatatcctggaacactatgttacctcttacacctttctaagtggaaagctacaattttttatcccaaattttaaaagcaaaagaagattggattttccagtgtattacaaaaattagackgtaaaaataaaattgttacataatttcttaaagtttatccaatggaataaagtactagcatgatctgcaatcctcatcacttaaaagaccacaagcaggctcttaagaaattttatattattcatttttctctccttgaatagttatttctatcccacttctacagtatttagcctaagattacacattttaagcttaaagtattttcttgattattatacttctttgcaaaataaaaatataaaatttcaattttctacaactgtaagtctctatgtgttaaaatgtttttcttttctattgagttagcatkacaactactttcagtacacaattaaataaagtaaatatactrcaagttttgacaagtaacttaaamctttatatttaaattgctattaaagattcatctctaagacaggaggagctttccctcatttgttcatatatccatgaatgaatattacttatcaacaaaattagacaagtttggcatcaatattaytcccatatttcattttcaaggatttaaacattgagaaacttcattcatatgaataagtaaatggaattagaagttttattatagcaatgtctcaattccttgaagtccttccaagttatatgccccaaattatatagtgatttactatcaaaatktagtcagacttgacaacttaatcgggtgctccctcaaagctgatgaaaggaaataaatggaaatcactagacttgaaaacggatttgctgcaatatcatttacaatattcaaattcttaatacctataccaatatttcgaatcatctctggcatacgaatgtatttatatccaarggcaaagctctggaataaataagaaattagtaaaaggtayaatttttctcttataaagtggragaaaggtgtattttaggcagattgtttttaagaaagtatatatgtgaaagttgagaatctgaatacagatttaattaacactctctttgcttgtgaaccccttgggaagtcagccttatcctggtttgaagaattccacttcagcrtttggaatggtgcattttgaaatgtgataggaagaacagcttgtgacacaacacaattcagagaaagcagyggggttaggttcrcaccaaagggttatcgatcactctgcattttgtgcaaataaacagctgtaaatcataacgttatgatactctcagtgtttaatcataggtcctgcagagatcagcagcttataagaayacaaaatatgcctacttaccaaagtcaagattcagaagctcccagatgaaragttctaggcttatgagataactctactctctgggacacattaactggtttgagttgagttctccctggtatctggtcaggctgtagtcaaaagtgcatgaacacatgcacacacaygaccccacactgtcccatgcaccctactgggcgtgacacatacacaaccccacactgtcccatgcaccctacataatccatcactgggcgtgacacacacacacacacacacacacacacacacacaacctcacactgtcccatgcaccctacatcatccatcactgggtgtgacacacacatacacacaatcccacactgtcccatgcaccctacatcatccatcaccaggacatgatacatgaacacacacacaacaccacacagtcccatgcaccctacatcatccatcactggggtgtgacacaaacacacacacacacaactccacaccatcccatgcaccctacatcatccatcactggggcatgacacacgaacacacacacaaccccacacagtcccatgcaccctacatctcatcactggggtgtgacacacacacacacacacacacacacaactccacaccatcccatgcaccctacatcatccgtcactgtggcatgacacacacatacacacagaaccccacactgtcccatccaccctacattatccatcactgtggcatgacacacacacacacacacacacacacacacagaaccccacactgtcccatgcaccctacatcatccatcactggggcatgacacacgcatacatacacaactccacacagtcccatgcagcctacatcatccatcactgtggcatgacacatacacacacacacacacacacacacacacacacacacaaccccacaccgtcccatgcaccctacatcatccatcactggggcatgacacacgaacatacacacaaccgcacaccgtcccatgcacgctacatcatccatcactggggcatgacacacgaacacacacataacctcgcagcaaattgtcacagaccaaattgtggtctgaggcaatttgagatttctttacaggaaaggttttaggtagcagtctggctgggatagtgacaaaactgcaaatgcatagcaaatgcactgtttttatgttgatagtaatgttgagtggctttagaggggaactgatgtagcagctaggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgcaacatgaggaagtcggacaagatgagcatcactagaacttagatgcccaaaaacattttttgttgtttttttgagacggagtcttgcactgtcgccccggatagagtgcagtggtgtgatctccgctcactgcaacctccgcctcccgggttcaagcgattctcctgcctcgacctcccaaggagctgggattacaagcacccgccaccacacctgtctaatttttttttaatgtacttttagtagagacagggtttcactatgttggccaggctggtcttgaattcctgacctcakgatccgcccacctcagcctcycraagtgctggsattacaggcatgagccactgtgcctggccccaaaaacattttaaaaatattcatagatttgatgaaatcccaacagaagagagttcatgagaaataatagttgctatagatccaaggggaacaagtttactgcatatattaagaaatattaaatatatacatacatatgtatattaaacattgaatagtattgtagatgtgtacagaaatgaaaaagcaagaagataaaacaaagatccatagtacaaaatagatggcatagcataacacaatttgttgatgctctgcacctcaaagtataggttagacattatttgtgtgggtcaggaagttctcatgtgactttctgttattcttgggtatgacataccacttcttaaaaagattgttttataataataatgacagccatattaatgtgtttagctttcttccatacacattaaaaatgtatcttaaaataaaaacattggtggcacaaactactcaataaacatttgttgaatgaatgaagaaatgaactctgtccccagccttgctacagtgtccatccagggtagaacttagaagcagggcaatgagaagcaagaaggaagcagagggcttgaaccactcttccagtggaaattggcacaattatacttcaacataatgattgttaactagaattatttttggccatgttggtggtgtatggatactaaaagaaagttttctcttcttgtttcaggccaactgccaaatagccatcttgtaccagagattccagagagtggtctttggaatttcccaactcctttgcttcagtgccctgatctctggtaaactttatgytaacttttcacttaggcctaagtaattagggtagagcccagatctatgtgtgagaaatttaaggattgtagccagttggtttgaggcatgggaaaactgtccaagtccagattgctggaagacaaatgtaccyaacgccatcatattggtagaaagggcataggaaagaacttaaaatgatatatccaggacgaatgtatccattaggcacagtagacacagacgcacaaaattttyaaagacccacacaygtctgaatttcttttataattattttctttgaagtcaaagaaaatgttttaatatatagtgatatattcatctttgtaccagtgcagttgcaaaatagaatttttaatatgttagcatggaggaagaagcctacataggcaaagttgcctgaagtctatgaaagtcatratgcagccctggctatatcagaatgaagtctttaaggcaaaacaatgccctggaaatgtcagcaagggaggtacaagcatgactaaccctcatgcaggcagcagaggagagggttggatagaaacaagcctttaaataaacaggaaagaaacccatttccaggcctgattgcttgctttgtacacctcttcatgtgggaaatggcctctcctgccccgggtggactcccayagactatgataagagtgctgtagtacctttatacttttgaaacgcacattctttagttcatttggtatcaaaaacacttgtgaaaaagggctgttctgagccctatcttaataagggagtattcagacatggaagaagtagagtagttaatgaaagacaaacagccaagaagaatggaaagactataagattgyagatcaggatatctgatttcccacccgggttctgccacaaacctactgtgtttcactcattcaacaagtatttattgaaggcctattaagtgctaaactctaggctcagtgctaaggatccaaagctaaaaagaaaacaccgtcggagatttacaacctggcagatgtagmctgtatcatagaaacagacattaccgtacatggcaatgagcacaatggaggcagggatgaggtgctgtgggagcctggaggaaggaacacagagtccacctgggaaagccatggagaataggtggagtaaagtttatcagacataagaagagaggacagccaggattgtggggagagcatgtgcaaattcaaggaagtaggaattctgttttgctgagaaagtacatacagtgggcaatgaggctggaccaactggtaggctccaggtcataaagcatgttattttccatgtgaagaggtagagcytgcccttaagacattttatatgtcatttaatctgagcttgggcaaattacttatgtctccttcttttataaaaggacaggagtaarttagatgacttcyagggtccctcctaactttgatatcttatgattccaaacctttaacatcaaggatcctcagaagatgacattttcctattctgacatcattcacacttttaagtgaaaggtggaaaccactctttttccttcaaacaactacattagacataaactagtcgttgttttgtgtattaatgttctggtcggaaattcatctgagtatgcagaagcatacttgggatcacggcctcttttttggtgaggggtactaacctggcactcmctctcctttactctagaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacaggtagggccttctctactttgaaactttcctgttaaaaaaaaaaaaccctgccttctctggttggccaacataaccaccgagtcaacacaaagatacaaaggcaggacatgaaatcaaggggtaaattgttagtcaatcagtattattgagcaccttgaagaatataagatcagaattagagaaaactagctgcttaaaactagagggaaattttaatatcatccagctcacctgtctcatcttataamtgatgaaaaggacactcacgaggttttagtttctcaaggccgtggagcaggacagaagcaaagtgaggaccagaaaccagtctcccaaattttaggtgtagagcttttttttcacccctgtgtcttgtataacagagagtgtaaattggaaggaaatttagccctgcccctaggtgacacagctgtaactaatagctactgaatgtcagtatgctctaggcattgtgttattagtttatttagttcatgtgtcatttgctcatttaatattagtcaaatttagtcctcatgacaactccatcagtcaggtttttctattactcttactttgctgatgagggaaaggctcagagctattaagtaatctgcccagggttctaagctagttgatggtggagccagtttcacactcatgttgattccaaagttggtgttttttagccatgtaaactaccacattctttgctctacatttttatgagacaatttgagaatataaccaaggattgtaaatgctttatagtttctcttcaacaacaacatatctttagatccattgaactttggtgggagggtagtggtggggagtgggcaggaaaggaaagaagtaattgaaggtgaaatacttcgagtgtattttaattctcaactttaccagtgccagagtaagcagacattcctgaaagcttggtcttcctctagtcacgagcctagtgtcagagctgattccttctttctgatgttgcttccctgtccagaggggccggttctgtcctttgtagcacacgaacactgtgcctaaggatggtatggactgccccgagcaggaagtttctaagtactctgaagcttctttgataaatcatctgccatacatattctgaattctttagattttaaacacctctccctcagaagccctcaacagtacaggtatggaacagaatacacagaataaagcaagccttctacattgtccctcttctccccaagcctcctagctgaggcaaaacatatccatgaatgcattatcatataatcagatctactttataaataatgcatttatatataaataaattgattaattgagcatatattcatggatcaggatggacattaccaggatattagctcatcctactgctctcccagtcagctctctacccctttctgggctatgcctccctagaattatctcttatcagataaccttgactgccactagctgtttcaatatgccactacttccccttcacacccaaccttcaaaatccatttctgcaagacagtcttcctcaataaagcttgccaaaaaaattgcaagatagaaaaaagataaaaaattactggcataaatgatgacactcctctaacccacaacagtggtagagacatcactaattaatacaactttacctgaacacagatgggttttatctccaccaacacagtactctaagcagccactaccattgattgtcgttttgccatctragatgtaaaggatgtagagaagcatcaattatccatgggagatgagaaatagatatatttactgtaatatgaaattaagtttgattgttggaataattctccacatgtcaggaattattagacctcagagcaggctatcgaaaaaagatttattcattgaatcatcatgaataaatcatcttctccctggagatccaaaggaatagacaaattgctaacctatctattcaggaaaccctgaaatgggatagaatacagaacattgtctctttttttcccctagagttctgagatcccaaggaagctataattggggaaacatttgtatgctccaagaacatagggcaggcaggggttgctactgtaaggtattaagacattggtggggttaaggtcagggagcgaagtgaataggatgtggaccaaacctgtatccatttagctgctattgcctcctacatcttctctttatttgaacccttcccagtgtctcagtgcagcttcaccaaattcactggctgccayaggaacttcttcctatagaaccttgcatggtttatagaattttagtatctcagaattgagaggaaacatagagatcatgtagcacagcatatccacatatgacatatggatattcttttgtaatatacttccaagtgaaccagcatgtggacagggcttaagacagaggaagtaaccaccagaaaacagttcagccatagaacttacccccaactatgacctcattaataaaaacatctcagtgctttgaaagtatcaattctaatactaattctcatcaagtgcatataccctaaaatactttcttgcaggaaagaaaccatggcccttctctattctgtcacctgagtggcactatcttggtgaagaggacatggcagttcagccatagtcagtactctcttcgcctgctgtattcagactcatgaaacatcacctcataagattgtttgtcctttaccatgagtacgtcttaaacatctcatttggctcctctgtttctccactgtaggattctggacatagatttgaagcaaatgaaaggtgaaagggtttgggctctaacactgtgcaagctgagctcagagaagtaacttgcctaaggtcacatagcaagtaggcagcagagccaggattcatatcacacctgtgtgaccccacgccccacatctggtgcctaacctcaatgcagtaatacgtgacattgggcttccataataaaacaatgcttggtttgaaaaccacagcccattttgtaccacatagggtttctctgtccacacatctgtcattggctccatttgtccctctgtgtccacacacaacaataccctccttaggaaatactaaatgcagtatgaaatgggagccacgcaatactccagcaggcccctacaatgcttttcacaagggacaggttggctctctagaagatactgtgcttccctcttgtctggctagctcagtcctatctgagaggggatgagtctgtggtcaaaacgagaattcagcctttcctcacatctgtgaatgtccatgactctgacctttccatatctatgcagcctcctgccaggacatgtcctgcagcaaacaaggagagtgcctcgagaccatcgggaactacacctgctcctgttaccctggattctatgggccagaatgtgaatacggtgaggcttcctttttgttgatattattttggttttatgctagagatgatgccaagaagtaaataaatcatgttgaagtctctccagtgagaatagratggtaccagcccccctctatcatctgtctcctccactcagtgtccctagacacacactctaggtaaaaacattttattcttgggagaaaacattgactcataaatttcaaaaaagaaaagggaaagggaaaggaagcaaaaccaacagaactttcaggctaattttacttgtttgaagtaaaaacttgtgaaagaatgactatttcccaagatgcagccaatacaaagagaccaagtagagatggatagcttgggttaaaagtttagaaaattagagttaagagggttacacaaatagttacagctttcagcaaacatgacattsctgttaattctacatggaaaataaaaatcactattttgtctcctgcagtgagagagtgtggagaacttgagctccctcaacacrtgctcatgaactgcagccaycctctgggaaacttctcttttaactcgcagtgcagcttccactgcactgacgggtaccaagtaaatgggcccagcaagctggaatgcttggcttctggaatctggacaaataagcctccacagtgtttaggtatgtagaccttattcttttcatcctcactgacatagaattttgggggagaagaggacacaatgagctttctccattaaaaaatgtgagaaataatgaccatctaggttagatggaaaactctggttatcactgttaactgtcaaccagagtaacattaatttcaattttcatggtatttttttatgggtagagtgacttagtcagtttaattgttgattcgcaggcaaaaacattacaaagggacccctctttccctttgttaattgtaaagtaaacagagtacaatgatgaggacttaggggttaagaattattaatttgataattttacctaacttctctacatgaaaaacaagggtgtttgatctttccaagcagctattgaaaacaccatttaaccattctagtgcatcaacctgcctgccactttgggaaggtgtgactgctgcagaatttgaaggcttccaaggtgatggacaaaatttgtccaaggactcacactattattctgtggttggttttagctgcccagtgcccacccctgaagattcctgaacgaggaaacatgayctgccttcattctgcaaaagcattccagcatcagtctagctgcagcttcagttgtgaagagggatttgcattagttggacyggaagtggtgcaatgcacagcctcgggggtatggacagccccagccccagtgtgtaaaggtgagtttcaggtagttgggatgtataatgtccattgcacccagtccttacttagtgcatagatgaaattgaccagcttatggagaagctggcctgaattgccaaaatttaattctcttcctacctgccattcagctagattgggttcatctgagatgagaaaggaaaaaaattcctttctttccccaaacacaaatgcaggcagtttcagaatggcctcattcataatttccccataagattagaaagggtggcctctacatctataagtggacactagaagacctactgagacaggtttatagaagtatagggaatagaggacattaagaatacagcttggaggaatctttgtttttaacagactcagatcaccctgggaactggtaatccaagtctggacaaacatcattagggtctcttgacctttacatcttgctagctccacctgcatttcagaggtggttccaccattgctctctgtgtggcttttctcctttctcagtatctttctctttatccttggttattctctccagctgtgcagtgtcagcacctggaagcccccartgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgagggtaggatttttcattagcaacctccattctgtccaagaaggaatcatggcatggtagagaggccaagggctctcagtgtcggggtgatctcttctaagttcttgcactagagcaagctcttcaacctccaggaaccatggttttctcatctgtgaaatggagctaagaattgcaaggtgcttgtgaggattaagtacataaaaagtatacaattaaatagcatgtataaagtacctagcatagagcttctgctctactgacatatccgaggtataggaccatgtcctatacttgagagggagttgggagcagcggctaaggtggctaaagagagtggttcaccatgtagtctttgagggtagcctttgacaaagaagcaaaggaaggaacactgcatcgaaaaagtgtgtgatgcaatcccaggcaattacataattccrccaaaatgaattctctgcaattgcctcacaccctcagtttataaggcggacagtggtaatgggagaataggaaatttacgatagattagtgaattcccagacctggatgacaagcccaaccctgctactatctagctatgagactttagagaagtcacttaacacttctgaacctcacttttcttgcctaaaacataagagagaagagagaaacactagaggattttggtgtttttgtttgtttgtttgtttgtttgtttrtttgtttgttttgagacasagtctcactctgtcgcccaggctgragtgcagtggcrcgatctcagctcastgcaacctcygcctcccargttcaarcgattctcctgcctcagcctcccgaatagctaggattacaggcaactttttgtatttttaatagagactagggtttcaccactttggccaggctggtctcaaactcccgacctcaagtgattcactcacatcagcctctcaaagtgctgggattataggtgtgagccattgtgctcagcyggatttttggttcttaaatgctctgagtctgtaaaaaccagaggtcaaagcccagagcaaagaggtagtctttacactttgaaaagtttcagaaatagcctggaaatraaatgctttatcaaggaagagcatgaggaaaccaatctttatcagaactgaggtcactcagggcttaattgtgctcaggaattcactttggctgcactcacttggcaactgaagtctgattaggatgacatcctgtgttctagagacaaagcccggtcaggatcattttacaggactaggtaacagtgtcaacaataagctatgctagtccagcttttttttttttccctataagtccagcattttcctgtatatactcttttcagrttcaatttcacagataatgtcaatatttaatgagcactttcaatgtacaaaacactctgctcagctccagaataaaactatgaatgactgagcccaacttcgaggagaccayggtataatggggaagaatgacaatcatgtatgaacagcgcaagaacagaggctgtgggagcacattgcaggggcttctacccttagttaaggtgggaagggagggcttcctaaggaaagggaagtctaagctgagacctgaagggcaggtgagagtgagtcaggccaagaggggcatgggaaggtgttccaggcagtctctcttttggaaaatggaggttttagggttctgaacacactgaaaatgtggacaggaaagatatagcatctaggaattttttctgaggaagaacccggcccttccattacctggctttagaagataccttttccacttagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaaggtactgtaacagtggtaatgtttttctgtgtgtctcagctcgttagaggcatcagcatctgcactgagcattggcatgcctttctttatcagatattcactgagaacctactatgggccatgtcctttgtgcttgggaccagggatgagatgaaayggtgcgtgaagccagtcttaggcacatgtccactatagtatagtcaaggtgaggtttgcactgattgacacatatagggtgcattggaatgaagaagatggggcttgggggaataaatcatgcatgaggaatagcatgggatggggaagggtaatggacaaggtgtttagctcagtcctgtcacttcctgtccttaagctagtggtttagactctctgaggctcagtatcttctgtaaaatggggctactattatcagccttacctacctgcctcactagtagttgtgaattaatgtgtgtaaacgcaactttaaaactcttataggatttatagggaaaatgatgatgatgacatgttaccttataaatcacatgtctgtggtctgatttgacaaaatgatcctctttcaatatgttaggtttctaatcttttgctcttatactaaggcactcatggggggcgggtgtggtggttcacaaggattattattttttttacgaggagtacctcacactaaagtcatgttccagaagtgtaatattgacattttgtgttttcatttacggagacctctgagcaatctatgtgactcccctgggttcctaagtataccttgattttaaaatgaggcagtggtttgaaagcaggtcttgaagagatatttgtgcacccatgttcatagcactattaatcacaacagttaaaatgtggaagcaacccaaacacccatcaatggatgaaaggataagtaaaaagtattccacatacttacagtggaatattattcaaccttaaagaggaagtaaattctgacctctgctacaaacatgaatgaaccttgaagacattatgctaagtgaaataagccactatgaaaggacaaatactgtatgattccactcatatgaggaacttagagtagtcaaagtcatagagacagaaagtagaacggaggttgccaagggctcggcggaagagggaaatagggagttatggtttaatggatacggagtttcagtttgagatgatgaaaagagttttggagatgaataatggtgatggtggcacaataatatgaatgtgcttaataccactgaactgtacacttgatattggtgacatggtaaatggtaaattaaatttcatgctacgtatatctcactataataaaaaattgaacagcaaaaaaaaaaaaaaagaaaaaacaagaaggcaatagaatagatggctatacaccatgatgctgacacytagtctgagttatggaatgtattgtatatgttatctgggagaaaaagacacaatgagctctttgacacacttaaaacggatcataagggattattcaagccattgttgtctccaggaaggtaaatgtctaatcaagaaaagatagttggatattctcttaagtatccagagatgtggtctcactaacccccttcataggccttctgaatgtttcccactcctgaactcagtgtctgcatgtgacgcaaagccttaatgatattattactatctattactaccactgctactaatatagcagctaatgttcattgagcactttctatgatctcagtctaactctatgaggtagttacaattattactaccattttaaagatgagaagagacaacacatggaatatgtgtgctctcttcgtatatggttatttattttacatctttgagatcatggtgtatattataatttttactctgattttttatttaacatcatacattgagacctctctcctatctttacaagttaaaatatattatttttagtgacctttaacattcttttcatggatccaccatmattaatttccaccctcaattaatggcatttgtgtttgttttcaatattccgctcttacaaataatgtcttcacaaaaatctctaaatagattttttggtatgcatcttgattacatacttagcataaattcttgggtccaaaagcatgataacttaaaaattattgacacatgttgccaagatgytcaacaaaggtttagcatttcctaataaaatccttcatgtgccgttataattaaatgacactttttcttatcttctatgttaaacaagcccaattcaggaatccctgttcttgacactagaaagagttaatggtcaaaaatcaatgagtacatgtgtattactgtttctttattccttacttcctcatcccttagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacagtgcttggctactggaaactggaattytgttcctccagaatgccaaggtaagagtgtattctttctaacatcatggaaataaattgtaggcagtatttttaaaggctggattttagaggtgacaactatgtaagatccaccttgaaatggactggaaaattcataaatactctcactcatcctcttgtcctataacccaaggatcccaaatgcaaatgcctccgggrgataggcagattacacaagtgtcaggatgtctggccatagacagtagggcatggcccttgctaactccttatcagggtctttacccagacctgaaggctcctgccacaaaccaggtaaactcttctcacctggccaaacatggcatctggaaagaagaccaggtgggaaaaaaattgcttcagagtggttgtcccaaggctggtctggcacttctaggaaccacagggtataatggtaaaatgggaggggcagaatttacaagtacccagttgcaaacactccaagatctgtataaaattggagaaatagacttagaataaggtgaagagtgatagaaaaaagagaaaaactaatctgtatactggaggttacgggattctcagaagaaagaaatgtgtggattcagtataaacattctatctgcattgtacttgatatacatacattttttgagacggagtctcactctgtcgcccaggctggagtgtaatggcacaatctcggcccactgcaacctccgcctcccgggttcaagcaattctcctgtctcagcttcccgagtagctgggactacaggtgcccrccactgcacccagctaatttttgtatttttggtagagatgaggtttcaccatcttagctaggctggtctcaaactcctgacctcaggtgatctgcctgactcggcctcccacagtgctggtattacaggtgtgagccactgctcccggccttgtacttgatatttaacaagccagtgtgctctgtcagtattgcaacatcttgtatgaacttgaacgggttctagtcatccatgtttgtgaattgaaggatagacgtatattttttatattccccaagctttttccccctcaatgtatccaattccttagttaacttttatagacaatgctgctttttaaacgcaagattttcatttataaaaathtgcagaaatataataaagaaatgaagaaatatcctcttaaatactcctatcctaaaatagacactgttaggcttctggtatgaattcttccaatattttctccgcttttcctcctatgcaattaatatttttatgatgtatatacaattttaacaataaagttgaatggrtaaaagactagacagttctacattatttgccatacctttcactttgtatagactttcaacatttgagtgaaagtgggcagatacatattttttactaaaaggaaaccactcactattcaggtcacacaaaagcataatcacatacacacacacacacmccccmcmcacacaccccattgttaagctaggtcaacagtaaatgaatgaatgaatgaatgaatgaatgaatgaacaaatggacaagcaaacagcagaattgaatgtccttcatcgccaggcaccagagaggatggcaagcccctggacttagggttgggtgcaccttcagagctgggtctggagagaacagggcggggctgtgaccttgccccttaagtgctcatcctggctacgttgaagtctggacatatcacaaagtccacacaactttggggaagttgtgggaagaactgggaatccctgaggacagtgatcacagtgattgaaactcttacaggcaagcctgggtggtgcagggcacagattacagttcattgctccatactgtcctgcctctgggtgtttcacagcaaggaggttgccactcaccacggcttcctgtgaccttccagttcccttctgcttttagttctttatttactctgaactttctcctcttgttgctgggtgcacatcaagtgaaatacccaaatgtgggctgggcaggaaggtaccatgcagwgtgcaatccactcgctgttgtaatacttctgagagagtgttatcagacaatttccctttttaatgtcctcccacccctccacatctacccctgctgtcagaaggcaaagccacagaagagctggaaatgggttctgtggtaccaacatcctcacccacaccctttcccccataagtccttgcagtttataggcttcttgagttgtgtcctctccagccccacatacacacttactacagaaatacttttcaactagaagaaaagaaccagatctttggacaagttgatcagattgaaaggaatgtagctagagaggggaaggaatgaagggaagagaaaggcgtagaaagtgttcttgaaacctcatgctgtttaagtcagtggctgaaaaatgaccctaggagcaaggacttcatgtctaaaacaccaaaagcaatggcaayaaaagccaaaattgacaaatgggatctaattaaactaaagagcttctgcacagcaaaagaaactaccatcagagtgaacaggcaacctacagaatgrgagaayatttttgcaatctactcatcrgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccatggtggaagtcagtgtggcaattcctcagggatctggaactagaaatgccatttgacctagccatcccatgactgggtatatacccaaaggattataaatcatgttgctaccaagacacatgcacaggtatgtttattgcggcactattcaaaatagcaaagacttggaaccaacccaaatgtccaacaatgatggactggattaagaaaatgtggcacatatgcaaggattttcctttttcccatttcgaagataaagcaactgaggctcagaaaggttattgtctagtgatagattgctagcaagtaacagagccaaaatttgggcgcagattccaccacttggttgggaaagggggaagaaagtattttcctccatttctgtgtttccaatcatttgtcattgttttctggtaaggtcattggggtgtttctgaagaaggtatcaagggagaaaccagttccacccctgtctagaagcaacaaaaatgagttgcaccactatcctcccaaacagagcaccagcttcctttaaaaatcacctctaaagctgtttgtgattgagcacttcaggatgtcaatcaactgtaagctgctgctattttacacctctacaatctctaactggtgatraagcatcatgaaattcaaacaatcacttttagccaaataccatcgttgtatattaatcacacacacacacacacacacacacacacasasacacasasmgagagagagagggagaaagagagagagagttacagagttcaggttgctgaattataaaatgatctcttcttttctcctctgccatgcccatgatagccattccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaaggtaggctgtgggtctgtcctttcttatggctttaaagatgacatcagagaatggagaatcatcagggatttatataaaagtgttcttgagctgaagcaaacaacactctccacaacaatggtaatctagataaaaaagttctccctctctttaaataatattttaatagctttagttaaatattccacagtttcaagaacatcctggccaacatggtgaaaccccgtytctactaaaaatacaaaaaatagcygggcatggtggtgcaygcctgtagtcccagctactcgggaggctgaggcaggagaatcgcttgaacccaggaggyggaggttgcagtgagctgagattgtgccattgcactccagcctggtgacagagtgagactctgtctcaaaaaaaaattgcacagtttcaggaagtgctttcatgtcattatagcattcctgtttaccacaattctaaaataataaggaaaggcagtatcatctcattttatagataaggaagagacacaagcttaaagaggttaaatwactcgtccagggtcacactgttagtaagtgaaaaggctcagctctatgtcactgaaagttttacttccttacagagtcttcttcagctacattcttcatttcttcattcctacattcaccttcaactgagcattactaaatcccagccacagaccttatttagggatgggtgagatttaaccctagcataactatgtgtgcacttccctcctctctccacttctatattgaatataagcttcttgaaggcaggagctgtgccttcttcatctttataccccctgcagcagctagacagaataaaaatgggtgtgtgtgacaaatatctgttgaattgaaggtgatcatttaccagtaaaatttactcaaacacaagctttggtaatttagtggaattctcaaaggcaggggccagatcttatctgtctttaattcccctgagacatctggctggcaaagtatctagtatattttatgttctaaaatagaagtgcactgaattaattaattcatagctcctgtttagttgcaaaaggtgctattgttctaatgtattgttcagtgtagagttagtaataatgagaccagtgataatggtaataattattgcttaatgtaggactacctatttcataagcatcatcacattcartccacacaaatgacccttaagttggttattactatgcccattttaaaggtgaagaarctgaggctttgagaggttaagtagctagcaaagttcatatagcttgaagtatggagacaggatgcaaacccaggcctagtctgattatagggctagtgttttgaccactgaactacactatcacccagtggcagagcttctgaatctcaggtaagtcacttgtgaatttartcttttccactccacagattgcagctataactgctaaatgaactttagaaatggcagtgcctggtgatcagatgagagaatatgttggtagaaatctattcgtgttacacaaaaacagctaaaatattatttattccttcctgtggaatgagcactagattaatatccaaagacttgtattgctctctctccaagtcatgtgccattaggaaagtcttgtcacacccttaggctcccgttttctcaattccaaaaggagaagagtggaccagaccatctttgaggtcgcttccctggtcaagaattctgtagggtgaaagacataaaatgctaccatctgctgtcaaaaagatatactacaagttccctgagaattctagaacatgtatggaggaaagcatttgggcttgtggtttttcactcattcatttattcctcactctcttattcatttattccattgacatttctcataagttctattttcccacattttaaggctaaagaatatttaaaaaaacctttaaaaatctcattcacattttaaatcatgtaggcaaccaacatggctgctaaatctgtaatctctaaagcccttgcttcccttcactactttccagcccccctttctctgcaggaggaggcatttgcctcccactttgcaggccccatccccactcactgtcaagacccaaccctgaccatgaacagcagctttaacccactatggcccttggaattatcaaccttgactgatcctgatcttgagccctggtttttgcatttgtgtttcttcttcgttctccaaatttatgctctaaatttaggcaaatggttcctcttattttcccatatgcctgaacccattaatttttaaccctcagcactgccccctagaaccccaattttcacatggtgttttgcagagtwctaggatacatcagatggactcaggggcctccaagtaagcagaggcagtgtggcaggtggagttctcaagctgtctcttcagagtgcaatgtgagatttcattttgggggatggctctaccgatagttccactttagttagaatgccggttccctgggccctctgggatgtggcctctgcctagttgttcctcagtatctgcagggggaattggttccaggactccctgcagataccagaatccccagatgcccaagtcacttatataaaatggcataatatttgcatataacctacatacattctcctttagacttttaaaccytctttagattacgtataatacctaatgcaaagcctacacatcacttcatctgcatggattcaacatactcagcacatggcaaattcaagttttgctttttggaactttatamaatttattttttttctgaatgtttttgatccacaargagttgaatccgtagatgcagaacccttggatacagagagtcggttatttttcagccttgtctctgcctttgcccttcaggacctgaagtccttttcatgagcctaagcagtgcttgaggttcttgtgccaactttgatgatgccacctgcatgatggagtgcttgtacacagtttccgtatccctcctgtccctgcctgttggaccactttcatgatacagactgctgaattcctaatcccttaacactgtctgtcattgatcctctggtgaccatgtttggctgctgaacccaactcctaatgtctattttcactgcgtggggaggggtcctggttccaagtcccaacctcaactctgctcttctgccatgtgcctgcttactcacgtcctaaaatatggtgaactggtgccccctaaaactctggcccagctgacatctccatttttttcttcattcccccaacatttctctgaatctgtggggcttcctagttttattcctaaagtttgagtttacaatattcaactcagatacatttattattcatactatatcttctttccagaaaattattgagaaaactctatcaaactcaagtaaaatgatataatgaaaggaaacagataatttactaaatctatttgaaataatataaatcaatatgtttaagaattcagatgcaatcatgtatactttcttgatggactatagaagaacaccaatgaatacccatatgtgatagmactgccttggtagtcagtgaaaatagaacactaagcgtgcaataaatgcaaaccttatctgttttctatttttgtaattattcaggagtttttttttttttgccaaagttttagagtaggctcaagaatatgaccacttctcaaagttatgcacaaaagtcattcctgggtataactcttttcctgcatctgcactaatctccattccagcagcatccttgataactccacaaatgtcattcatcccatgtttgctgagtgcccaccatatgccggatctgggttaggcttccatgtaactcatctaggctgcccctcaaacaggtaaacccacttctttacatgatccagagccaaattcttagtatgtaagggtcaaggttaatttttacctgagagagttcagagacttttataaatatgaaagtctggatatgtaaccttggctgagcatgactgataagactgaaaccaaagcactatcccccaaatgaatttaatgctgtagtagttctcattttatactagggcccccttcggttaatttttaaaaacagtaattcctcttgtttcttttcaaaccaggtaggcataccttttagaatgcatttaaattaaattgtattcattactgtattcattcaattcataagtatttgtagaacccctcctatgtgtcaggccctgttctctgggatacagtgttcaaagaactgacaaggtccctgctttcctgcagctgacattatacatattcttcagtttaaagttgtaattctgggagattatgaaaaagttatttttgtgaaaatgttcacagatgacttcatgtctaggagttacaccagtagacatgtttcaaaaakgtttagtaaattgatttgatgtgtcagatatgaagttgttaattactcaacaatttgagagtactgaactgaaattcactgtgttattttggctatttgaatggattcatgcaataagaatccataatccttcaatgaatagcttgttactgaaaaatacatgggccagtatgtaaaagccaaatactgtacattggttttccatgagggagcatataggtcttgaagaggtttgtaaaaatcaaactatctaagtaaatgagacttatctgaccaaggtattgttktcagaatagccttagatttaaagaaagawtartcacttcatttgtctataacccaacatttattgataaataatagtcttatattagagaatyaatggggagaaargaataatgctaagaaaatatgtaactgcaataatttgtaaaaatacttttggggggaaattgtgaattaaaatttaaattcatttattcattcacttggcaagtggttactgagcactgcctcttgagatcctgggatggsagttatggaagactcaaggatgaatcattcttgggttttagacactttcccatccagtagaagagtgagggtatgacatgggacatgacarcacatcagttcagacaaaaagttgaagaattcagaggagaagagttcaggctgtggtgatcagcagagtcttcagagactttaygarttaaatcctggaggattagtgggattttaygycatraaagtggaaaaattctcaggggaatgtgagccaagaaccagaagcaataacacacaaagtcacttcagggaattccaagaaactaatctatcttgaccaggaggttttgagttttcctgtgttatctggatgggtggtattaaaatacaacagcaaaataaacaaaacaattagtgaggagattcaaatggaagaaatagtttgaggcagaaagcaatcattgcagttttaggtgtgttgaatttgagaagatggcrtgatatatgggagcaagtagtctcaggcaagaggaagggcggaaatgaaatcctggattgcacccattcaagtaagatagagggagctgcggcaggctacgaggtctctgaagcagagggtgtagagaaaatagggtgacwttgtaagttcttgagtatggctgyctaaatctttgacttctttgtcttcgtgacttgtacctatactcttctctgtaagcttaccatcctcccactgccctttgcagcaaatgacctacatgatatgttgtggaatgctgctgcctagcaaaatacctggaatataggtgcttaataaatattttttgaatatataagtgaatgaactttgtgtaacacagaacttctgaataaacttggagattgtgacactcttaatttgatactctagccatcaagtgcccagaactctttgccccagagcagggcagcctggattgttctgacacycgtggagaattcaatgttggctccacctgycatttctcttgtracaayggctttaagctggaggggcccaataatgtggaatgcacaactkctggaagatggtcagctactccrccaacctgcaaaggtaataatatgtacttgctaagacagttctacttttggaaatttattctacaacaacaaacaattatctagttcttatatgtgaactagataattgtatatattaccattatttgggtttagcaaacagctgaaggattttaaaatgtctaaggagtgacaggatatttttatgtttgtgaataaaaggtatattgattcttaagcaggaattttgtttcatggcttctttttttgaaagagctttgttgagtgaacggaatggtctccattaatttattgctgagagaaacagacaatactggggtagagtcactggtccagtttttcaaatctaggaattgaggtgcagagaggtcaatcatcatcttcctgccacatggcaagttaatgacaaagctggtgggatcattcaaatggaagaaatagtttgagacagaaagcaatcattgcagwaaatttcaactttcacattgacctttagtcagagaacagtaccatttcycaataaggcagggttgggcaggcagttggcccatgtatatttggctttctgctgaatttcttatatttctgtaccatttcttgcttctttttaaaatagcaacaacaatgactcctctgatttcttctctkggccaggagaatcatctcctcaaggatgmtttttaataattttcctcatctggttttctatctctgacactgayagtttttcttaacttccttaaatagctcttgcaggagcctcccttgttatgaagggagtgaaaagcagttattccagattagccttaactctgttaacgcttcttttaattgggaggtctctgaatkgaaacattttctcacaacagkcatagcatcacttcctactccagggktgcaatgtccagccctcaccactcctgggcagggaaccatgtactgtaggcatcatccgggramctttggttttaataccacttgttactttggctgcarcgctggattcacactcataggagacagcactctcagctgcagaccttcaggacaatggacagcagtaactccagcatgcagaggtaaggtgaaaaggagcaggcagttctgaacctgccttcctgcaagtactcaagctagccattgtgcctgtatgttgaagtctcacccaaccacaaccactactccaagtgtcatctcccttatgaaatccacaccaatccyattagaagtaatgtgtcacaggcatttcacttctgtccttcctcaygtcacaagctaaagctaatacacaagtactcagagacttaaaggaagaaacatttgyagatgtccaagatgtgttagaaaaatagrcatattaaatgtaaaacctgctatagaaattggtaaactagaagttgcatattatgtgacagtataaacattccatattttcataataatttgaacctaaataaaaagttaagccatacatgatatttcctgaagagctatcgycctacacataaagcattgagacctatgtttctttcatttttgtatcccccacaaaacatagcacagtgctttgcaaatgtcactactgataaataacatttatttgaattaaatytaatttcttgacctttamtttcytatccataaattagaaagaataacsctgaagttccctgaaaatgtagtytaaggaggatgacagtctacttctttcaaacttccagtgtccagatatgctgaacacttattaagtatttyaataaacacatactgacatgccagttgatcacaaatgtagtaataayatttagactaayagtattttaagaaccaaaattttgtaaatagtatatktggaggcaagatttatcawtgcattagcaggtatttgtcggatgctactatgtgtccatctttgcatcttggttctttggatatcacccttcgagagaatattttcatatatgtgctgttagaagagctactgtgaatattggaagtggctcatatcctttctgaccttttacattctgcctcatttattggcaatgttaggttacaaaagaaactataatctstttcacctccaatccacatgttgtttctcttgcattmtttcttttctgcagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcamctaccgtgccaacctgccaaggtacaattttcatgtgggttaagaagtcactttgatgtggaaaataacaaaatcagtgtttcttccctgtgtctttctcatagtggtcttgctttccatccccgggtttccccctgcttaataagtgtttcacaatgaatcaggcagaatctccttgccttataaagtagtggaaattaaacccagtgactgtgtaggtaatcacccctcctcttcagtgttcagtttgtgaaatgaaaccttttgcttcgttataatctctgtttaacagaccttgaagtttcaaaatgttttaaactgggagttatttcatgcagatttctaatttattatctcagaagacctttgcttaccacctaactctaaaaacctcctagcagatcttccttaattaaattccatctgtttgcaaggtatatttcagccccctattttttcccctcatagcttgtcctgactgccttttgttacataactgaatctttgccaaaaaattatgcacagtttattttatttgcctaaacttacatgtataggcttcttatgtctacaatttaatttcttttattgggaccttaccctaattcttttggaaattacagtttatatttaagtcttaggaataaattaaggccccacttttattttatttgcccatacttacatgtataggcttcttgtgtctacaatttaatttcttttattgggtcctcaccctgattcctttggaaattacagtctatatttaagccttaggaataaaataaggccccacttcccattctgttgcagtggatttatgaattccagatcttctttcatgttagcttgtcagcattcccaggacctttggtgatcctacttgatygcacatcttagagttcttgaaaactttctgggagagaaagactagtcttttgcataatacacttcttatgtcttgcatgtgtgtgtgtttgttttgtagcaggaccattgactatccaggaagccctgacttactttggtggagcggtggcttctacrataggtctgataatgggtgggacgctcctggctttgctaagaaagcgtttcagacaaaaaggtaaataggaaagagtcttctctttgcatcttggttacataaatcaaaagaaattgatttatgtaatttagggtggggaggcaaaaaccacaacttcagtagttcatgttggaaaacatttgcattaaaagaaaataaagccaagataagtgatcttgagaactgattgtccattagaatcacctagggaacttcctaaaaatatagatccttctatggggagacttggtagtgggtgtggaaatctgaatttttcaaaagctctctcccaaaattcaaatgaggctactttgcagttttgcatttggggcctctggtctaagtaccctaggctatcactaaagctaattagaaaggtgttatgcttcctgacttcactcatttcttcatgtagcagtcatttattcatcaactctgttagagtgtgagactcataatgatggtttctgatattaaggaaggaaaaatccagtaggggagacaggtgaaatcagtgccggtagtgaagtgtagtaagtgtgttaggacacaaatacaacctaggtattattagaacatagactagggatgcctaaaccagactggcaggtcagaaagcctttttcaagcttagctttgaagaatgagaggcatttagccaaggggaaaatggaaatagagttccatcagagaaaatggcatgtagaaagacatgaaagtgtaaaatcaatgagaagatggtatgtttcgcagttcagtgcatctgaatcaaaaggggattatggaggaggcaggagatgaagttaggggcagaagaagctgcccctgtattggtgacctggtgtgataagctaagagatttgctttttctcctgaaaatttgtaaagttgatgcaggatttaaacagagaagaccaaatagatgaaaactctctgtaagggaaactgtgttcatcagactgttcatcagaaaaagaactttagtctaggaattaaagatgggaacatcccatctcttaaggtttaaaacatcctttctcaatcttctccagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagaggaccctctaacagtggagaaggacaaatggccactcatgccccaatatttttaataataaatacattcatttgttggggatgggagcttttttcctcagcttctcccaatttgattttaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaccttaactttawaattcactgtaatatgtcagaatgattacatgcaatgcctgcctcctttttacaatgtcttttgcaatgtcttcttttctactctgaagtaaaatacacagataacaaatattctaattaaaatataaagtaggaataaaaygaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatggtgaacaactccggtaaagagtctgaaaacctgtgataattgtcctttgattcatatggcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctatttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggtcatattgcaccctttgaaaactatcgttagattatcaagtgttaatgccaagaattttgtaactacctcttgtcacctagaagaggttgcagcaacttagagggtataacaggtattcagtacataaagcatgaacaataacttagtgtgggtgcaaaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagantataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgtaattaaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccaggcaggcctcaggtcagtggtaacggacgactgcttccgtggtgttggcaggtggaaatggagggatacagctttgtccggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagcaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatgatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtc

SEQ ID NO: 12581 - DNA, 13896 bp, Homo sapiens
cttatttgacatctgtgtatcttctttggtgaggtgtcttttcagattttacccatttattaataggttgttcattttcttatggttgagttttaagagttctttgtgaattttggttaacagtcatttatcaaaataattttccaaatattttcttcctgtctgtgatgtcttcccattctcttgacagtatcttttgcagagcagaaatttttaactttgaattaagtctaacttatcaattacttctttcatggtcatgcctttggtgtcatacctaaaaagtcattgccaaactcaagattgtttagatttcccctatgctatcttctaggagttttatagttttgcatattacatttaggttagatttcctttttataaactttttgattgaagaataatatgcaaacaaaagtttaaaagtcataagtatacaagttgatgaattatcacaaagtgaacacattcataactatcacacaggttaagcaatagaaccagtacttcagaagcctctcttgtcccctttctcaatcatagctccctccctttctattcacacttttaaaaccatagggtaatgttgcctgtttttgaacgttaagtaaaatgaagtaatatagcatatactattttatgtctggcttcttttgcttaatgttacatttcagaaataatccatcttattgggtgttgcagtgtttaatacattttcattgccatgtagtcttccattatgtgattacatcacaattcaatgttaatggacatttgagatgtttccatttggagctgtcatgaataatgctgctgtaaacattcttggacatatcttttggtgctcactgggcacattcctattgggtatttacctaagatagatagtgagtgtcactatatttccagtttgtgccccactgtcccagcttatgcctagacgtccagagtaataattttcctccctttcattttcagaagtgtcccagtttggctaataaatgaattatgtcttttgatgaatagaaatgtaatgtagtccaagaaatcttttcctaccccgaagtcatgaagacagatgcctgtataatcttttagaagtcttattgttttagtttttacagtattttatgttcacctagataaaataaccttttatatttaccacttgtatgctctttattcactcctcaacagtcaggtttccttctggtatcatttcctttaatctgaaataattattgtcatatttcttataacgaagatctgtgggcaatgaactgtccttagttttactttgtccagaaatgtcttaacttgaaagctgttgttcctgttttctgtttccgtagtttctcatgaaaatttagcagtcatctgaatcattgtcccactgtgtgtattgtgtagtttttctcgggccgcttttgtctttggctttcagcagattaattacaatgtgcctaaacatagttttctttgtatttttcctgtctgtcatttgttgactccttaaatctgtaaatatatgccattcagcaaatttggaaaatttcccatctatttttttcccaaatgcttttatctcctctcacttttctccacctgggacttcaattactaatgttaggcattttgatactgcccacagatccctaggtctctgtttatttttttcaatctttttctctgttcttcagattggacaatttgtattgatgtattcatgttcagagactttttcctccctaatctctagtctgttattaatcccatacagtgaatatttatttccaatattgtattttttcagttctaaaattctcatttgttcttacgttttctatttttggctgagagttcttctttatttgttatgagttttttctttatttttctgcactgaggttaatcataatagtgatattaaagtctttgggaattccaacatctgggtcatctcagggttgccattatgtttcttaggtgatgtgatttgggattgtatcatgggcattgtgaatgatatgttgtggaggctctttattgtttcattttagcaggcgattagcttgattacactcacagtgtaaacatgatgtcacctgaggtgggtggcagctcaaatctcagttcagagatttttaaatttttagttggactccttaaaatcttccctgtgcatgaacagttccaggatcagccagagatgtgagcagagtttgtacacaaaatttaggttccctcctcattctctagtaactctggttgccccaggctccatcttctggttccttaggcaagattgatggtaggttctccatcacagttggaccgtcccatgccgtggtgtgactgtggcctgccctcatggcaaaactgaaaaactaggtaactcaccagatgctagattccttctccagatctttctccaaatctgcctgcttttgttcacgctccagagcccttaggttgtcattttttgtgtgttttgttaaagtgtgttgttgttatcagtgagagggttggtggttataggaatttactcgttcttactggaagaggaccccagttcattgacattaaatataattagtcatgtatttgcatttaatgctgctatcttactatttatattatacccacctattctattcagaatgtttttcttatcttgatttctatccatttaaatattttccatttcctccccttttagcttattagttaactccctgtttataccctttttgtaattagtagaaattacaaaattacttttaccttgttaacccaatgttaatatctctacccttctttaacacagtagaaggaatgtagaatacttaaattccagttatttccctccggattccatgctcctgttgtcgtgcattttaattctatgtatttttaaatcccagaagaaattactgtcattttctacactcaatattcatttagatttacacacaaatttaccttttctaaatgacattattttctccatctgtgagcttccatctgagatcatttgccttctttctaaagaccaccctttattattattttttttagtgcaatagttctagtaacaaattctctgtttttgtttgtctggaaattcttttattattattattattattgaagtatatttttactaagtatagagttccaggttgccacgtattttatttcagcattttgaagatatcatttcattgtgtcccacctcccattatttctgtttttccttggctatttttaaacgtttttcacctatattttgcttttaccagttcttctttaatgcacttaggtatttttttttcttcatatttttttttctctttagggcctacagtgcttcttgactttgcagcttgatttgtttcttcaatattggaatattctccaccattttctcttcaaatattgttcctgacgcgttctctctaatcctactgagagtgaaattacatgtatgtgacaccttttctctgtgtcctggatgcctctcacattcttcttatatttgccatccttttgtctccctgcaccttagtctggatctttttctttttttctgacatatattccagttccccagttctctgttcactgtgtctaatatccatataaacccatccatctggtaactgattttaacaatggtagttttatgactaaaatttccacttgatttttaaaatgttttctagttctttgtcaaaatgttgtttcttgtcttttaattctttgaacatattttcaagtctgtgtgtgtaaccctagtatctggatcttccacgtgtctgtttaatgttttttccctctcttggcttttggtcaacctttttttcccttataactgcttatttcttctgagcattggattttaaatttagagataatttgatgctctgaatgatggcatattcccgcagacagaatttagttttccttctagttggcagctgggaaggggacaggcgataataactcagtgactgagatgagtcaaagaaccatttcgtcctatgtgaaggctggcctatctccaggtcaattctgttcctagattgcagctcattggggtccccattgaaaacctaacatgtttgccaaggtcctcactctctgatgggccctgaactccagttttatccttccatttctgtgtggtggatggaagctctgctcagcttctcggcttctggaattgtcagtggccttcaggggatatggacaccaaaagccacattttccttcttgccttcctttctctcgcagatcttggtctgacaaagtctcactgcactggtatctatctgatactttcaaatagatttttaaaacttctttccaatttctctagttattcttattggagagtcggcccaagaaaagtaaggttcagagagaataaataaattgtccagggtcatacagaccctgaaagtagaatctctatgaaatctatttaaataggtggcacaagaccagagaaatctgagacttacagcagcctgcatgcccagccttcaccatcctttgtcatttgggtattaagtttgacagttgctatgtttaactctcttgttttacaaaactgatatccatagagatggtgtgatttgtccatgaccacacagcgaggtaatatgtgagttggggtaaaatctaggtctgtgctcctcggttttttcctgttaaatcttgctgcccccatctttttttttttttttttttttattgttacttaggtacccagacctacatcccagctttagtaagacatctcagtgctcagtggtccaagaagattcttctcatttgtagaaaattgtccttgatttatgcagccacaaccacatatgagtgtcacctgttaccttcttttttcccctctttcttcgcttctctttttatctctgaatttttacattgccactgacatcttgcctgtggctaatagacacgtccacactgagagacatgctctagtagagtgggttcaggactgcataattagtttgtcctcttttatgcctgggaatattatatcagattctctaaaaggttttgaaacgtaaggtgaaaagggaaatgataaaataaggcatttgagatttttaaactcatgatcagctgcttcccttgaaaataattcataatctcttccagaattgcttgtaaaggcttttaacttttgtggtttatctgctgttctcttaagcacatggtatatatttataggttcttaccttaaattttaggcagaatcatgaattagatactgggaataaagctgaccagaagtaaatcatttcccacatcttatctttgtaaggcctgaaaatgtgatattccacgctgtttttgaagagaaagcattttggtggttaccaggaggaaagaatggggcaggttggaagtgtcactggtctggcagcctggagacctcaattttatcccattgtgacctctcacttatgtgcgaccttggacacatcacatacaatttaggccttatttggcaatatgtaaaatgaaaaggttggacaagataccccttgggagccttacaattctcaaatttttggaaaactatcctttactgtgaggccagtgtctggaacagcattttgtaatatgaatgaggacttaaagcaattttttatttcctgtgatcttgtgggaagagggtgggtaaagttagataatctagaagttgacatttgtgttttcatgtaagcaagtcaaatgttctggactacattttgtttcaagctaaagagcttatgctgtgatgacccagcttattaagttagataacaaatgtaaggcacctatttcatttccttatcactgtggggctcagtaaggagtttccaaaagaatgaatgagagattatcatcataatatctatcacttatcaactgcctgctgtgccaagatacatccgtgagtaatacagatttggcatctgtcctctccaaggggtaagtattattacccctagttccacgtgtggaaaatgaattccaatctggtcttacattaaaaaccattgatgtggcgcctgcctcgcgcactgtgtgtgcacgctgcaaagaccagcaagctccttggaccttggagcaggcctgctgccttcatgtccactctcctcatcaatcagccccagtatgcatggctgaaagaggtggggctccgagaggaaaatgagggcgtgtataatggaagctggggaggccggggagaggttattatgacctgttgctctgctaacaactagccaatagcaagagtccgacaggccagtgtggcagactatgaagaaactgtaaagaaagcaacagaagcatggaaaatctgggcagatattcctgctccaaaacgaggagaaatagtaagacagattgacgatgccttgtrggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagacctggccatgcactgattgagcagtggaatcctgtaggcctggttggaatcatcacggcattcaatttccctgtggcagtgtatggttggaacaacgccattgtcatgatctgtggaaatgtctgcctctggaaaggagctccaaccacttccctcattagtgtggctgtcacaaagataatagccaaggttctggaggacaacaagctgcttggtgcaatttgttccttgacttgtggtggagcagataccggcacagcaatggccaaagatgaacgagtgaacctgctgtccttcaccgggagcactcaggtgggaaaacagatggccctgatggtgcaggagaggtttgggagaagtttgttggaacttggaggaaacagtaccattattgcctttgaagatgcagacctcagcttagttgttccatcagctctcttcactgctgtgggaatagctggccagargtgtaccactgcgaggcgactgtttgtacatgaaagcatccatcatgaggttgtaaacagacttaaaaaggcctacgcacagatccgagttgggaacccatgggaccctaatgttctctatgggccactccacaccaagcaggcagtgagcatgtttcttggagcagcggaagaagcaaagaaagaaggtagcacagtggtctatgggggcaaggttatggatcgccctggaaattatgtagaaccgacaattgtgacaggtcttgcccacgatgcatccattgcacacacagagacttttgctccgattctgtatgtctttaaattcaagaatgaagaagaggtctttgcatggaatactgaagtaaaacagagactttcaagtagcaactttaccaaagatctgggcagaatctttcgctggcttggacctaaaggatcagactgtggcactgtaaatgtcaacattccaacaagtggggctgagattggaggtgcctttgkaggagaaaagcacactggtggtggcagggaatctggcagtgatgcctggaaacagtacatgagaaggtctacttgtactatcaactacagtaaagactttcctctggcccaaggaatcaagtttcagtaaaggtgttttagatgaacatcccttaatttgaggtgttcggcagctgtttttgaagaagacaaagaarattaaagttttccttgaataaatgcattattatgactgtgacagtgactaatccccctatgaccccaaagccctgattaaatcaaaagactccttttttaaaaatcaaaataaaattgttacaacattaaaaaaaaaaaaaaccatttaccacttagcaacattggcagctttagttctccagcagcctacatacattttgtgctaaggagcaaagtaatcttccatttaccaagagctttttttgctttttaatgatgtattaaattaaacacccactcaccaaatatctgtgagtgttggttgcgcagatggatttgagtgtttggtgctggggtgcatcttgtcacagctgatcacttactggttctctgactgtggctgggtggagttggcatctgtctcctaggttcctcctgcccccaacagtttgtggttatggtgataaaattattgtgtgacaaatatcatggcagacatataaacagaggaaaggggacagcaattgaaagagtatcaaacacactttaaggttctaactgtttcagttaccaaggctcaggaaggcgtatgttgtgtgttaagggatccagagtcactcagacagtgttcctctccctctagcagggtatgaaactactaatggccccagaccctcatcatcactgtgaaattcactgtaaaatctttggaattttgatgagtcaaaagtggaatctggttattttgatttgcatttttggattgccagagaggctgagcattgctgcctggttttacagcccatttgtgtatttgttttgagcattgcttgtccttttcttgaccctttttaattgggatgttcgcctgttttattattgtcttagtagagattcaaaaaactctaataaggatgccaatccctttactatcatatattactaatattttttctcagttttgtatttaaatatttattatgctttttaatatgtttttcttactaaaaacctaacaatcttttcttggtttatgtctttgatgttatttttaacaaaaggcttccgggcccttgaatgctggaaatgttcacttaaattgtttttcaatattctcatgggattttttttctcatttaaaattttaatctatctggaagtaatttgggtatatgtcatgatgcatagagctgacttaatttttctccatatagttaaccagttatctcaatattattattgaattatccattactttctcactgatataaaatgacatttttattacataataaatcacatatatcgctttatatatatgtatagatatgtgtaaaattgggtcagttctagattttatctttttgttgatctctctgctggaagcatactattttgatagttgtatctttgaagtattattgtcacaactggcagagcaaaatacttgtaactcttcacagttttattagccagtggctggaatttattcctctatatggatttgagaatcatttcacaagtttaaaaagttgtgccagtgtatttatagcaattagtatataggttaatttgagagagacttagcatttttttagtactggttttccacccaggaaaacagcatctcattccatttatttcagtcatattttctgacactcagatagtctgagtgtgcgatatgatgtgttaaggcacaggttctggagtcagagagtctcagttcaaatccaagtctagccatttattagcttgtatatcagtgaaaggttttccccagtgagtgggacatagtgttgctcagtaaacatttgttgaagaaatgtttgaatgaaataatttattcctaaattttttgtttttgcagttgtgaatgagttttagtctgcatgcttgccagcaattaacattgtcagttttttagattttagcccttctactaggtgtgttttaattagtaattccctggtgacaaatgatggcaagcatcttctttggtgaggtgtctgttcagatcttttgtccatttgttaattgggtgtttgttttcttaatgttgagttttcaatgttctttgtgtatgttggatataagtccggtatcacatttatgtttgaaaatattctctcctcatatgtggtttgtgtttttattcttcccacagcttattttgaaagcagaagtttttaatgttaatataatccaatttactatttttttctttcatggatcctgctctgtagtataattttaagccccttatatcaactcataaaaacagacagggcaataatgtaaattgacagagcacacagtccataagcagcatctttcataaaactaaggattagagtatatgtctataaactaaaaaatatgagcagttagggccaaaccactgaccgtaacaaggaagtctgcaggaggaagcagctggcagacaaacagacttctggggatcccagggctggggacccagaaacttctctcaacacttgtcccaagaaggggacagtcccccaggagtggagggcttgctgttgatgtgaacacattcgcttaaagtggagggggcttcccaggctccagttggcaaacagtaaggacaaatgagaaaagtatgcccacaaagcagaagagaaactgcaacctaatatttcaaatgagctaaaagaaattaagaaaatgattaaaagttacaaaagaacaggacgaatgcaaattaaaaaaaacacaggttacatcattagacaacagaaaaatatgaaagggaattgattactcagaaaagaaatagaaataaaagcaaaaaaaaatctaggaaaggaaggtcgaactggaagaaatataagagtgaataaacagtgcagaaagcactgtatagaaattggaaaggaagaagaaaaacacagaaataaagaagacaagaaactatttgagaagtgatagaatgcaagacaggcaaaggagctccacaaatatatgatgattcattatataatatatatatgatatatataatatatattatatctatctagataggtccacatatataatacatatacatatataactcctctatataataggagcctctgaagagaaaaaaccaaaccccgttgtgtactgggaaaatcaatccaaaaggacaacatcaatgcatattctagtaacataattgcactataaaggaaaaaagtcttttggggcatctaggcaaaaagaccaagtcgtttataaggaaaagaaatcagattggcatcagaacctgagagcaatgctttaagccaggaaatactggagaagatatgttaaagataatctagaaaagaaaaagtgagccaattattctacattcagccaaactggaccctcaaatataagaaccacagacaaaactgtgcgaacatgccagacctcggggaatgaatttcccattaacccttcttgaggaaccttctgacaattactgtgactggagaaactttagcataaggactggtggttgacacgtgagactttggggtacgttagcttctggtgagacccctggctttctcagaattccataagtgttcttgatccaaagacagctgtaaaaagtggttctatgatcccttggttggaataccatttctcctctgctcaggtgttggctttgactccagtcatttggcttgtgattatttcatatccctccttttaagaagccacacaccaatgcacctgtagcttgtgtggccaattgcccacccaaaggatacatatcatcagatctctctaatatcaacaaggggaagtcatttgtttccattgagattctttctgtttaaacacaggagagctcattcaaccttatttaataaggagaaaaaaggcaattaattggctcacctaactgaaaaatccagagttagatatggctttgggcaagtcttgatctggtaatttggaagtgttacaaaggatcttgtttctttccatttctccactctgctttccatggtgttgctttcgttctcacatggtgtcaagatgttacgagaaacaacctcactacacatttctttttgataaacagtgagaatatttattaaaagtagaatagctttttcccagcattgctagcaaaatcctgggataaactgagtggactagcccaagtcaaatgactacccctaaccaattgctgtagcagtccaagtcacgtgactactcctaaccaattgctatagccaggaaaatgaaatgcttagttatggttacctgtcctcctcttcttcctcctcctcctcttcttcatcatcttcttcttttttcttctttttttcttctttctctccctccttttcctcctcatcttccttctcttcgttttcctcttcttctttctctccttctccttcttcttctttcttctttcttcttcttgtttcactctgtcacccaggctggagtgcagtggtataaacatggctcactgcagcctcaacttcctgggctcaagcaattctcccacctcagcctcctgagtagctgggactacagatatacaccaccgtgcctggctaatcttttttacttttggtagaaatagtgtctcaccatgttacctaggctggtcttgaactcttggctccccaaaagctgggattataagtgtgagccaccgctcccagcccacatgtctttagaaccaaacagagatttccaaacagaagtcagtgactcctggaaggagaaaggaaggaatggactggggaggctatctaaaaaagaatttttaaacgtgttgaattttatcaaagtgctatcttgacatttcttgagatgatcatatattgactcttattgattgtggtgagttatgtaaatagatactctaagttagggaaggcaacctacttagctgtgctctgtgggagtaactgaggttctgggagaatctgcttgtttccccttttcttctctttttccttcttccagctcttatgtgtacttctctgcctctcctcaaccctctgatactggtgttctccagagttctgtctttggtcttctgctgtgagtgatggcaaggttttaactgcctttcctgtatgctggtgtcactctccctgagcttcatacttacatatcccagagcctgactttgcattttgaaaggactagagacatctcaaactcagtacaaaggcaggggcctttgtactgtgtcatctcatggagaaggtagaaagggcaagtgagtgtgggagacagaacaaagaaagcaagcggaattcatccttttatcaagagccctctcctgtgataactaacccactctcaagataacagcattaatccattcctgagggcagagccccatgacctaatcacgtcttaaagatcccacctcttaatatagtcaaaatggcgactaaatttcaacatgaattttggaggggaaattcaaatcatagcacccctcaccactgctcctagtgtagacactcatcatcttttgtcaacaccagtagttcccaaactttagcaagcatcacattcatctggaaggccagtcattacacactgggcccacccctagagtttctgattcaatagatctcggatggggcctgaatgtttccccttctaataagttccatgtgatgctgatgctgctggttcagggaccacaccttgagaaccacggggatcattgcaggaactcctttctgatctctgttcctcccttagtctatgcacatttcaaccagagtgatccagccaactacaatccagctatgctacacctttgtccacctagcaaagcccaggcttctcaccacagcagccttctgtgacctggctccttcctccctctctagccacatggtctgttccacattgcctgggactgttcacacaaactctgttctttgccatccttgtgccattccatctgccaaaaatgctccttccatcggtcttcacttggctcattctcactgatccttcaacattgatctccagtgtggtttcctggaaatttgcctgaatccccagattgagctaagttgcccttaggtttctctggcttcatggtcatctcactcccactctgctccccactcctgtcttcagactgtgggcttttt

SEQ ID NO: 12582 - DNA, 122271 bp, Homo sapiens
aagggacattgagagggaaggcaaagaactaagagaaaaattgctggtccactgccccatgggaaaaagaagtctctggggggttgaggagataaaccaatggactctgcttctagctccaccctccccagtttctcctcaaaaagctctgcacctctcccatctttctgagaaggttctgccaaattcattgttctttggttttatcactttccccccggggcctggcatggtgcctgtgacaaggagacagcacaggtaataaaaggaaagccaaccacagaccctggagccagactgcctgggttccagctctgtgactctgggcaagttattctccctctctgggcctctgtttccccatctgaaaataaggttgatattataatagtacctacttcaaaaggttgctgagaaaatcgagtagttaattcttgtagtttgcttggaacagtatttacatcgcaagcactatatatgttttgggtatgattattacctgatattaaaattttattgggaattcaacaggttaaatgaacataatattctgagtgacaatgaaatgacatctgtaacagagattttaggactggttgttctggctacccagaagtattctagagaaatcaaaatcagctaatgaaaaaaccacagaattttctcacccttaggagtaagcagtatcttaattaagcctctcacatcatcttcccaactgataaaggtttaagaggagtgaaagatcgtcaatgaaacaatggcactatgtctccagtggtgattttaatttgccaggtctgtcccttaacagcaccctagaaggagaatgacagcaacctggagttcatctctttaaaagaaacaccagtcagggatggagatgtctgctcatggatgagaagttgcttctctagaattcacatcgtgaaccattcaaggtttttcatcactgctctccgtcagctattcaatcaagcattgagtttctagaatctctcccagaaataaaagctgaccatacccacctacccacctttttctttgcttctcactacttaaagataatcaggtatgaattctagcctcaatctatcaattaatgggatttcatgcagatcacctaaaacttctctgtgccatagtttccttaaccttaatgtaaagacataacaactagtgccctacctattccccaggatgttgggcagagaaaaggattcatctattgatagagttctgtgggaaaaaagttcaaaggactatgttcatttaaggcagaggtgtctaatcttttggcttccctgggccacactggaagaagaattgtcttgggccacaagtaaaatacactaacactaacgatagctaatgagcttttaaaaaatctcataatgttttaagaaagtttatgaatttgtgttgggctgcattccaagttgtcctcggccacatgtggcctgcaggccccaggttggacaaggttgttttaaggtaacgctccctaagatttatcctgattttcctgcccagcactctatagcttacagagcccaggcttgttcatattaaatccttacaaactgcagttggcagttcacaaagttatctagttctccggactcctagtctagtctagctctttccattgatcaccagctgcctccagattcctacaacccagtctgtctaggacacaatctaatctattttgttttttaacctgagacttgcagtttacttaaatggccaactaacttcagggaactctatcttactaaagccaccctcataatcttcaaagtggagtgttcaaggagatgcttgaggaaaatacttaagaatgcactcatggccgaggcgggtggatcacgaggtcaggagatcgagaccatcatggctaacacagtgaaaccccatctctactaaaaatacaaaaaattagccgggcgtggtggcgggcgcctgtagtcccagctactcgggaggctgaggcaagagaatggtgtgaacctgggaggcggagcttgcagtgagccaagattgtgccactgcactccagtctcggcgacagagcgagactccgtctcaaaaaaaaaaaaaaaaaaaaaaaaagaatgcactcataatagtatttaattatagcaaaaataattaggttttactaacactaatgacatggcattctcactcagtcactatgtcagaagtcatctgtcacacacagtatatgaggaggttccaagaaccagaggtaacatcaccattgacgttcattttcttcatgatgtacgccacccaccagacaaaaacaagcctgttaactgctacaaactttacaattctttgtaatgacagagaatgaccatgaaaatctttgctgtgcagattaacaatctcctggggaaagcctaaaatgaaatactgaacatggaggagatgcacagttttatttcagtgttctatgatgagaaatggctgtcaagagtatgctacctagcacttacttgcaaaaacaaaaacaaacaacaaaaacaccgcttaatctgtcccttcaagctgtcccttcaaggttaagatgacagtctatctacgagcgaggaagtcactgcttttctaaagaaacacatactttaggaaaaagtattttgaagacggatgactggaaatggttccaatattgtgatttttttaattaccaaaaacaatggtttcacctatcaaaacctttgcacactgaaaaattaggaaacagaatttgaaaacctattttttaaagttaaatgaaatttcttaatggctggaacccatttgttaagaatataaaaatgtaacaccttccaatcattcaagaaggattgacttaagatataaatttactagttgaatttcaattagaagtctttgcattgttgatgaatgggattggaaaataagtatcatgatttaataaatgcaatcaagggcatacttcttctgtttgaatctacctatctttggcaagcatcttttccagttatgacagcaattaactttcaccaaaaagcatgatttaaaaaatgttcatttttaaatttcaaccttttaatatttctacactaggcaatgttgtataagatatgtaataaaatatatgtaaatacttgctttaaaaatattacatatattaagaacacattatcattattattatcattttgagatggagtttcactcgtcacccaggctggtgtgcagtggcgcaatcttggctgattgcaacctctgcctcccgggttcaagcgattctcctgcctcaacctccggagtagctaggattacaggcgctccccaccatacccagctaattttttgtatttttagtagagacggggtttcaccatgttggccaggctggtctcgaacttctgacttgaggtgatccactcgcctcggtctcccaaagtgctgggattacaggcgtgagccaccgcacctggccaagaaaacattattttaaaatgtgtggcaaccagtggtctgtcaccacagagcagtgtccacatttgagagcatcatttttgcgggtagtatgggaaagaaagacacaattaagtcagcaacaatctagactgtgcttcaaatgctgggcagatcacctgttttggggagttctggcctaggggttggtggagacagggtgaaggaagcaggttcttttatttgccaacctatacctgatatacattaaagggaaagttcctggttcatagtaggtcttcaactgatgcttattcgtttctttttcctcttgcaatttgcatatctaccacttctaacactggtgaggtcactccagagctcacgaatgtgtatagataatttacatatacatatccaccccctcccagaacaatccaggtagtgtgaaaggagagaacttatgcaaacaccccactgcctgcagagtattttacaatggcatttacctaggcaagaaggcaaagtccactccccaatcctagtgagagtttttttattttaataatttttaaaaaaaaattttattattattagttttttgagacggagtctcgctctgttgcccagactggagtgcagtggcgcaatctcggctcactgcaagctccgcctcccgggttcaagcgattctcgtgccctagcctaccgagtagctgggattacaggcacgcgccaccacgtacggctagttttgtatttttagtagagggggggggtttcaccatgttggcccaggatggtctcgaactcctgacctcaggccccgcctcggccttaatgatttttaatcataacgctcggcaccttctgacaaatgtcacgttacttgtaaagatttagaaactgtgattctatgagagggggttatgaaaatagaattgctctggaaaggctcttccatagagttcaaagacactttacacagcctgctattaagatgcccaacccaacccgagaggaaacagcgaagggtcttccccctaagtcggtggtattagaagtgggaaggaccacagaaacgggaggaaacagttaaaagaactgacaccacgaaggaggccgcaacaaatgtttgaaaaataagatcagaagagaggtggagagagggtgagccgcagctgcgggcgccggggtaatgccggtggacgcaaagaggtaaacctgcacccgtgggcaggggcacggggcgcgggcacggtggctgggcgggcagggggtaggaaacaaaggtcggctcccgagcagaagtcaataaaagggggaaaagcagccgaggaaaagcggcgaaaaggcggcaggggtggcggtggcggtggcggcggcggggacggcgcgcggtgcctggcggggtcagggccggggtcgcccgcgggccgggccggggatccggctgagatgggaacccgctaggccgcgccgaggggcagggccggcgactgaggggccgcagaggggaccggccgaggagcgacggcaaagggttgtggggggcagggcgcgcagggaggccgggacaggggcgggccggtcggcgggagtcgcggccgcgggaaccgaggcagggaaaggcggtcagcttcccgcccccgcccccggccgccgcggcgtgaggggaaaggccggcgggcggcgggcagcgcagcgaggaggaggagcctgcggccccgccccgcgggagcgagggaaggagaaaggctcgcagggaaggagggagggaaggggggcggccggccgggcctgcgcccgagcgagcggcgaaccgagggggaaggggcccggaaggaggcgagcgcggccgcgacgccggcagtcggacgcccgctcgtgccggcctgccgcagccgccgcagccttccctgtgcgccgagcctggcgtcccgagcggccgcgaaggccggaacacggcggtcgggcgcggggcgagcggcgccgggagcccgaggcccggccgggcgtcctgcgcgaggcactgcgggctcctgcctgcgagattaggcgaggggcggaaagggaggcaaggagaggccgagaggagacaggcgatcggattttccaggagtctggtgtggaagaaaaacccacctcgaactcaaatccacaataataatccgaacgaataataagggagccgtctttctggccgggcgagagagagggagagagaagggggaacgggaggaagcgaaatctccgtttcatggaggctgaggcaagagaaaatttcggagcctggatgtggaggagcccaacagcagaactaactcaggaaattgtctttcagaaaaaggccgaacgtaggctgggtctgagaatcaggctggggtaggtggaggaacctgcaagtttaaaggaaaaagaaaaggagagaatattttcagagattatctctggtttgttatcattactaccatcttaaaggtaaaaagcattgcatttcaggtgttctttgatttttattttatttttttttttggtgcaattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagcygaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggtaggtttgctaataatttgatttttcaacattgactaaaggaaagactgggaggggtggtgttgcattttaataaatggttgaaaataggggtctgggtgggctatgggaattggtgggctaggagcattagtctctggggactgtcagcctatgtggttatgtgcaaaaacatagctcttgattcagcgtcttttgaatataagcaataaacagtgaagccaggagagggaaaggaggaggatgtgcttccagtggcttttgacttttgccagggtagaggctgaatttgagtccacccaacttgctagtctcaggtgggggcaagccagtcttgtgagctcctagggttgcactagggggactggctttaggtgttggagctgctgggagaagggccctggcagaggcgtgggcctccaccaggctggttggtatggaatggtggggcttggtgacggggtggatcccatttctagaaatgaagaggatgttcttggcctgaatgatgggacagaaacatcctttgcacccatgcaagtctggatttttaccagtagctgacatggtcccaaaatgcatagatcacattagaatttcctctcctccaagcttagagtttgaattgagacctgccaaccggctgatgctctaggtttaatcttccaagctgttcttaataagcttgactctgcaaaatgggccttccctctgcctggagccagaagaaattgttttgggctcgtaggcctgctgggcagcagcactggccctcagagtctgaacacatgacaccccttsccccaagagtctgcccagccacctctatcactggtaatgttactgtgtggttgcaattcttacctccaaatgattggtacaactttgtaaggtgtctgccttttccttccctcccctacccctcctcaacgcttctccccatgagaaccttgctgtggggggtgtgttttgtgggcactgcacacatcctaactggatagatgggtggttgaaggactgaacaagcaaatgaaaggactgggcctggaaaaaaatattattggagagatagggaagaatatttgcaagggagcaattgttccctccatgcccagtccaccttcggttatccatgctaataataatttccttttggttgtggaatgtggcctaaaatgcatataatctctctctctcaagcactaatctctgtattgcctcagagtcccatttagattagttcagcagtccctagatgggaactgacttggcagtggagaagaggaggcagacagccacaaaggatgtacggccagttcagacctccttcctcctttctgttggcctctctgcagtttgacccttggaaagggagaactgaggtgtgtcaaggtgaggaattggaatggtttacatggctgcccttcttcccttttcatcctcttggagtttgagaattagtgcacttgcctttttaagatttggatggtgaactctttctggtaaatgcaaggatttgagaagatgggaacccaagttttgggggcgtgcaagaaggaggaggcggtgagccttcctgggttgatgtgagacactcctgggggtttggatatcctcatagataaaaatctcaggatttgcccagcacattacagtttcctaagtgctttcgtagaacatatctcatttgaatctcacagtggttctgtgtgaggtagacagaagcatcagaggttattattcatgtttcacagaaggggaaactgaggctcagagaggctacctggcttgcccagtgccatcttgcctggctagtggcagaatctggactcaaagactcaaacacaggtcttctgagtctgaatctgtagctctttcattgccccatcatgtctaactaggcttctgtactggtcctgtagaatgtgtggggcaccgttttctcctttctctttggtagtagggtaaagtgcccgtcagcagtcaaggtcttcccttctacttttctgtcttggggctcctaccttgggggttcagtcttggggctcatacctgtaagtcctatagttaaagcactattttctcttgtaagatagtgcagctttgcagggtaagggtattcctcacctccaccctgcctgattctcttccccattaagagtggtaggactcagatccccttcagacatccccagctagctgcactgaatcttactcccttaactgtaggcttattcaattgtaactttgggcaacatcagcctcaagactctatggattttaaataatttacagatttaaatcacactgaaaggaataatacgctgcggattatggagtctagtattctttcagtttatcagtttgctgtgtagagagcctagtgtaaggtgctataggagagttttagaaaattaaggtgtacagtacttgctcacagagagagcatgcaactgggggactgggaaacacgtaagactcttgaagaccacataaagcaacaccagactgtaagcccctcacaagcaggracagtttggtttgcctgtatgaaatcctgtgtgcctagcttagtgtcttgcatgaggtgagtactcaagaaatgtttgacaaatgaatgttagagtgaatgaacagatcagcaagtacaaattatttcattgcgggttgtttcaacattcacgtgttaatttcaaatgtagtcaaataaggtcaattagagaaggtttcctaggtaatgtgtattttctagaaaataaatgacayaataaaggactatgtatttggaaagagattgtagctgagagtaagaaaattttggaatatttacttggcagtctttcatctcctgtagcaccctgttcaagagtgactcctgggtccatagaaagcataaagtatttgcaactattctttatctttcagtgttaatcagttgttactgaaagatgggctaaagtgtagctgttcatgtccctttcagtttttgtccatgggcaacttactgcccattaatatatattcctttcaagagtttctaaaaatgtgtttgctattgcaaacagagataatgatactaaattatttttacaggagtggtcatgagttttgctaagccatctatatctgttagcctggttcccccatggcaaatgtttttgagatggacaggagggttaggggtttgcatccatgaaacatctttcctctgcccaaagttagttcatgtgaggatcaaaccaaagtactttaagccaagagtttgtggtttgagtcctggctttccccttaactatgtgaccttggggaagtcacatgcctcctctggcttcctcatgtaaagcagtagtagttcatttctataaagtacaatccagttctcaaacatttttatatggtgtgtcatttgaggattataatgtttgtttcatctctctcacaagcctattgaaaggagcaaatcaaacgagataatgtatttcaaattgttttctaaactgtaaactctatataaattatagatggtaaattcacagatttgatttagcttcgtgcacaactttctgagctaagtatcccaaaacaaaacaaggtgactgaaatctttatatcattttgaagaatttaagcagagtgaactggctttattgttgtagaagtgcatggggtcaggaggaaggagtatttttccaatagatagggtactagaagaatgtgagaagagaagggttactgaatctccttcccaggaactctgatgaatgagagagacttcatctaccttggctcaccttaaatgtctgttagtgatggggatagaaaggatttgttctgtgatctccagccattccttgtcttaaaagcgtatgactttcctaattcaaaataaatctagacccagcaactgttctctgtcaggggtctcttcgcaccttggcttctggtctttattgactcctgggaccaagaagtccccagacatttagctgagtttctacctagattagaaggttggcctcccagaatggagacagggatccagagctacgtatgataagtcccggaaatgctgagtcttttccaaaatgtacccttgttcccatctaggggtgtgagatgagagacacaatggatttgcagctgaaacatttggcaattaatcaccattatgagaaggagcagactaagcttaacttcagatactcaaaaacatttctgaaagagtgcccttttattaatgtatttgtttagcttttttaatagacaagaaataagaaaaattaaatgacaatacgagttcatcaaaaataaaaagattttgtgaacagcacatagctaatctcctagttagtataaaggtaaaggagttctggaagctcacagcctctgtggaatggagtttagaaactctagtttgtatagtgtttcttgctgctttaatgttctgataatctgatgtttgtgaaaaggctttgttaactgttgagttctataaacgtaagaggagttattttaatctatattgactgaatctgtttcacctcttcatagtagcattgcctttaaaaattcatttttattggtttattattttttaagcttaactcaaagatatatcacgtggcttggaaactctttttgctgtggattgtggtgttccttcttttgtcaatcactatattgataaaagacccaagcatacacctgctagtggcatgcaagatcactcctttgccccatggggtaaaccgtactgaagaagttgctgatcctggtctcaaaaagaaaaaagtataacttcataaaaagtcatgttagatcttttgtgaaaggaggtttggagttctgaggaaagaacacaacatctgagttagtagacgtggatgatggagccagctttgttagcagctgggtgaatgaccttgcaaaggtgcttacctgccctcgacctcagtttgcttatttggaaaaatgagggaattaggctagccagcctctaagatttgattccttttagctattacgttctttcagcctctgaaaccagaatgctttgtgtcctttcagtgggccaaatggtttttcagaaatcattgtctggctttcctgaaaatcagtgaaaatgaaagcttgaaaagaacagagaacaaagctgcctgatcaaatgggagagaagatggaagtacagggacatggaaacatggggaggaactgagaaatccatggcccctaatagaattggaataggatttggaaggtggttttgttttttgttttttgggacagggtctcactctgtcgcccaggctggagtgcagtggcatgatcatggctcactgcagccttgacctccccaggctcaggtggtcctcccacttcagcctcctgagtagctggcattacaggcatgtgccaccacacctggctaatttttgtagatatgaggttcaccatgttgcccagagtggtctcaaactcctgaactcaagcaatctgcccacctcggcctcccaaagtcccaggattatgggtgcaagccaccacgccaggcctggaaggtgttcttaaggtctggaagaataccccaatttattgtactaaaacaattggacagatttcaggaaaaaatcacaaaaatctggcaggacttcaagggatcctcttgccctttactctggactccaaatagggtgtctcttaacctagtaaagacaggttgaaggcctctcccattttcagtgatctctggaggatggttccattagttcaacaattagaaatccctttggatacgaaacttcctctgccacaatttaaaaccattttattgtctttctattgtgatttcagcrtaggccttaaagtcactagtatccctctattaccattgttgacttccttaagattttcctcctcattttaaagaatagcaaactaagacatgaatatgtgagaaaggggctttgaaaagttagagtgaagtaatttcagagtcttgctttccagaccctgctcctttctctccagtatttgggagcagccactacaaagtggtgtgatgggatctgtagtcatcagtcacagcctggcctcaaatcatgtagggaaccaatctagcagccctcctggtgatgacctgtgatctgtggcgcttgacggttggttggacttgaaatatttatcagatggctcagtgcagttctcagtgttctgagagatagtacaggagaacatagagcttacattcttttttttttttttttttttttttttgagacagtcttgctctgtcacccaggctggagtgcagtggcgtgatctcggctcactgcaacctccacctcctgggttcaagcgattctctgcctcagcctcccaagtagttgggattacagacacctgccaccacacccggtatactttttgtatttttagtagagacgggggtttcaccatgttggccagactggtctcgaactcctgacctcaagtaaaccgcccacttcagcctcccaaagtgctgggattacaggcatgagccaccgtgcatggcctcaagcctaaatgcttgttgggaaatgttattaacaaarcaacacaaaataaaaagatggtacataattgctgaatcgttatgtacaccaaaaggtacatttagagaagagtgcaaggttggtgctaataagaatagtcaaaggcagagtagttaggaattattcaggtcgaagaaagagaagaggccatttcagactagaggagcaacacgagcaaggttctgtctggggtggcaccaacatggtgtggtctccaagtgttaagattattgtagagcagagagaaattagattgataagatgggtagggtagggagaatgaagggattcagactttatgtggtagtagaaagggagccggggaaggtttatgtattatatggtgataaacatagtrtttaaagagagaattctgatattaatatatagagcagaagagagcttggggttaggaagcctaggagtttttgtagcaatcttaggaaaagataacgagcttctgaatcagaacggttatggtggggacaaagaggagtggcaggattcccaagacgttttggtagcrgaattaaccagtattttaagactgaatcaaatttatttatttatttatttattttgagacagagtttygctcttgttacgcaggctacagtgccatggcacgatcttggctcactgcaacccctgcctcccaggttcaagcaattctcatgcctcagcctcctgagtagctgggattacaggtgccygatcccatgcctggctaagtttttatattttttagtagagacggggtttcaccatgttggcctggctagtctcaaactcctgatctcaggtgatccgcccgcctccacctcccacagtgctgggattacaggtgtaagccaccgtgcactgccctgaatcaaattttattcccaaatttatgagactggtggactaggagaagggtagtgctattgatagactaggatcttcagtagaagtcattttgtctgccattgatacctagcaatttactgaatacagtggatacttaaccttccttagacccttaggttaggccatttctaccaaatagttttagagctcttcaatacagctttttaagagaagcaggaggctgggcgtggtggctcacgcctgtaatcccagcactttgggaggccgaggtgggtggattacctgaggtgaggcgtttgagaccagcctggccaacatggtgaaaccccgtctctactaaagatacaaaaattagcctgatgtgttggtgcacgcctgtagtcccagctacttgggaggctgaagcaggagaatcacttgaacccgggagacagaggttgcagggagctgagatcgcacccctgcactccagcctgggtgacagagcaagactctgcctcaaaaaaacaaacaaaaaacaaacaaaaaaaagtgagtagtcagttctgggagatcccttaggaagttgggtcatggtttgaggagattagcatgtatttgatggatcctgattaatcagccwtatatatatatatatatatattcatatatgtattcatatatgtattcatatatatattcatatatgtattcatatattcatatatatattttcatatatatattcatatatattcatatatgtattttcatatatatattcatatagattcatatatatattccatatagattcatatatatattcctatatatagattcatatatatattcctatatatagattcatatatatatattcctatatatagattcatatatatatattcctatatatagattcatatatatatattcctatatgtattcctatatatattcctatatatattcctaaayatatacatatatatattcctatatatatattcctgtatatatattcctatatatatatattcctgtatatatatatattcccacatagccacccaaactctggggctggagggccatctatgtggaaatcattctagttgactaatgtagagaatataggactttaagtgagccccagctgagtgactaactagctatgtgatcaggataatttgtaccagcctgaccaacatggagaaaccccgtctctactaaaaatacaaaattagccrcacgtggtggtgcatgcctgtaatcccagctactcgggaggctgaggcaggagaatggcttgaacccaggaggcagaggttgcggtgagccgagattgcgccattgctctccagcctgggcaacaagagcgaaactccatctcaaaaaagaaaaaaaaaaaaaagcattttgtgaattccatggtgccaaacatacggtgagtkttgttagggcatttggtttggcagggaccccagattgtcctaaactctcctcagctgccactagaatacccatgcttgaattaccctcagtcctgtgctgattctcaactaaggacagacaggcatggctgtgggaccatagtgaacaaacacaggacagtagttaaaaatgaggggcctaagcgctcatcccaaagcagatcctttgctagaaacccacaatgtctttccttcctagcccaagctccccagcttgggattcatgacttctttcttcagtttagcscacatctcaataatcgtaggtctcattactgtaccctgtcgccctgcttcgggtagaccagcctcattcctgggcccacatccctctttgcacacctttatatcagtgttctctgtcttctcccaactccattactcttatttccttcaaggaagtctttgctggttaatatcaccaaaccctacacctttatattattcagcattccttttgcacatacatacagcaattcaactttatcttatttgcttgtataaaataatttgtgtaaaagttctagcagaatatctagcacgtggtagactgttatgttggttcttttatatggttcttgtgttttatcctgttcctaagggttcaagagcagtgtctcctcattgttctgggttgtcttctttggcccagcttagttctctttagacacggtatactccctatgtgctctttcctgactcgaacacagctcattcttgacactgctgattcattccatgcctaaccaagggattttaagaaagcaagctctaaacactcctgccaggaactaagaccaaaattcctctcgttctcattgggtgctaggtctttggtacttggtatttcttgcagggacagagcagccttgttggggttgcctgccttcagcctctcagagttctggggatttccccatggcggcttgatttccgggctgcctttccctgcaggagtctgatgggcacaaggcctaccctgccattgtcccgcctgccccaggctggccccattcatttcccagagcagggccttcagaaacttccccccaagagactgctgctgcagagaaaggccactgttgttctggggggaggtggctggagagagtgtagtaaatagctatgtgaatgggaccttgtgtgcagctagaaccacagaccctcttcccttcagagccccagggagaggggaaaaataccactaggatttcagtgtcttcacaggaacagggtttcaggtttgggaarcattcatgccatccctcaaataagaagcttggtctgtttaacaaatcttcacttatcgtagtgctaggcatcaaggattcaaccagaatatgctgcataccttgcccttaaggagcttatggttttgtggagggagacagaagtaagtatgatagcacccaaacttactcctgtgataacagttgaagcactgggagagacacctaaagaaggtttcctggtggaggaaaggacctttacattgaggccaaaaaataaaagctaggctggagtaagggaaagtctaggcagagggaacagcaggtacagaagcctcaagcaagaaagagcatggtgktgtgagaattgcaagtggctgtgatctgtagtgagaccatagaaccattaattaaatgaaactggagaaaaggaaaatgagtaggagccaaggcctgaggaccgtgtaatgctcttagaggttttggacttgatcctgagggcagtggaagatcattgtgagattttaaatagagggtgacatgatcagatatgctttcacaaaagcaagatcaccatggctacagtgcagacatgggattaaacaagtgaaagggtggagagagggaagatgggttaggagacctttgtagtaaccttgacaagagatgaatgtggtctctgctacggaagtgacttcagagagggagaaaaatgagagatcagaggttacgaagttgattatatgggggtatgcggaggcatgaaggagagtgtggggcaaggatgatacccttacccttctcttgggctactgcatagtactattcaataaaaaaaaaggaactctggaggaagaacataagatggttgagggagagaggaggagaggagtcagcatccctttggacatgttgtgtttgaagtgcctgtgggagatccaaggaaagatgttcagcagacaactggagcttgggctggaggtcaggaggggatagagaatcacattagcaggtcatcaacacctagacggagcagcagaagcataagactgtccaggggcagggtgtagagagagcaaagggctgtgcacagaaccctgagaggcatacatttaaaagggaggtgaaggaagatgagaggcatacatttaaaagggaggtgcagaagagactggcagggagtgacagaagcaaccagggcagtgaggaacctccaaagtaaagagagggagtgattaacaatgtcaagttctcctaagaggtcatggacgaaaaggacagagaaatgcctggacttagtaactgggaggatgttcatggcctccgtgcgtggtttctgggcagtagcaagggaaggagccagtttctagtgggtccaagtgagaataggaggtgaagaaatggtgatggacatagtctagtcaattctttcatgaagtttcrtcagaaaggaaaaaaaaaatgtcgctcctggtcctgtcaggtaggactttaattttttcaaggtagggatgtattgccctaggtcagaggttctcaatctttagaatcctttagaatcagctggagagcttgttaaaatacaggtctgtgggccccacccaaaacgttctgactcagtgtgtttgagctgagtttggggcctgaggatctgcattgttacaacttcccagatgatgccaatactggcattctgtgcttccagagccactgccttatgacatctgtgctcttaacgaactctttttatgttctcagaacagaacttttgttcactgtctatttcaaaacttgtcagtggctctactctgctgggaattgcttcggtggctggtgaataccttggagcagactggtcactttgtaagcttaacgtaagctccccatctgggaaaccttgcttaccccatttctgtctacctctgacataggtgcaaataaatcctgtctactagagatctttaaggatggtgggcttacaggattttttgtaatttcaaaattaaagcccagaagagtcatacataagagaaatgtcaaagcttatagtaaatgtcaaaatcaaatatatataatttcaataattcagttttggattaagtgagagaataaatttcctaaaatggtttctcaaactgatcccaggttctgaattttccagtggtaaggatccttggaatgtcattgttgcctcttagaatgttgttagagctcttaacacgtggttactgcactcaaagagcttagggctccagaacatgcttccacagagtgatcggttgttctacgcttgcaggagtccacaccaccactatggcttctctgctcaaggggtgggagtagggatcccatgcagttctggggttctgttctagggcctttgccactccccttgaaattgggttcagggaccacactactgtggtttctgagagccccctgaccttcgagcctcttcctcctctcctgcttttctttttgccctgtgcattagtgggccgtttctcatcatctccaggttctccagaccaatggctctgagtctgagatgcagatrtgggtccgaggatagtggtaggtacatgacatggcctggcaattcttgtgccatagggtttcctaaataacacttcaggccttaggatcatttaattaagtaatgggaaacccagaagaaatcctagttctcttagctcagcctagttcagggctaatagctacacttctgctggaactcatgcctggagacacatccttttactaatcctgaacttgaggcctggcaggttgagaaagaactgggcaagatacggggggagagaccactcccttgttaagatcctccttcccatttgttggtgtggcctatgggaattttaaaattcattcagcacatttactgaatacatattaaatgttaggcagcattccgggcactggggatacactggaactttcactctgctggagcaagagagacaacaagcaagtgtttaaaattattattattgtgatccatcatataaatgaattttataagacctgggttcataactgctgtgggagaggcaggaggaaagatgtgacaggattaaaggagggattagagtcaagaagagaagtcagtttttaaagtgggccagggcgggggcgggggcataattcatggyaagagaagaatggaagcttgaggacccagataagagtgcagtgatgatgaggcttcttggtatttctgcactacaagatgtatttggcaaagtgtcttgtccattatctcattgaggtggtccagggcaaggattttcattcccattttatagatagggaagcatgctcagggaggctttagtaacttgcttaaggtccagaaactaagaagtaatggagttgggatttttttttttattctgtgcctactgagccctaacctagtgctgttcctcttttcctatacccctgtcaaggcttggtggtaaaaatgtgtaattcttaagggagccagacatcagatttgcctgacagtagtgamagacagtgaaatttgcctgactaggaaagagataggtaaatcaggagtcaagtcccccaagtttttctgtctcttcccaatacaatttccttgtccatggcccctttaggacctgaggtttgcattcactgtctaagaagaggataagtccctcttctttgcctcctcattggttaatggtggggagagtggcacgctggggctggtaatgtttcagtgaggctgggaaagatgcaatctcctcaaaagtggctcagcactctgccacttagcagtgcagcatcttttaagctactcaggggccctatctttgtgtacactatggtgcctgggactgtgtagtaaatggatgctcggtaaagttttattgaaaaacaggtacaatttttttagttaacagctttattgagatatacaataccataaaatctactgctttagagtgtacagttcagtgatttttagtatattcacagagttgtgcaaccatcatcactgtctaattttaggacattttaatcacccccaaagaaaccttggcccattagcagtcactccccattgcccccttcccctaacccctgaaaaccactaatctacttttttctctatggttttgcctattctggacatttcatgtagatgtaataacacaatatgtggtttgttgtgtctggcttccttcacttagcatgatattttaaagatttaaccatgttttagtgtgtataagtacttcattctttttatggttgaataatattccactgtatggatagactactttttgtttatccatttatcagttcatggacatttaggttttttccactttttggctattgtggataatactgctattaacatttgtgtgcaggtttttgtgtggacatatgtgttcatttctcttgggtgtatacctaggaggggaattgctgatcatatgggaactctggggaactgccaaactgccttccaaagtggttgcacagccgggcacagtggctcacgcctgtaatcccagtgctttgggaggccgaggcaggtgcatcacctgaggtcaggagttcaagaccagcctaaccaacatggtgaaaccccatctctactaaaaatacaaaaattagctgggcatggtggtaggtgcctgtagtcccagctactcaggaggctgagaggcaggagaattgcttgaactcaggagctggaggttgtagtgagctgagattgcgccattgtactctagcctgggcaacagagcaagactctgtctcaaaaacaacaacaacaacaacaacaacaacaaaaaccaccaaagtggttgcaccattttacatttccaccagcaatctgtgagggcccagttttttcatatctttcttttttttttttttttttttgagacagggtctcacttcagttgcctaggctggagtgcaatggcacaatcttgacttactgctgccttgacctccccagctcaggtgaccatcccaccttagcctcctgagtagccaggactacaggtgcatgccaccacgcctggctagttttttgtatttttggtagagatggggttttaccattttacccagctggtctcgaactcctggactcaagcactccacccactgcagcctgccaaagtgctgggattacaggcatgagccaccacgcccagccagtttctccatatctttaccaacactttctttttgattatagctaggattgtgggtgtgaagtggtatctcacggtggtttgatttgcatttccttaatgcttaaagatgccaagcatctttttatgttgattatttgcatattttctttggagaaatgtttactcaaatcctttgcccatttaaaaattggggttatttgtgcttttattgttgaggaatgaatagaattttaagctaagtcatttaacctctcttggcctcagttttatcaattgtaaagtgggaaagttggatttgatctctgagatcgattcaaatatagtattatttgatctttggtaatttggtcactcttttagggctctactcgccatcatgttgcagtccagtctggtaattaggggtatgacttttatgttgaatcaacctaggtttcctgttacttaacctttctacgcctgtttttccctttggaacatgagaaaaaaagtatttctttcatgaggttcctctgaagattaaataaaaataatgcatgtgaagtgcttagcaaaatacctgatgtagttaagaattcaataaatgtcagctattattattatatcattacttcatgtcttatagtctccaattaacaagccagctccccatcccctggatgtgacttgcttgtcctgatcttggagcctttgcacagatcagtattgttcagtttatccattgctcccaaacaggggcttaacgtaattctaatcatttattttgctcagaattctggcggttgattgggctgagccaagcagttgttttcacatgaggtctctcatgcagctgtagtcatatagggatagggctgggcttccagagacttcttcactctggcacctttgttggaagggctcaaacagctggggcttgaaacagctagagctcttcagggatctctctttctctttcccaccaccctttctctggaatctctagattatctttctacatggcgacctcagagtagctgacttcttaaaaggaagatgaaggctctcagagcaagcatcgcaagacatttgcagaggtgatgtcttgatgagctagccttgggggtctgttagttgaggcagtcacaaaggccaacccaggatcaggggagaagacatagactctacctcctgatgggcagtggcaaggctgtgaaagagcatcagggatgggaactactgttgcagttacttttggaaaattcatttgccacaattatttaactcctttattgttaatttttgtccctcctctccttcaaataccagttcaaaactaacttactagtgaggtcttaccttattaactctccttgatgtgggtttcttctttctcctatagctctcaccatgtaggtcccttttgatttttatatgacatccaattatcttttcttgtgcctctgtatctgtcaatactcccacagtacccacaaccagacagcactcttttttttgtgtgtgagacagggtctcactctgtcacccagactggagtgcagtggcgtgatcttgatcttggctcactgcagcctggatttcctgggttcaagttatcctcccacatcctgagtagctgggactacaggcatgtgccaccgcactcggctaatttttgtatgttttgtagagacagggttttgccaagttgcccaggctggtctcaagtgatcctaggctcaagcgatcctcctgccttggcctcctaaagtgctgggattacaggtgtgagccactgcagccagcctagacagtactctttaagtaatgttgaccagctacctgaaagagtttactaaaaatctccaattagggtttttccaataactttaatcagctagtgatcaaatgttgactggttctctcggcattaaaaattctcacactttttcagactgacccccaactctggtccatgctgcactttagggaaggccaagttctccacccgtttgttttctcacatgttatcacatctaggcataaagattgatagacactgatagacagtgggtcaggatagatccataataacagttagcatttgttcagcactttactgattttggaaagtgctttaacaacagggattctgaaacatagctgttacagttattattctccttaatagtgagaaagctgaggctcacgggagttggtacttgaaatcacatagcattgaacctatgctctgaccctaaatcctggacttcctccccttgcttgaggaaggcctctggcttggccccactggatctcggaaattgccttctaccttctagtctttgttgagggtactgaactttgatgaaatctcttctacagttctagccctaccttctctattataatcatctgggtgatctgggactcagagctttgttttcctcacatggtcttgcctctgcttctttgattatttaccctggagattgtgttgcttgggcgccctatgagcttggttactttgaaaaaatgcactcccattaggggaaattgtgtgtgtgttctaggaggatggtctgagaaatagtgcttaataaaataggaagcacagaatgggcaaaaggacaggaaggtagctacagaaggtagagaaaagaatctcccaaagtggtaactttgaagttctcttttcttcagttgaggagagaacaggcagatgcaaaactgatgctgtctctgcctctgactctgctggtatctgccgctgactgcagaatgatacttacgtcatcagggactcttcactgagaattggcttcattttattttctgtcttgatgatcaaatatttggtgaatgtagttagggtgctgttgcaagaaccaggacataaaccaggcaaaggataagaatccacttaatacaataatccttgcagtaccaagcattatacagtgtttttattcttcaaagcagtttccatctattgttatacctaccctcatcacagacttgtaaggaagaacctgggcatgaagaaggagccatctccctccaagtgacttagtttcccttttctcctctccttccttctgcctgggttcccataggacacacttttttgacagatctttccagcttttgaaattgcccccttctgatataacttagctccttgatctatcctcccttgaatagagtgccttccctccctggtagtaattaacaggggagcccgctcatctgtgtggctgcccagactgtcatcatcaatctcacggagagccctttatatgaaagctacaagattagaaaataaattggctagggcagaaagattaccaactcaggctaggaacccgcatgttcaggaagatgtggtggggaggggtgctgaggagggaagaatgaggtaactagctggcagcacagatcctcctggaatccaaggtcctttttccctctctaccagatttatgccctgtctcatttcagctaccattgtctcagtcagcatctacacctactttgtattgtgygcttatttatcttcgacatgcatcggggaagataatggagacaagtagtacttgcctttagggaacctcaggcctgttggaaaggcacctgcaaaagacctaagaacctggaagcagcagagtacatcacttgaaaggaagagtaaaggcaccacagcccacagcaggagtgcttactgtctgtaccatcagtttggtagagataacaaatctccccttctctctgattttacttgcaagtcttatttggcaattaattgacttcagcaagagatgttcattgatcctaagttgatgtgcctgcactgtgctagacagaggttgtggggatttaatttataagaatatacttaacatgaggtatgtgttcaaaaaataggaaagtaatagtcattccaggtgccagaggagtgacatatctaacacacattttaaaaggttttccctggtattgtgaatacacaaggggttcaagagaaaacatgagagaactattaagctattacagtagtctagtcaagagatgatgggcataattatggagttaaaaatctgttgttttgactatggcatagatacaaacttctttaactgtggaaaaagataggtttctgttttttttttttgcctttcacccattcattttatctttaatacggcttttggtcagagatgaaaaggagattattataaatggaccctcaagtcaagagataaatacattaaaagatatttacatagcatagcaggctgggcaccacctatacctgcagacaagttttttgaggttagcgagttggctgatttaattgctacttcatctaaccttcatgacttcacaatccatagccatttattttgtatcataataatcccttgtgtatgtgcagcacttggagttttatagtttgagaattttcatgtatattcttcttttataacagctttttgagatataattcatatgccatgagattcacctaaggtcgtgcacccattatcactgtctataattccagaaattttcatcaccccaaaaataaacctcaagcccattagcagtcacttctcattcccgctccctacagtcccaccaggcaaccactagtctaccttatctctatggatttgcctatttgggacatttcatataaacggaattatacaaaatgtggtcatttgtatctggcttctttcacttagcacgatactttaaaggttcattgtggtgtagcatgtatcaatacttcattttttttatgccaattaatatcctgttatgtggatataccgccttctatttatctgttcatcagttgatggacacttgtttctactttttggctattatgaataatgctgctatgaacatttgtgtataagttttatgtgggcatatgtttttatttctcttggttgtatatgtaggaggggagttgctggatcatatgttagctctgtgtttagcatgttaaggaactaccaaacttttccaaagtggttgtaccattttacattcccaccagcaatctgtgagggttctagtttctccacatcctctccagcagttgttattatcttttttttttttttttgagatggagtctcgctctgttgcccaggctggagtgcaatggcacaatcttggctcactgcaacctccccctccctgtttcaaatgattcttcagcctcagcttcccaagtagctggtattacaggcgcatgccactgcgtctggctaatttttgtatttttagtagagatggggtttcaccatgttggccaggctgatctcaaactcctgacctcagctgatctgcccgccttggcctcccaaagtgttgagattacaggcgtgagccaccgtgcctggcctattatctgtcattttattatagctggacagtgggcataaagtagtatctcatggttttgatttgcatttccttaatgactaatgatgttgagcatctttttatgtgcttattggtcatttgtatatcttggttagagaaatatctgttcacgtcctttgcccattttttatttaagttattcgtccctttattgttgagttttaagagttctttatagattctgtatactagacccttgtcagagacatatgattggcaaataatttctcccatctcatggattgtctttccacttttattgatagtgtcttttgacacacaagacgttttaattttaattatgtctaatttcttttgttgctatgcttttggtgtcatgtctgataaaccattgcctacctcaaaagtcacgaagatttactctcatgtttcttctaagagtttcatagtttaactcatatagtctatggtccattttgagttaatttttrtgtatggtatgaggtaggggtccaacttcrtacttttgcttatggatttctgattgtcccagccccatttgttgaaaaaactattctttctccatttaattgtcttggcacctttgttaaaaatcagtggacccataaatgtgatggcctatttctggtttctcagttccattccattgatctctgtcattatgccagtactacactgaagcttggtaataggttttgaaatcagaaagtgtgagttctccaactttgagtttttttcaagactattatggccgttctgggtcacttatatttccatatgaattttaggatcagcttgtcaatttctattaaaaaatcaacagagattttgatagggattgcatcaaatctgtagataactttgtggagtagtatcatcttaacaattttaaaccttccaacccataaacatggatgtctttctatttatttaggtctttacttttttaaatgatggtttttagttttcagtgtacaagtcttgcacttcttttctcaaatttattcctaggtattgtattctctttaatgctattgtgaatggaattgttatttttaatttcattcagattttttattgctaatgtatagaaatacaattgaattctgtatcttgatcttgcatcctgcaaccttgctgactttgtttttattgtaataggttttgttgtggattccctatattttctctatgcaagatcattccatgtatagagataagtttttcttcttcctttcccacgtggatggctatttctttttcttgtctaatttccctagctagactcagcacattgttgcacagaagtagtgaaagtggccatcctcagtttattcctgatcttagggagaaagcattcagtttttcaccattaagtatgatagctttggcttttttatagatgatgttcatcaggtagaggatttctatttctagtttgctgaatttttttattgtaaaagggtgttggattttgtcagacgctctttttacatctattgagatgatcatggttttgttcttcaatctcttaatatagtatgttacacaaattgagattcatrtgttaaaccaaccttgcattcctgggataaatcccacttggtcatggtaaagaatcctttatccatattgctggattcaatttgctgatattttgatgaggatttttgcaaatagartcttattggatccttgaaacaaccctatgtgattagggtccayatgaagaaactgaggcataagttgtttgcctgtgaccacatagtgtcaaactggaacaggaatgcaagacttttgaatttagtctaactttttttccactgctttatttggcctctcgtttagcatctataacccacagttgattccatttatttaaacgatttccttttatgaaacaccatcattactgtcttggactgaaaacttccagagggtggtcttgttaatgctctcattacatgaccacctaatcaggacttaatattggatccatttgaggtgataatgaaatttacatccttgatggttattattttgattttaaatatatccttgtcattgtctcttttttgattcaggagcattacagggcaaggacatgcctgtgattctgctttcttttttggtgttcagcatttgccatcctcaaatacttgacacatacttgataaaggctttaggattggaaggatgcatgtctatagtgcccacctgaaagcatctaaggacaggttctgttggccaaggatccacttggcctgaaatctctgtgttcttctcttcagcctgtactgtgtaccccatcacatcactctctttcccatcttcctacagagcaactggcatgtcagagactgtaattgctgagaatttactgacagaatctcaacattaaatcttttgctttctccaccttttctgatgtgtgcacaggctattacacatttcacatttagatatccagaaaagctctttggggcagcttggaagagtgggtggggagcacatggacagacatttacctggaagtatataacattttgctggcttttgaattcaaatgaatgcttttaaattctcaatgcctacatttaatgcagttgctttatcgatatcagcattgtaatttatccttgctgtgaactccttagctcttgctctagtataaaataggaaaaaaatgaccattcattttaatgttagtcaaagcccaacatccctaagaatatatctgctgcaaaacaaaaccccgtattatattacaaaggcaaatgaaagtgtgctttgtaaaaattatctgtctttgctgattatttgtgttgcttctccattaatatgtgtgtttggaacttgcctatgcattaattgattaaataatcatatgtatgtacaaacagataaaatgcaagactgtatgtacatattgtgattttcttccattttaaattcaaagaccatagcctcattttaggatctagcagcactatgacctggacaataaacagaatgttttgggacagccttatattaccactaaaaagagcgagtacctgcatctctataattgagtaagggaatgtttagtttctaatatggacccagaataattttttttcttaatgctgttttttcttttaatcactttattaaggtatatttgatgtacaataaatgtgcacacttacagtatataatttgatgtgttttgacatacatgtacatctgtgacactatccccacaatcaagataaaaaacatacccatcacctccaaaagtttcctcatgttcctttgtaatccgtctctctcttcttcttttttttttttttctgagacagagtctcgcactgtcgcccaggctggagtgcagtggcgtgatcttggctcactgcaagctccgtctcccaggttcacgctattctgcctcagcctcccgagtagctgggactacaggcgcccgccaccacacctggctaatttttttgtatttttagtagagatggggtttcaccatgttagccaggatggtctcgatctcctgaccttgtgatctgcctgccttggcctcccaaagtgcatctctcttcttttctcccctctcccttccctaggcaactacttgcctcctttctctcacagtagatcagttcacattttctataattctatgtaaatgtaatcatacactatatgctcatttcttgtcttttttcaaccaacacaattattttgcagtggatctatattggtgtgtctatcaatagtgtgttccttttcattgctgagtagtattccattttatgagtaatttgtgtatctgttcacctgttcatggacatctgggctgctacaaataaagctgctgtgaacattcatgtacaggtctttgtgcagacatgtttacatttttcttctctaaatcctagaagaatggctgggtcatatgataaatgtgtgtttaatgtcataagaaatttccaaattgtttctcaaagtggttttataatttcacattcccactggcagtgtatcctattcccagttgttctatatcctggtcaacacttggtaagttcagtctttttaattttaaccatgttagtacatacatagtaacatcttattgtggttctaatttgcatttccctgatgactaataataattttatgtgtcattttgtcatgtatatgcctttttttgttgaagtatttgtttgggtcttttatccattttcagtgtcttttaaaacttgtttaaatttgcatacagtaaaatgctttgtcttttgaggaacaaaagttcttaattttgatgaaatccaatatataaggtttttcttttatagtttgtactctttgtatttaatgaataaatctttgccaatttcatagccactaagattttcctcctctgttttcttctagacattttatggttttagctcttacatttaratctgtgatttattcttcgttactttttgtgtagtgtgtgagagaagagttgaggttaatttattactrttttttgcatatgaggtccagttgttctggcaccattacttgaaaatcatattctttcctcattgaattgtgttggcatctttgctgaaaatccattgatcgtatatgtgtggtccagactctactgtgttccactgatctatatcaaaaacacactgatttgattattgtagctttacaatatgttttaaaatcagttaatcaagtcttccaatgttgttcttctgtttccagaattgttttagtattctaggtctttttcatttcttttttttttttttctttttgagacagagtcttgctctgtcagcaggctggagtgcagtggcacgatctcggctcactgcaacctccgcctcccaggttcacgccattctcctgcctcagcctcccaagtaactgggactacaggcgcccgacaccatgcccagctaattttttttgtatttttagtagagacgaggtttcaccatgttagccaggatggtctcaatctcctgaccgcatgatccgcccaccttgacctcccaaagtgctgggattacaggcatgagccaccgcgcccggctggtctttttcatttctatatagattttggaatcaatttgtcagtttctgtaaaagtgccttctgagattatgattgggattgtgcagaaaccatagatcagttcagagagaattggcattttaacaacattcagtttgtcagtctataaataccatgtatttcttcttttatttaggtcattaagttctctcagcaatgttttgtagtttttagtgtcaagtcttatacatttcttatcaaatttatccctatttcatatttttgaggctattttaactggtagtatttaattatcaattttcatttatttttgttggtatgtataaacatacttgatttttatatatagatttcatatcctgaaaccttgctaaatttacctattctctcatagcttttttgttaattctctaggattttagaatcagcttgcttgattctaagtcatgttgtctggaaatatgacagttttacctcttcattccaatctgtatgttttatgagttttggagaatatcaggattttagaacttcttggtagacctttggagcagatgttagattctctcttaccagaaattctttaaaaatcaaaacaaaagaaattattaaatcctcttctccgtttctttttttttttttttttttttttttgagacggagtctcactctgttgcccaggctggagcacagtggcgcggtcttggctcactgcaacctccacctcctgggttcaagtgattctcctgcctgagcctcccaagtagctgggattacaggtgcgtgccaccacgtccggctaattttttgtatttttagtagagacaaggtttcaccatgttagccaggatgatctcgatctcctgacctcgtgatccacctgcctcgacctcccaaagggctgggtttgcaggcatgagccactgcgcccggccttctccatttctttattaattcagtgaacatttagtacccactgtatcagacactagtgattcatggaagagacggacatacaaacaaataattataatttaacaagtaagtgtaataagtgccatggtagttatgatacagagtgtgctgggaatttagaggcaggaccattcagaatctgggcagtgagatgatctctgcagaccctgctgttctggaagggtatgactgcctgaggaatacttggaggtcattgataagaaagtatttaaactgagctatctggggaagttccacctcttcgccatcctgattgtccatatttgctttattattatggggagyctgaaaggaatacatctttatcaatagttcttctccttcctattttcttttttaaatcttaatggtatggcagcagccttagcttctagccttaaatctcactagtctggatgtcgtggggtgtgcctgtagtcccagctacttgggggctgaggtgggaggatcgcttgagcccaggaggtggagactgcagtgagctgagattgtgctactgcactccagcctggatgacaaagcaagattctctctcaaaataaataaataaataaataaataataaaaactctattatggaaaatttcaaacaagagtaggatgagataaggaacaacagttatcaactcatgccaatttcattttgtctacactcctacatacccttcatcagattatgaagcaaatcacagacattttatctgtaaatttttcagtatgtatctctaaaagatgaaaacgcttaaaaatacagtcacaatactgttaccacacacacaaaatgaacagacgccaaacaacctaacaacagagaaaaataattttaaaaacaggaatattaggctgggcaccgtggctcacgcctgtaatcccagcacttcaggaggccgaggcaggtggatcacttgaggccaagagtttgagaccagcctagccaacatggtgaaaccctgtctctactaaaaatacaaaaattagctgggtgtggtggcaggtgtctataatcccagctactcgggaggctgaggcaggagaatcgcttaaatctgagaggcggaggttgcagtgagccaagatcgtgccactgcagacagagcaatagtctgtctcaaaaaaaataaaaagataaaataaataaaaacagtaatattagaagtagctcccttttgttgctcgctgaccatgtgccaggcctgtaatgggtgctatgggtgcctcattcagtcctcacaatagacacctgggggtttaggtcttatttgtgattggctgggtagtctgactcctggcaagcgtttttcctactgttcttttgttgtttcattacggattaaaatcttagagatatccacacactcctggtttatttttaagactgcagtagtcatcacatcactcttccaatccccatattgtgaaaaggtatctctccccctcctcagttgagaattcccagagggcagggaccataatagcaaagtgactggcacctggtggaaattcagtaaatgtttttgattgggtgaatgagtgtatctggctccccctgggagacatgctcgttgggccaggtcgccaagagtcccatggctgaccttccatcccagtgcttcctcctccagtggaaagaggcactaatccacacatgcctgtgctgcatgcagtaaggcccttcaggatattgtgaccattagcagacacacactgcgcattactgaggacctagagtgtaattatggcagtagaccttcaggctgcaaagatggataagacaatccctgcctcaagtagctcaaagaccattaaatagatgaccacagtgcaagatgaatgcagtgatggcgatgtgccctgtgagttaggagcagggtaaagataacccagccaggggaggagagtggggttgcttgtttgtttgataaatactcatatagtacttatgtaccaggcactgttctaagaactttgcacataataattcctttaatcctcataacagcctgtgagcgtccccatttcatagctgcgtataatgagacagagcattaagcaccttacccaaatcacacagctggtaagtagtagaactaggattcagatctaggcagtgtggccctaggttctgtcctcttaaccactatatcaagcagtctctgaaattcctgaagtagaggggaaaatgagaagcatagacaatttgtatcaaattgwccaggatgtattgtttaactggctatgtggtcagagaaaaggaagagtcaagattgattgccagaattcctacctggggcttgagagaataygagaggaggacagaggtgtggtgcatggagatgagtttgtcagtgtgttgagtttgagcatctgttggctgtgttgtcccctagagagttccatatggagcctgaaatctaaaagagactgaaggctgaagacaagaatgagagtccgcattgttacaaaagttggttaaaaggagagtacgcactgtctcctaagaaggaagggtaggataaagtagcaagtctgaaagcaagaggaatcaacattgttgcatgcagagagaggtccagtgagatgagatctggaaaagaaaatgctctgaacttctcagttgaggggctgttggtaatcttactgaaaacaatctcatcagagttctagaggcagaagccagattgcagtggattgaggggtaagtgggaggtgagaaactggagacagtcgatgtagacgactcttcccaggagtctggatgagaagtggagaaaagagattggttgattggtaatagctagaggggattgttgggtcaaggaaatattttttcctttaagagagaattggatcactttagcccaggagtttgaggctgcggtaagctacagtggcaccactacactccagcctggacaacagagcaagaccctgtctcaaaaagaggagaaaaaaaaagagagagagagaattgaataaatttctgggctgaggagaaagagccaatacaattagatcttgaagatttaggagrggcatgagtgagatttgagcttgaactagagggaaaaggctaagatgagtgtgaggagcttgtaggtagaggtaggaaattgmagaagaacagtgcttaaaggctccagttatttttatgtggtaagaggcaatacaatctaatgatagggagagggtgggctttaaatatggaggctgaggagagctgtaaagttttagcgttgtggtggaaaaggtcatggaaacactaataaaaccgtgattggaggcaccaaaggcctcagcaaggctggagaccttgaatctgcatgttagatcacacagcagtgtgatttttccctagckgagtgcagctaacaaagtagaagtaaagcccgaaaatgggagcttttctccagagctagtttgttggacaaatttgatgggaggactgggratacaaaggaatcaggactgctgccgtaggtgatcagctatggaattcaggcgaaaaggaagagaagctgagaggacgttgatacctgggaggaaaataccagggtctggtgatgtcaccaagaagagcaaatgtggtgagaccaaatgtatgagaggaaactggagcctgtgtttttgaaggtggaagtattgtgagcaatgtcaagattcaaaatgtagttctgggtgtgagtagtggaggtggggatgggagtgaaagtcatgaaaattaagggaagaaaaggaactcaaagtgggttgaaggagagacacccataaatggagatttgctatacagaatgaaaggtgttgtaatagagggagggagaataccaagtaaagtaggggccaaaaggaaggtgtgagcagccatgctgggggagaggtagggaaatgcttcaccaagaagcattaatgtttgaggaattcataggggcttgaggaataagcaggagtttttgccaggcatccaaggagtaggcatggtgagacatggctgtgctacatacagcagcacagggaaaacctaaactgcctttgaaagaaacccacccaccggagaaggttcttggtgtgtgtgtgtgtgtgtgtgtgtgtgtgtgtgtgtgtgtgatagtggggagttatgagcagttggggacagacccaagtacatgatggaagggaaatggaattcagccctgcaagtaaaccagatttctatacaatagagcaatagtggctagaggtctggcagaggtagtcagttgtaggcatccaggactagatagcagagcaaaagatgaggagtccacctgaatattagcctgtcaacttcatatacctcctcttccacatcactgccctgtcaacgccccctaaaaagtacccttatctaaagacctgcaacgactttgcaccagacaaggaagggaaatctggcttgtgccctattttagttttctccctgagacctagctataatgtttcttcatgtacattagacagtaaattttgttgaatgaatggccaagaaatgatgaggatggcggtgatgatgattgcaactaaaacttatatagcatctactacacaccaagcactgttctaaatgtttttcaatactcaacagcaatgctgtgaagtaggtactctttttatccagagtcaacacagatgatttagcaaaaatactgaactaatacctagacagagaaactacttactttggatatatgggcaacagttacccattcagagtagacagtaaggaaagtagtgtcttctgagaatctcttatgagagtactaggaaggacgttttcttcatatctgtaaaaccagaaaagcatggaagtgaagggctggttctttgttcattttgtttgtgttatcgtttttttgaaatatattgcacrtatcataaaattcatccatttaaattatatggttaagtgatttttagtatagtcacagttgtgccattatcacatcctagttttagaatttttcagtatcccaaatggaaaccctatgctcttccctttcctgctccccactccttcatccctgccccagttagccattaatctactctctgtctctatgaatttgcctattctgaatatttcacatacatggattcatataacatgaagtctttgtaactggcgtctttcacttagcataatgctttcacggttcatccatgttgtagcatgtatcaggatttcgttctttttttaattgccagttaatatgttattgtgtggatatgccatcttttgtttatctgttaatcagttgatggacatttgggtagttttctactttttggcttttgtaaatactgctactatgaaccttcatgtacaagtttttgtgtgaacacttttcacttctcttgggtatatacctaggagtggaattgctgggtcatatagcatatgtgtgtttaacattttgaagaactgtgaaactattttccaaagtggctgccctattttacattcccaccagcaatgtattaagcttctcatttctccacatcctcaccaacacttgttattttccattacttttgttctagtcatcctagtagatgtaaaatggtatctcattgttgttttgatttgcatttccttaataactaatgatattgagcctcttccatatgcatataggccatttgtatgtcttctttggagaagtatcttttcagatctttgcccattttttaattgtgttgtctttttattgttgatttgtaagagttctttatatattctggttacaagtcccttatcagatatgtggtttgcaaatattttctcccatcctctgggctgtcttttcactttcttgatggcatcctttgaagcacaaaggttttttattttgatgaagtccagtttttatatattttttctttttttgcktatgcttttggtgtcatatctagaaaaccactgcctaactcaaggtcacaaagatttattcctatgttttcttctaagagttttacagttaggtcartgatccattttgagttaattcttgagttaattcttgtatatgatgtgaggcaggggtctagcttcattattttgcatgtggatatccagttgtcttagcaccatttattgaaaagtctattacctctccactgaattgtcctggcactgttgtcaaaatgaattgaccctaaatgtgagagtttatttctggatgttctgttttattgatctatgtctatccttatgccagtcgcatactgacttgcttactgtagctttctggtagatcttgaaatcaggaattatgagtccaccaacttgattctttctcargattgttttagctattcattttcatatgaattttagggtcaacttctcaatttcaaaaaaaattgagattttaatagggatttcatttaatctgtggatcaatttgtggaatgttgccatcttaactatcttaaatcttccactctgtaaacatggatgtcttttcatttaattgttttccgtgatattttatagtttttagtatacaggtcttgcacttattttgttaaatttattcctagatattttattctttttgccgctattaatatgggattgttttcttaatttcatttttgtattgttcactgctagtgtatagaaatacaatttttcagtccaagtatggtggctcatgcctataatcccagcactttgggaggctgagatgggaggatcgcttgaggccaggagtttgagactggcctgggtaatgtagcaagaccccatctctacaaaaaatttaaaaataaaaattagccaggctaattatctacttgggaggctgaggtgggaagatcccttgagcccaggagtttgaagctgtagtgggctacgatcacacaactgcactacagcctgggtgacagagcaagaccctgtctcttaaagaaaaaaagaaatgcaatttttcatatgctgatcttatatcctgcagcttagttctaattttttttgtgtgggctccttaggattttctgtatgcaagatcacatcatctgtgaaaagagagagttttactttttccttttccatctggataccttttatttctttttcttgcctaattgccctggccagaactccctagttcaacattgaatggaagtggctagagcagacattcttgtgtttttaaaatttattttattttttatagagatgggatctcgctgtgttgcccaggctggtctcaaactcctaggctcaagcagtcctccctccttggcctccctaagttttgaggttacaggcatgagccatcacacccagcccagatattcttgtcttgttgctgaccttaggggcaagtctttccctgttgagtatgatgttagctgtggggttttcatctgtttttgagggaagggtgagattgaatttgataggtgctccaggcagcaggttcatgttgagaagaaagcaagagaggttcagattgagattcagctgatgcatattgaatcgagtgtgtgaggagaatgagagcctttttacattggaatgaagtggcaaataataagattacaggtcctggatatcttagtgtctttcagcgtttccagccaggtagactggctttaccctccatagaagttttccagctagcttagactagctcatgaatctgtgttagtaaggagtcctgtgtttagatcaaattatggttcagagtcaggtttagaatccaggagaaataaaagataagtatgcatcccttgtgggtaccctttaagagcctagctcagtaccaccaaccttaggatagctctccttgatgagttccattttctgatgactatgtttattactcagtacattctgtgtacagttggcactttgtggatttggacttaacttctcttatttgtacattgcacaaacttaagtctgttttgcctgtgtctcctaactcctcaagattgtatgtttcctaaggacaagaaccatgcctgcaccttaatatatgcctcaaatgtcaaagcatttctctgtaccagtaaatagttgttaactgttgataagggtaaatatggtcataaatacaaagatctctgagtcatttgggaagcatattaagtataagtccattttatactggataagcagacttttcatagaggtgaagatcccctaaaagtcatgattttaagatgtgacacagagacacttgggtttttaaaaatgtgcagagacattcatactaaactgccccctaggatttatttagtttcattcttaattatctacaggtgatatactgggcagtctgactttttacttcccatggaccttatcagcatctctgctaacccctactcctgagtgcaatcttgtagttcaacaatagctaggaggaaaagcctttgaaaacaaatccatgccttgccttttgtttctttccccaccttgtgaaggaatgaagtaggacttaggagaacagctccctttggatccctctcaaaggtgataccattggctcccagcttagagtaagaagctctgagaagttgaatgaagggtgagatagagatgctgaacccattcttccagcttcttctagtgttgttatttccagaatggccaacacccctacattgatacataaacacattccaaggccttgtgtaatacaaagttcaccgtcctcctggaataggagccctgggttctagttctcactctgccactgggggaaaatccaattaaagtctggtttagtcagcttgggtcaccatagactgggtggcttaaacagcagacatttatttctggtagtttctggaggctacaaatctaagagcaaggtgccagcatggtcacattctggtgagggccctcttcctggcttgtagacggctgccttctcaccgtgtgctcacatagcctttcgtgtgtgtgtgtgtgtgtgtgtgtgcgtgcgtgcaagcttcctgatgtctcttcttagaaggacaccaaccccatcatgagagccctactctcatgacttagcctaaccctaattaccctccaaaggccccatctccaaatgccatcacattggagggtagagcttcaacatagggattttgggggacacaaacattcagtccataacaaaggctgtagtccttagtttccttgtctgtgaaatgagagtgttgagattctttctagcctttatcatttataattctgtgagatgtagatttgcattattttcgagttygagttatatgaaatgtttccctctacattttcttgggcaactgagaactgaatagggctaggtttaaatagagttaggcagttaggcttattcttttatttaataagcatttttggagcatctacggtgttccaggaactgaactgttgtaaacattggagctgtaacagagaacaaaagagacaaaaaaaaaaaaacaaaaaaaaaaaacctttgccttcttggagcttacattacattctaaacaaattaaataagaaagttatttgttagatattactgtgtattagataatatggttacagagacagaacaggaagtatcaggaatgtgggattgcaattttagataaggcggtcagagaaaagatcaccttaggtggtatttgtgtcaagaagggagagagaatgtttaattctgtgtggccagattggaaactgagaccctgctagggaaagcaccttaaccaaaaatcgtacggtagccttgttcttcctcccagatgctgacaactcacttctgtgtgcacatactcctccccccgccgcacaaccccatcattctgttttgtgccagacactctacactaattaatgatttcacagcccttttataaatctcagcctaaggactgtaataagaagttccattgaacacccctgctgccagtactgcctgagtctgggaagtctggctggcttagaatctgtaccaacccctragacratctgatgtttaaatactgtgatgccctttctccccttttcaatgcttcttactctcttttgctggtttctctttcctttttccacatctttccatataaccatctatccccagccattttattctctcattctcttgctcttccctttcttttgtaacttccacatttcctcctacttctttgtttttgttttttcatctcatgtctgtatttattctatctctaactctcctgttttttctcctcctttccatcctgtcattcccttgtaccctgaaatgtatgtggagaacaggtgtgacacaggtgaggagttctcttcatttacccagtcagtcatgtcctggtacctctgccgcctccccctaactctgtgctgcctgagcatgcagaacccttgaggggagagattctgacacaagtcagttagaaagggctaccaaccttagccagcctggccctgcaggagccacccctcactaggcctgtggcacagagctcatgctgctgttctcagggtgcttcactggggcccttcatcttctggctcaggctcctggcacattacacttagtgtattatgggggtggcatcacataccagtcaaatcgttaaaggttcagtgtgatccagggaaggaggtgccagcagatggtgaaacttttctcagtctctgcctttctgacctgagccctatccaattgtctggaaagccagatctgcctgacttcccatgctgttaccaagaaccaaagtattgagccccaggccagagctgtctkctgcaccagagggcacacaggatcagagagcaattctcttcttgtcctcagaaccctttttttctaagcccaggaaagagagaaactagattctacccatttctaccctatgattacggtgcttttggtggaatacatcctaggtctctcactccctctcacagtcccrctctgtcttcaaatcagagtcaacttcaggattggaaggaatcttggcagtcatctaattaaactggccctccgattcttagcccatatgattgtgtgattccatcttggatagctccactttctctttggctatctagtcttttaaatttgtgaygtgtgggccaggtgcagtagctcatgtctataatcctagtgctttgggagtctaaggcaggaggatcccttgaagggccaggaagttcaagaccaggctgggcagcatagcaagaccctatctctaccaaaaaaaaaaatagatttgtgatgtcctggctgccatcaattgtcaactgatttgccacacaagtggattgaagaatgctgtgtgtagaaacctatattttacagtgaatgttttatgtgtatgtacatatacrcacatgcccatgcaaaaacatgtttttcatccaactggccagcagaggagaatgcaaaatttcaaaaatgggagatatactcttttctttcaaggagtttgcagcttagttggggaaaccagagatgtagaagtatattgatctaagaatacctagaaaagggtgtcaaaacaagtgccctttaatatagaaatcaggtctctttagaatgaactccagggaaagttcatatttttggtcatactgaatgtgtgaaatataacttgaaataaatggtttgaatgggtttgtgttgactttttcactttgattttgttgtaagagactaagtagcagtacaagaataaatttgtgaggattgaagttaggagaggctaaatcaaggaaagcttcatgggattaatgcgttttaagtaaggttttgatagaattgggtgagtaccagaactgtttgggggcatttctcagtctgctctgtcaaccagaattctgggggttctgaatggccttgagaaactgccctgacaaccttcagttctgacctctgagctgtcgctgttcaaaagacctttaggatgttgaagtccacttcctatttgagatgcccctccatccatcttttgcactatccaacattagcttcacctcctgaaagtccctagaggtgattccagggaacccagaccctctgaaggcggtcaacattatgggggttggggggatgcagccagccctgagaccactgggagctataagggacagcattctctttttaatggtgggtwtaaggcagtcatcaaaccaagctgagcaaatccactgcccaagcaacgggcagtaacacaggaaggaagaagggaagtactatacaaagtgtgagtgtgctggagtttgaaataatgggaacatcagccctacatttcagaatagaagagcagcatatttagaaacgaaggcaaggcctggcattccttcctgttagccaagattagaaggagctgtgagaggggtagattttctgcaggacctctctatgatcttgggagtaagagttagagtcctagattcctttggccttctggatgtcatcatttccacatcctgtctccagccaaggctctccctttctggagagattgaagttgttgtttcctatttcacaggattccttttatttttacgtytggggggtctcacccagggaattccttcctgatgtcatctttgtgggatgtaaaggagggaatgaggggaggggccccaagaatgtttctctttctgtgaaagtttttttcagctcttactgccattcaacattacttgtatccatgagatggcttctttcctccctcaccccacccgtcttcagtttcctggaaatggaatgggsgctggaagagagaaaggatggaaattcccattgcatctctctcggctatgcagtggttcagatggggttttggtgaggggggttgggagaagtagaaagatggagtcagccctggagggagaggccaggagactgctgagctgatggtatgggcctaattactccctgccttgagcttgcctgtaattgtggtttctgagagccagcacgtcctggaaatctgctggtacagcagagatttggggtttccgcctgggatggagttgaattttccacttggagcaacttgcccagcccccatttttggttggggagcagagtgaatccttaaagctcaaaaggagcgattaggatagtggtaggaatataaggccttcctttggaactgaacgagaggttgtatgctctgaaatgctagacatttttgaaaagttcagagaggcggcagatagcaggacctggtaaagagttgtatggttaaagttagaatgtcaactgtgtcccaaacctaggacaagtgatttaatctttttagacattagtttctccatcagtgatttgatttgaatatgtgtcttttctaacaaggatgtcccttaagtcataggtagagaaacgctagatgaatacaagggagcaacttaagccccccttttcccatggtggtgataaaaataatagctaacatattttaagcacttaatgtgtgccctgtgctaaacgctttaatgaattctaccatttaatctcttaacaatcccgtgtaatagttacttctgctatagctaagggaacgtggggttaagaggttaaatatgttacctgaggtcatggccccagtgagtgtcagcatcaggattctaaagcctgtgcatttggccagcagacgtataaatagttgtctgcactgcattttactcgcttgtgtcaggaaacactcagagccaggctggcttagtgaggctggctgttggatttggcatcagagaatctgagttcaagtcctagctctggctctcaccaaccctgggacctcaggcaagtcctttatcttctctgaacctgttttccattcatgaaacatattttcatagttgttctgagggttaagtgagatactatctggcacaacacctgctactcagcagatgcttagtgtatgttagcagaatctgaatttgaatgaggggaattcgaataagtggcatagtatagactcaagcagccctagtccctgccctcctgaatttgtgatctgaggttttagaacactggcataagttaaggatgtatctatggcaaagtcaaatggatggtgaggactctctctagacagagtgcaaagcattagcagagtaaaggctctgaagttaaaatgcttgggttcatatcccagcttcatctcacttgctggatgcatgaaatcaagcaagtggctcagcctttctgtagcccattttcttatctgtaaaatggcaacattaatagtgccaactcatgaggttgttgtgaggattaaatgyaatacataagaatggctaatatgaataatcaacaatcaatcaataaggaattcttactgagtgccaggccctggcctgagcattttttgcatgttttaaataatttagtcctaacactctcatgaaatagaatcctaacattcttatgaattctctctattattatccccattttatggatgagtagtctgaggcaagagattaagtaacttgcctaaagtcacacagctaataaatgtcagggccagcatttacatctgggaggggaactcaggagcctacattcttgtctcagtaagtgctttaagaatttgctagctcttattattattatcatcatgagttcccatttatcaatcagtcacaagaatttactaagagtatatgcttagcactgtgttagttattrcaggctytatcaacaaartatatgtgacaggatttctgcttgtgaggagtttatcatctagttggagtgagatatgaacaatatggatgaaatgatttgataacragtgccaaatagcatagtatggactcaaaatgcagtagaaatggacttagttactgaaaggatcattgggtaagttggactagttaggaaagtttactagagacagtactacttgaattcagccttagaaaagtgggctgaagggcaaggttgggctgtttggagcactagagtttgggaggatttagaatttcaaggttggtcattcagcattcaacaaatttctgttgagtgtatcttatgtgcctcactcgatggagaatgagatccaaactgattgctcagtcgctgttgtttctctcctggccaatccaggttcatttcctggagattgtgttttgtggactagcagtttcccagttgaaatgctagtattgccctgttcgaggtggtccattrttgatgtaataaagcctcattatcatgtgatttgtgcctggatagaatcattatatgtgtctaggtcctggaaaggaactgcagggaccacatggttcattcatctcttcctctctcccatcatttcaccgccccgcttcccaatcccatacatgcacatgcaaccacactttttgcttaggagaaatataaggcctagaactaagaccataatccaaatattcaaacctttaggatactttatttaaactgtgctgcgtgaattgtgagtcaaattaagtgctgtaggacaaatgcctaccatttttgtaaacctacagagggaattataagcccatatcccagtgccaataatttttgtcttcctaacacccgtttcactgttgtgcaagcccctcagtatcaaagatgtaattcagtagaaagagtgtaagagacagcaacacttgctggaagtggtaggagccactgctctaaaaaccacttttcctcccacagaatggtctgggatctcccccagtggagagggcaccctccatttgtgtgatctagatctgcaaagtgcctgcatagccagagccaatgggcattcttttggtttgtggcctgcctattgcacctcctatcaggcagctacatgttgagtttgttgcttggggttgtctttgtcataaacacagtggctaatgttctagtggtccaaggcccattagtcaatgtgagggaatggagtaaacaacagagagatccagagtggatcctgggtgatgaaactgtggcgagagctgcagggatctggctactggaaaacttgactctgattttctcttggctggccttctgtcagcatcctagccaactatgtatatcaagtatactttgtagagctcagtctatgggttgagagacccattttaggttgttggagacttggtgctaaagaaacaaaaaaatagaagatgtaagtctctccttcagaacaggtattttattaaacagatcacacggtagaatacgtgagtttcttttaaaagcagtacacaggcagggatctgtgatgatagcataagtcagatgcttaagggccaggagatgtaaagaatagaagtgtcatcattcgagagttcattgaggaaggcttcctcaaggaggggagcttccgcacaggttttcgaagggtagaacaggaatttccagggggacctggaataacctcccctgtctgcacgcccttctttcttctacttctggcagggcttcctgaagtcaccagccaggaatgtggagggtatggactcagcctgtgaagctctggcccgcctcccacttctgccccccattacagctgggagcttaggttgccatgactcagtttgcatctacctgcagttacctcagctgaagaacaggttgcctacagcctgcccaaggaaggggattgcaaagacaagcagacctcataccatcaactcccattacttccacaagttacccatttgatggtttaacctcagtggttttaaagtagaacactaactttcctctgccacccagtactttcctatcgatgttggtatgaactcagggaaagggagctaatttaaaatccaccttaagaaagtaaattagaaaggtgaatcttctgggccaaatgacacacttttaaaaagcaaaatgaagacttcttggattggccattatcctgggtacctgtttcatggttggtcctttatttgtgccaataatcaaaagtcgactcaagtaacaactccgtttatacaaggtataaagtatgccttctttgaagaaaatccagtcttttgagaatttatatttaaggtattatcactttcrtgatgatttacttcagaacatatttacttatcttttcaggaaaacattaggtaaaacaagatatgcctgtagggccgggcacrgtggatcatacctataatccaagcactttgggaggccgaggcaggtggctcacttgaggtcaggagtttgagaccagcctggcccacatggcaaaacsccatctttactaaaactacaaaaattagcctggcatgttgacacacgctmtaattccagctgctcaggagactgaggyacaagaatcacttgaacctgggaggcgaaggttgcagtgagctgagatcgcaccactgcactccagcctgtgtgatagagtgtgactgtctcaaaaaaattttaaaaagatactcttgtagagtggttttaggatgacaagtaatttaattatcacagtgccctgcaaaaagtacaaggcttggtcttcccatcttactgttaagaaagctgagactgagaagtggtgtggcttgcccagtgccacacagtggctacgatgtggygaggaggaaacctcattccacagatggaggcctttcccttcggccctggcaagtccctgtgacagatgcttgttctttatcttgtaggttctaggttctgctcatctcctttgccctttgttgaaaaccaggaaactcaaatgaaaatatactttttcatcttgtggatatcaccaatgcagacacagaattgcttctagatcatggttggtgatggtgtctgttgtttcttttccagttgaaatgaatttggctgtggcctgccctccctttattctttagagagaatctttcctttccaggctagggatgtagttctgcctgggtgcaagacctgatacgctgaagaagaattataagggacaaagaatcaagcagaattaagaaaggacgtgagatgacctagctcagctccctcgtcgtggggatgatagggccaaggcacagggagaggaagctgggactttggtatcagacacacttgaacttgtgtcctggctctactatttaatagctgtatggcctggggcgacttatgtaacttwgctgaacctcattttccttatccgtaaaggaaaataacactgttatctcaccaggttgtcaggattaaatgaatgcctgtaacacatgtttattatatgtaattttcttctcccttttcaaggatatataaaaagataagggcagagtgggtctagaacccagatgtctaggctgccagctgtcagtcctgtcctcttgtcagaagggcccgccccctccctcctgctggggcagcctccatgatttcccttcctgtggctttgctctccacccctgacttctactcctaataatcagatcttggatcttccwgaaagttgctttatgttgtctggagttgcacagctagtaaatggcagaattagcaccaatatctaggtctcctggcttcctcttgatgtcttgagatgctattcttttcattgaacataagtttgatggaggactccgtgacaaaagcaaataaatataggctaaacataatattcrgcagtagatcatctaggagatcttaggagatctgtaaaatggttgcatctatattagataactcaagacttgattttgtgtttcaaggcaggatgtgcttgctttggcagtagcttactaattgtgtctgacttagggcttcagcaaagaatagcacccatttttaaagtactgcagagtgccagccattgtactagatactgtacttacattacaccaattcttaaaacagcctgataggataggtggctagtattcccattttgtagatgagaaaactgaggttcgcagaaaatagtttgctctcagtcccatagatggccagaggcagagccaggcctgttctaactccacacttcaccacactgctcctcaatatcaatgtaaattcctgggcatagcttcggcattgagctttttctgagaaatatgtgacaaattggataagtccgatgtgagcttgtgccaatacctatgctgatagagcctgcaaggctgatggggtgttgggttctgagtggagaaaagggtgcacagcctagggcagtgctggattgttctactaaggggtgaagatggtgccctcagagccgggctctgcttcgtttctgggagacagttgtgyctctttactctaggactcacagtccagcgaacaaggagagaggtcgacaatgtggaaggtgcttttgcagaaatatataccaggtgctgtgggagacagaagttcctggagggttgactgggcaggcttctagttttctctgactgttctgaagggcaaggaggtctcaccactggagagaaggtggaagtgtggtgcagctgtggccaaaggaggccagaccagtgctgtccaatagaaagatagtgcaaaccacatgtaatttaacattttctagtagccatagtaaaaaaaaaaataatacaggtgaaattatttttaatgatatatttcatttaacccaatatattcaaaatactctaatataaaaagttattgagatattttacattcttttttttttcactaaaactttaaatctgatgtgcattttatacagtgtatttcaatttgagccagccacatttctggtgctcttagccacatgtgacctggggttcctgttaagacagtgcagggctagagggtactcccagtgtcagctcctagtaacccactctcagcagtctgtccctcacctgtgctttctagtgcattccacgcatcgctgtctttcaggtgcacatctgctctgccgcagctggtgtctgggcctccagcctttcctcctccaggccactctagtcactgcagtcagacttatctttttaaaggctaaacctgatcctattacttcttcgagaaagccttcaacagctcccccatctgtaaataatcaaatctataatccttagataccgtttaaggccctccataacctgtctttttccctccatcatactccctagcaatgatatgttactttagtatttgcagaaccttttgacatactttatcccacttaattctcacagcagctgtgtgagataggtagggcagggcaggtgaattataaggctcagagagtttaagagaggttcctggctgggcatggtgtctcacacttgtaatcccagcactttgagaggctgaggcgggaggattgcttgagcctaggagttcaagaccagccttggcaacaaagggagaccccatctctacaaaaaaaaaaattttttttaactagccagatatagtggtgcagacctgtaatcccagctacttgagaggctgaggcggaaggatcagataagaccaggaactggaggtttcagtgaactattatcataccactgcactccagcctgagtgacagagcaagactttgtctcaaaaaaaaaaaaaaaaaaaatagagagagaggttcctaagctcagccagctagtaagtggcagaatcaggayggagacccttgtcttttttttttttttttttttttgagacagagtctcgctctgtcgcccaggatggagtgcagtggcgtgatctcggctcactgcaagctccgccccccgggttcacgccattctcctgcctcagcctcccgagtagctgggactacaggcgcccgctaccacgcccggctaattttttgtatttttagtagagacggggtttcaccgtgttagccaggatggtctcaatctcctgacctcgtgatccgcccgcctctttttaattttatctcttgttacactccttgttgtgagatccatccccttttctcccatattgcattgacagcctccccagagtccctgtgtcctccctctgccttctgctgcttcctcccctagaatgtccttccacagcatagctacctgtcagaattctccccttcctccaaggctctggttaaagtccacctcctctctgatttcttctttgtccatcccctccccaaatctagtttgtaactaccaacacactttaacatgcagtttcttatttagttgatgcttcactgtcttatttgcagaattcagttgtagcaatctggggcattgaagaatttaggagcttaaatagttcttacagggtcaccagtggtactcyccgcctaagtccatagagaggctaacacccttctagtttattagtctttgttaaacctatgaaattatgaatttaatcctaatttatatgcattgtggaggtcactcaaaaatgtttctctcaacagctgtgataagtataggcttattttgatgtctaaagatctgttacctgtatctgatttcatcttccaacacatatttattgaatatctactatgtcctgtgttctggacaagtatgcatgagaacaacatacacgaagtttatcattaaatgggaaaagagcagacattttaaaaagcacccaaaccggccgggcacagtggcacatgcctgtaatcccagcacgttgggaggctgaggctgaggatcccttgtgcccaggagtttgagaccagcctgggcaagatagtcagagctcatctctatttaaaaaaaaaaaaaaaaaacaagctgggcagctactcagggagcttaggtgggaggattgcttgagctcgaacccaggaagtcgaggctgcagtgagccgtgattgcatcactgcactccagcctgggcaacagagtgagaccctgtctcaaaaaaaaaaaaaagaagaagaaaaggcacccaaacaatagtgtagttactattgagttaggcacattacaaaggtaaatttcagggaaactcaacacattaagtgtcagagaaggcctctctgagaaagggacacttaagctgaacgctgaggaatgagtgtgggttccccaggccaaggtggggagagaaagcccctgaggttgaaatacagtgagtgagagggagggtgaccagatacacagcttgagaataggcatgagacctcacccaaggacctgctagccatgtgcaggatttggaacttcatgcaaggacagtgggaaaccacggaagggtgtatatcctctaatttctctctttaaaagatcactctgtgtgtaagaatgggtaggggctagagtagacatggggaggccagttcttctaggtgagagatgatggtctcttaaatgagcgtggtggcagagagggggagaagagaagtaggtggatttcagaaatgttaggaggtcatatcagtaggacttgtcaattgattggatttgcagagagatgtcaaagataatctcagatttctggcgtgagcaagtgcacggcagtgttttactgaggaggaaacatttgatcaggagcagggctggggagattgattgcagtttgactgttgtagctttgaggtgtcagtgaaggtgatttggtcctcgcaattaccctttgagaaaggtagtattacytacatttgttattgggaaactaaggtttgaagaggttggatgacttgcctaagactacatagccaagaaagggctgagcctgagcttgtgccagtattttgactcctaaagctgtgcttttaaaaccataccacatgtcctgtgtgctgaatattcgatgtggaaccaagctaaccaaccttctcaacacacgagttctctgcctcccttctccacacacacctgtctgccaagttgtctgctctgatagtcaaacaaatcctaaaatctctttttgtctaagaccttcatgaaagtagaaaggtgaggtttactggccctgccctacctagaatttgaacaccctgggggtatttttcactcactctttctagttctgttcccctcacacctgacatttttcaagcatagctcacctactgtacacctgaaaaaaaaaaaaaaaacacacaataaaaccatttgcagagggctttacactttcaaagcacttaataaatattatcttttttgccctcacatcagccctggaagaaagaaaggacgtatatgggtccttcagctaacatttttggagcraccctcactatgcaccaggcactgtgctggaactcagctggtgatacaaggatgaataagacatggtccctgttctyaggggcttaaagtctaaaagagatgacagactaacagatgatatcaatatgtgttcattttgcagataagaaagatgatagactgatgatagactcataarttaagggacttgtttcaagagtttctccaagttacggtcctctgaataaggaatggcttgggctgcttgttgaaatagattccacaccacagacctgctgaattggatccctaagggtggggcctcaagtgattcgtatgctgctggatagctagaaagtgatccaactgaggagtgaaccttctctggtgcactgccagagaccatttgtctattctctagtttaagagatgagggaactgatgcttatagatcagcagcggttgtctgcaaacagccgtctttcctcatagcccttactgtagggatgtgcaggtctaggacggtgtgtttgccagcctcagaccagagggaaaattctacccggaggcagaatccatagaaagttagggtgccaggagcctgctgaaaactccaccctgggagataagggaaaccaaccagtaagaccaggtcagagttcagtaagtatggactttatctggagctaaggtcctggtagggtgtctcttgtctctttcctggtttactgctcttgtctttagggaagggcccaggaatattactttgccccagactcaggaaaacctagctcagcctgtgtatagtgtgctttttttatctttctctatccatctattttatgtatgtgtattatgtatttatatacatatatagcatatgtgtattatatatatctttaatcatgtcatatatgtatatattatatgtgtgtgggcacatgtgatgtatatatgtgtatatgtctggaatgtgtgtgtatgtatgtaaaagagaaaataaagaccaaacaaatctacatgtggcatatacaggtcatataattttttatttaggagcacagaccttgaagtcacaccaactctatgcacatcttaacttcatttatttaacctctctgttcacacactggaaaatggggatgtactacctgtttcaccagacttttgtgagtattgaattagataaggttatatcaagtgcttagcacagcacgtggtaagtagtaagaactttatcattattaccacagaacgtggatgttctaggccttgtcctcatttacacatttgtgatggggtaggcgtaagggtgagtagaccaggaacctcccattgacagatggaaaggacgtgatgttatttgcttctctttgtttctttaaactccagaagccagtcctgtttggccaccttaagttcgaactcgtatactttgtaggggtctgagtgaagcagtgggcagtgtaagctgtgggcagtggtgactgggaaaggtaagacatgcccatctggagagggctgccaccactcattttcagctgattgtctctatgtgagaccgtaagctcgaggatgccagaacttctgactgacctttcaagagaagtcagaaatctgtattttattgcttagcaactaacttttaaaatatatatatatatacacacacacacatatatatacacattcacacacagacacaccgcagaccaacaaaaaggatatgtgggctctctggaaggtcaccaagcatctccttgctttgtcgcccaccctgtgggctggggtgaggagcatgtggatgcatagttagaaggcacctgctctgtgccttgtgctgcactcaggcataccgggaagtccmcactgcaacctctgmcctccagcarataggcaggactgacgcaccaggccacagggagccttggaggaggggagaatgtgtgcgccaatgcgggctgcattgtaaagaagaggaagagttctgcgagttactctacagatattgtaagtgaaaaaagcaaagtgcaaaaaggggatgatactacctgttgtgtaaggaagaaaggaaaataagaatatgtataggtatttatttagttttacaagaagaaacacagcaaggaaaccaaaaacaaatgaaaatgattacttggggaatggggagaaagaataggtacacttctgaatatacttttaaaatttcattttgatttttcaaccatgtaaatgtttgatatattcaaaaaatgaaataagcttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaataagcttgaaaaaaagaaaaccctaaaattcagtacaaatataaaaagaaacataaatatatctcaaattgataacataaaaacagattaagaccaaggacagtggctcacgcctgtaatcccagtgctttgggaggccgaggcaggtggatcacttgagcccaggagttctagaccagcctgggcaacatggcaaaaccccatctctataaaaaatacgaaaattagccaggcgtggtggtgtgtgcctgtaatcccagctacttgggaggctaaggcaggaggatcacttgaacccaggaggcagaggttgcagtgagctgtaattgtgccactgcactctagtctgggcgacggagtgaaaccctgtctcaaaaaactaaacaaaacaaacaaaaaacccagtggattaacccagaaattttcacacacattactgatgatactgggatacagtctgaggacaaaacaaaactgcaagaaaatcttgaacttcataggtttgttgttactagtgatactgatgtagtaactccaggaactatcttttctgcatattgaatagagcagtgagtaaatatattggtattgtttaggaacggggttctcaatatgagaaaaggaagacaaaatgtggaatggggaagatgaagaaccctgttgtgttgagttcaaattggagataccagtgtgaactcaaaaatttataataaatttttctaactctgtccattaaaagggcctggaacgagggacagctcagcagcaatgagtacctagcagtcagatcttgtttgtaaatgcatttcctgctaaaaggaacagggctccttggagaaatgtttaattccaggtctggcataggggaagtacaaggtgagcatggagtatctttttgtgccagaaagcaaggacatgatcaaagacagatggtgacatgttaaaaggacacaggagctggctttcagaagctcccactggtcaaattggaacattttaaactttttttttaaagggtaatagactataatatattattactttgcgggggaaacaggatctgtgagttcatagcactactccagaaaagggatgagatgacattctttataaaagcttactggctaatatatgttgaaggaatgatagaattagcaaattgccattttgcaggcaccagtgcaataagcgctttaggcaagaatcatctatgratagtaaaactattggatgagagattgttggaaaacagagtatctatgcagtctcaaaatatcatcccacagatttctcattaattcaaatgagaaaatagatttttaccattgaaaaaatctcaggaataccactttacctgagtaatcaaacctaccgtcaccaaaatggggcaagctatccaacatcacttatataatagtctcttaaaaatgtttaacatgaatctaactgtgaggaggcatcagatgaatccagattgtaggacattcaacaagattactggcctagactctgcaaaatgtcagtgttatgagagacaagaccaagaaaagtagggagagttctagatcaaattaatctgagagacaggacgtaagtataattcgagatctttgattggctcctgaactgaggcaattggggaatagctacaaagaacttaataagacagttggggaaatttgaatgtgtactgtatattagataatattgtatcagactcattgggtgtgctgatggcattgtggttatacagaagaatttcaatgctcttaggggatataggctaaaataggggtaaagtgtcatgatgtctacaattttcaagtgagaaaaaatgtataaacatagataaagcaaatgttacaaatgttagttgctgaatctaaatgaagggcatgtagatattcaccatgctacttcttcaatgttaatgtagtttgacctttttcaaaataaaatgttggggtaaatgaaatgtgtgctgcagtggtcagggattgctttgtggagtcaatgccatttgatcaggaccttgaaaaagtagtaggagatggacagagatgacaagggatggcaaccatcaagtcagaggtgggaatgagtatagcatcgcttaggatccagtagaggtaggtagtaggcaagtaatcagagacgaatttgaaaagacgtttgggtccacaggatgaaagtcctttaataccaagttattggaggcacatctgattgtgtagataataaggagagaaatgataagttcttgatgagagggcctgagggagtagtatttgagtaagttagtctgtggtggtggagtgctggatggactggagagtggaaaagaggtttttttcagtaatccaggcatgaggcactagacatgtggcttcaagggatgagtgtcaatgattatgtaaagaaaggagcgagtctgggaaacgattataaagaacctaaaggtttctttgactggcagtaggggataactgagaagttgggtcagaaaatctgtctcagtggtgccatttagagtacaaatttggggggaaattctccactcctcagggccgcctccatayccscaggtttaggctgagcagaatctgagctctgctgccaaattttgatgagaatgtcctcaggaaaagggaggggccaccattaaaatcttttctatctatgacagcctccatttcaggccaaactaccctcctctctcctttccttgtttctcagatttttaaccttccaaggtcttcctcccaaatatgtgctcagactcacaacccagctgacacaatagtctgtccattgattctatccaccaggcctgccttccataggcatttcttcctccttcagttcaatggtagttttctctcctttaagctctcagaaaaaaaaattttttttgcatctgttgcaagtatacttacgttgccatctccttgtcccccacatacctgccctagcctctgattttattttagagaaacttttggttactgctgaaatggtctttgtccatgcccctaacaattgttgacagcagggacatggaccttttggttcatttgcctttgattatgtggaactgctcatgcctcagctcaaatgcaaaccaaatcaggttctcaggttcagatgcaccttctaggctttaatatgggcataggaaaccagcttcctggtggggtcaagaacaaggcaagaaggcccgaggtgtcccaagataagatgggctttctctttaggtaggaaggaggaggagttcaagcccagcgtggatagccctgtgcagtcatagagaataaagtaggcagaacatgtaggaggaaggaacagtataggcagagacagaagccagaaaccatagcaagtgaaaggaggacagtaaagagcagggaccaagaataggactgagcccctccctattgcgtcaggcactggggacacagcagcaagaccctctctgctttcatggaccttccaaccttgcctgtctgtacggctttacagacaagtgaacagcgcattttcagttgggtatttgagctgcaggaaggacagatactgggagctgtggaaaacatcaaagggcacttccccgggcatcaggcattatacttcctgttagatgctgtggcgaatggcctagctgaggccagatgactgttctcccaagtacagtggggaggttctaaaaggttttaagcagcaaaatgacatgggtaaatttggatgttagaaagctgatggctgttagtaagctcaccttgtggccaggtgcctcccctgggtcactcttggctctgttgtggtttttcttcgaaccaaccatccctagtgtcttgtctggtttatgtcgtgttttgtttttctttctctttcttcctcctgtcctgcgttgctctctcctgggcccacgctctcttcttccttgatgtccttctctctctgatccaaagatcagccagtaaaaagcagtctcacctgtccaggtaagaggggtgccattgtgagggggaacgaagacccactcctttatatttataagttacttgtaccctcacatggtttcaaacattaaaagtaccaaagaatataataaaagcctgcatttccattcctgtgccccagccacccagtttccctcctcagagacaactgtgttatatgtttcttttgtattcttccagagatattttagatatttttggatatgtaaataaatatttaaacatatataaacacataattttattctctcctttactcacttttttaaactgtccaaataattctatattttgtttatttcactcagtaacatatcatggagatattctgtatcatgtataaagagcctcttcattctttcttatgactgagttctgtgtcattgtattactgtaatttatttaaccagtcactcattgtgaacatttagattatttccagtgctttgccrtcacacacagtgcttccatgagtagccttctacttagtcttttgctataggtaggataggaattgcccctttctgaggggcagcaactattgattcaggaacttgcaacttgtacacttttccaaaaaggagtgccacagcagttattgaaatttcttctattcctgtgagggtcctagttgaagaggagatgaagcagtgaatcctttggtttggtgatgtgtaccacttgaaggtttggggtctttagtagtttctaattaggcgaggtgcctcaggctggctgagggactggagctgaatatggggttggaatactaccgccaaacagaccagattcctgtcctcccatggtacccaaaggataaatggaattttcaaaggcttgggccgttcctctactgtcttttctagaaagtgtgcaagttgccagttacccagcgggcttatactcatgcccatttaccctcctggagatcactgttatggagaggtggaactttgagggacaaagagatgaagctaaatggggagcttgtctctgctgccaccactacagccacatgttgtgctcatgcagacctctgtatgtgtttgacccacctcgtccttccctccagtctccccttcctttgcaaatcattgcctaaaactaactggctgtttgttttttccctgtctttttcttgcattcattttctctgctgctccgttctgttccatcagccccattgcagcctggtaagacccaacaagcatgtacacgtgtgyacatccccttcttgctattgtctctttgtcgcctaactccaggaagggttatttcccttcacaccttgctgggtattaaagagatcatgcttgccctgccagcccaggattccagataggtggtgttaccagtggtgtacacatggctaatgtcctaccagattgggttacagggcgggtaggttggtctctcattatccaagrctcagggccccttttgacagagcctccatctactacaaggctgatcccccctgctgagctcattgacatgctttccttactccttctccaggttaagtagcctgtcttctctgggagattctgcaccagagcgcaagtccccttcccaccatcgccagccttcggatgcctctgagacaacaggtaacctccttgggcattaacatacaaaaacagccaggcatggtggcacatgcctgtattcccagctacttgggaggccaatgggaggatcgcttgagccgaagagctctggtctgtagtgtgctatgccagtcaggtgtctgtactaagttcagcatcaatatgatgacctcccaggagcagggaactaccaggttgccgaaggagaggtgaactgacccaggtcagaaatggagcaggtcagaacacccatgcttatcagtagtgggatcacacctatgaataaccactgtactccagcccgggcaacatagtgatactccatctctttttaaaaaaaaaaaaaaaaaaggcacatggctgggcgtggtggcttatgcctgtaatcccagcattttgggaggccaaggcaggcagatcacttgaggtcaggagtttgagaccagcctggccaacatggtgaaaccccgtctctactaaaaacacaaaaattagccaggtgtggtggtgcgtgcctgtagtcccagctactcaggaggctgaggcaggagaattgcttgaacccagaaggcagaggttgcagtgagtcgagatcgcgccattgcactccagcctgggtgacagagcaagactctgtctcaaaagaaaacccacatggacacagagatgtacactcatacagacagatctgtatactccaaatgtaaagcaacttagtgtttatgttaagcacatgatgtatactaggcattgtgttaatgggttttatataaattgcctccgtacatcaacatagaaactaggttttattatctttattttgcaaatgagggagctgaggcacagagaggttaagaaatatgtccaagttcgcaagcttactggggacttgaaaccagttctgttttaactctagaacccacgctttaatcattgcaggatgcaatcacacatactcatacacatgtacgatgtctagtatacactcacaggaatggagacatttggtagtgataacctctgtttctttttgttttttaattctgtatttttttaaaggatacatgacaagaagaaaacccttttatttcagaaataaaagggttttcttcttgtcatgtgtccttccctagatttggcaagagaccactcctaagtcaccctgcatgagttatccagctctataaaaagaatcaacaagcattggtataccacttgctgcattcattggatgtcacttaacatgtaacttctaggctcacttgggcttcaatcctgggaggctccttattggtaatattagtcttcaggaggatggctagacctggtcctaccccttctttgaccagtctcacccgggcacaccaaaagggacagacatgtttgtgagagacaagcattttagcacctcagagaagggtagtttcttatttggaatacaaagttaagttataggttttgccaaccaccaagggaggcgtgtcattgcratagtgtttagacaggaatagtctagggaatttgtttagtgtgaaaaggcttcttgaagaagaaaggcactggggcttccctgggttggtcttggcatgtgtacactaacctcccartgacactgcgtactcaacctttctctccgccttccaggtctcgttcarcgctgtgtcattatccaaaaggaccagcatggcttcggcttcacagtcagtggggatcgcattgttctggtgcagtctgtgcggcctggtgagtgctgcatccctcctgcccacggtggacagttcttgcaaagccaccatgtatgtgacagtgccattctacctgtgctttcctgtggggcatgaatgaattactctagaactggttctccatgggtgcgtggggaagcctcttcaatgctaagcccccaggcagaatttctagagattgcacctcatgctcgcttccctagctggaaagtgaaaaaccagcagaatagctgtcaggtcatcatcaggcagatgtctgattgccatcgaagggagcccctcatactgggtcacaagattccatggaggaatcaaaggccccctttcttcatatttacctccacattacctggctaagtgcacagatggtcactttctacagaggtttataacctgagacaggcacaatggtccaaatgattacagagcacatttgctgatacaattaacattaaataataaattaccaacagatgaatgatatatgttggatgtgatgtcaggggaaatggtgtttggaagtttgagtagtttgtgatttgaggcatagtcattttccttgtgatcatttgggaagccctcttaaaagaaacaggattttagaagtagtttgaaagatggaaatgaaaagcaaatcagcaggataggaatttggtgggaaggaagtgaagagtgggtgggcatcatagccaaatccatcaagttaccaattgtgtatagaaggggtgtgaacagtcaaaactctagcatatgccaggtagtggaaccactgttggtggtccaggctgaggaagacaatcaaaaaggcgatgggtggccagctgtggtggctcacgcctgtaatctcagcactatgggaggccgaggctcgcggatcacgaggtcaggagatcgagaccatcctggctaacatggtgaaaccctgtctctactaaaaatacaaagaaattagccaggcgtggtggcaggcgcctgtagtcccagctactcgggaggctgaggcaggagaatggcatgaacccgtggccggagcttgcggtgagccaagatcgtgccactgcacttcagcctgggtgactgagcgagactccgtctcaaaaacaaaaaacaaaaaacaaaaaaaaaagaaaggcagtgggtgtgggagagtccttaaagggtaaagaagtgtccctaaaaggagtgaacttcagtgcagtaagtagcattgggctggtgacatggagcatcctaggcttggcttaaacaagagcacaaggaagggattgggagcaggtttcctgatagtgcagagcaggagggaaaatatacttgcattgattttggaggaagatatgagatatgttcacaggaaaggtgaaaagagaatttcaaatgtatgaccaaaatgagtatgtggatcatataaggatataaataagtatggcttcttatatttgggagtaaacttatatcagtgggaggtttgttttgcatatcctggggtgaagctctaaaaagatagttttattatttgcttctcttatttctcagggttcctggactagggtgagacagagttagtggaactgccagtaacttgtacttttcctctgctggtctatctggtacagaaaatgtgtatgggatcccctccagtgaagtcaaggttcagctctcctttaccttcttccttctcttaggctgagcagagtcagacccagagaagaaagaaggaaaagatggcttacagggagaatatgagttctagagtctgtgtgtgtgagagttgtgtgtgtgtgcatgcatgcatccctgtgtgcatgtgtgtgttggggaggagagtaaaagagacttcatttggattggcattgaagtcacaagagtaacaaagcagcggttatcttttccagatacatattaggtttctttaattcactgtcaaagtatagtctgtgttctgcctgtattagaatcacctaagcccaagatgattgaaatccttttycttggggctgacctcggaagcactgaattgctttctggcaagaggtccaagaaatacactttttaaaaattcccacagtgattctcakgcttgctgaagtctgagaatttctgctcaagttccttaactctgaagagtttagtttaaaaaaaaaaaacactaagttattagaagtcacctcacgtgtttcatacattcaggcaagatagttctgttgtctttaacgttagtttctaaatgaacgtataagagggaatttcaagctatttgcaagtactcttccataaatagcacactttagctgagggtagtcttgagtcccagtattgaaaagccaaattggaatgtagtcatcactgaatttttctttttagagtagaaacatttagatgggctttgtgggagttttgttttgatcagaggaatgcaacttaaagatttaatgatcacgttggggcaaatgtacaatatgtaatttttatgcttctcattaacttgttttggctttagtgttttttgtgcttcctggatgtaaattaaactaggaatataagtcatttaaaactatcttgtgaggctgggcgaggtgacacatgcctataatcccagcactttgggaggcaaagccaggaggattgcctgagctcaggagttccaagaccagcctgggcaatatggtgaaaccctgtctctacaaaaaatacaaaaattagcatgtgttggcacatgcctgtagtcccagctacttcggaggccgagatgggaggaccrcttgagcccaagatgttgaggctgcggtgagccaaaatcgcaccgctgcactccagcctgggtgacagagtgagacacagtctcaaaacaaacaaacaaaccatattgtggtcaaaaccactgtagcctccagttgaatgacaagttgcaaaagtcaagagcatgttcttttgagcacctcacagtcagtcaccatcagaagctcttaatttggtccattttaaagggagaaactgggctgagtatggaggctcacgcctataatcccagcattttgggaagccaaggcaggaggatcacttgagcccaggagttcaagaccagcctgggcaacacagtgagacctcatctctacaaaaaaaaaaattttttttttttaattagccaggcatggtggcatgcacctgtagttccatagctacttgggagggttgagttgggaggatcacttgaacccagaagatccagtctgtagtgagctgagatcacgcctctgcactccagcttgggctacagggcaaggctgtctataaaaaaaaaggaggggagaaactgtaaatggcttaaaacagtttttttaaaagaaakaaaacagttgtctttaatgatgtgaataccgagaatatctttatgaacctctcaggacttaggaaactcttgttttaatccttttctctgaatttctcttaattattattttaacaattatgtttcatacagtaaactcatttccccccccccccccggaatataactgatttgaccttggaacatatccagatacactcgaatgaagcacacgtgctcttcccagagcctggccctgcctcgctcctgccttggcctggctatcagaagtctggcatcttatttaggtgaaaggaagagcaggagatgggaccttatatagttcactctagcttaaaagtagttgtgtcactggagtagaataggaagtacacccagaatttgagatacttaacacagagaaataagaggaaatttcagaggagaggtgatctgacagggaccttcgtgtagcttcagtggaagaggttgttgggcactgctgaccaggccttctccttacaggaggtgcagccatgaaggccggtgtgaaagagggcgaccggatcatcaaagtgagtgaccccaacacacactcccactcccagcagtggaaatagatgtgcagggcactcctggccttggcccatcctgcacactttcatcttgataccaactgccaggcagccactgagttaggagtggtaccatacgagggagcacagtggtatagcatgagagagagtgaggaggaggatagctgtgttctacattttaggcctttcttgactctaaagcaaccaagcttctagaacaagttttattattcttatttcacaaatgaccaaaataagattaagagggagggttagtaactagtgaaggatccaagacttcaattctcaggttgatattctttcctccatataatgccaacctggggtctttgcccattctgaactactataacctgccctggtcgttcagacctttcttcgacagaatggtgttcaagactagcctgggcaacatagtggggtgcattaaggaaatcctagatgcagagacttcttagtcctctgtaatgaggaagcacactgggtcagtggacattcacatgtgtgtgaagcaaatggttagaaaagtgtataccaaaaataagtgaatgaatgaacaaattaaggaatgaagacacaggtcttgtccttgaaaactcataggctagctggagagacagaacaaatagcagatacaaacagaacaaattcatagtgtgacttgagtaaacaagtgaccagaggaggctaaagagcattggaaaatggcttcctaaaaacatggcattttgggccaggcrcagtggctcacgcctgtaatcccagccctttgggaggccaagacgggcggatcacaaggtcaggagatcgagaccatcctggctaacacagtgaaaccccatctctcctaaaaatacaaaaaattagctgggcgtggtggctggcgcctgtagtcccagctactcaggaggctgaggcaggagaatggcatgaacccaggaggtggagcttgcagtgagccgagatgggccactgcactccagcctgggtgacagagcaagactccatctcaaaaaaaaaaaaaaaaaaaaaagtggcattttgaacttacagaaggatcccctagctgttcattaccattactcaatactgtttgtccctccaacaggtcaacggcaccatggtgaccaatagctcacacctggaagtggtaaagctgatcaaatgtgagttggagagaggtgacaactaaartagggaagcagatgatccgagagggaggaaaggagggaggaaaggtcaggcctggcattccaggaggtttcctttgtagatatgtgaggcagctaaagtcacatctttaatcktaacatggagtgatccacttaagtggccacaattccctattacttcaagtggagacagtactaggctctcatgagacatcttcatttttacccacactcatctttgccacacctatttagaccatatcctactgagaccaggtctccctcaaatacctttcaattccctctgccattcatggacattcttcctcatttgttttctgtttggcagggaaaagcaacaataatctgtttatagccaggaaggcccaacaattgagtctgcacaaatattcaaatagaaacaacaaatgttgaagaaagaattgaagaatgtgggaagtttggggagagcagagggctagaatctgagtgcctggtctgtgccatgtgggcagtatgctcagagtgtgacactggctacttactttagtgagataaagggggaaacaagaggctgctgaggcagcctgtggggcgtgttcccagatatttatgagtggaattctagttgaggtctctgcatgaaggaagggcaggaagtagtacttgggcatgaaggcagggattagagaatgggtggggcattaaaagtgaggagaacttaatctacagaataatgagtttaatgacaggacaagggagaacagcccccycytgtatagctggactgtctctccagaacagcactcctggaacaagtctctctctgtttccctctagctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggtaataatcctcctggctttctttcctcaccctaatgtcctgwtgaaaagctccgcattggggaggaragcaagttaaatccagtggggctgtggtaaacagagacaagccaaaagacatatgaaagaccattgaaagagttgaacaaaaatgaaggctgcacaataacagttgttccatgccttagtgtcctccttccatgcaaatgcatatgaggttttatcacacagcaacattgtgtgtttcctaaatgtgtagaagactctaaggatgctgtctaaaagtgctcctcatcagagagagagtgtacacttcaggcaggggcagaatgcatctgtttaagaccattgccagtcagtgttaaccagggtttggaataaagtcaaggagtgggggaaaggcttcctagagaaaaaagcctgctttgaggtgcaaaatatagagcccactcagtagagggagggaccagaaaaggacaaaaacaagtagaggctaggcgcagtggctcacacctgtaattccaacactttgtggggctaaggtgggaggatcacttgagctcaggagttcgagaccagcctgggcaacatggcaaaaccctgtctctaccaaaaatacaaaaaattagccagacatggtggcatgcacctgtggtcccaggtactcaggaggctgaggcaggagggttgtttgagcccaggaggyggaggttgcagtgagccatgatcgtgccaatgcactccagcctgggtgacagagtgagaccccatctcaaagaaaaaacaaaacaaaaaaacaagtagaaagagaactctagaagcaagaaacacctatgtgaagagttaaaagaggacaagatgcagacaagtatagggaacaggacttttcagttggaatgaagactgagcccacaagtcctgggagactttagagagcaacttgataccaaaggtgattacagccaaattgaggcataaactcaaaataagattttgtgtttactgcattccggcaaggtactgaataaaacatacttatgatccaggctctattctcatagctgtccttgcccaggaaccagcagatagaagagagctmagctgttgagttagtccctaactcttatattgccatattttccatgtctaggatcccgaagttcaaaaacatgccacccagatcctcaggaatatgctgaggcaggaagaaaaagaattacaggtaaggtcactgccaagggtagactggccattgcctgagtgaaataatactttatcagagcagcctgccaatgtacacaacttaatttacaggcaatatcctatcacagtaaaacctcaaaaaataaaacttcckgaccactaaagaattgtcattggccagtagaatttgttaaagcagaatttcaccaataaagtgaataggattctccatgtgtaatagattaggatagtgaatatgtacacaaaaaaaagtcaacagagtttatctgggacatttccaaggaagggaaggaaaagagggaagaaagggatgggtaggtgagtgctgggccagactgaaagaggtggggagcacttgggtgaaggatgaagagagtttacaggcctaggaagtgatgtgcacagagaacagtaagaagattaatttactggagtggaataaccagattcctattatagccatccatgtaagtgccaccatatataaaacactgttttagtttctaggctatatagaaataaaaaagattagatggttcctcccctcaacatgtttaaaatctaatggaggaaattcaaattacagtaggagggagagtgggaggaacaaagagcttacaataagagaacaaagaagagaaaaattaattaataatgggaaatatggggaagcrcttcacagagaggatagtatttcagctgggccttgaagagtggtactttagtaggcaaaagagatgagggagggaatgccagtgaaaagacagcataggtcaaaggcacaaagatatgaaaatacaagtatttatttcacaagcactgagtccttgctatatgctagataccgtgtgtgtgtgttggagcagtagatgggggtaatgttaggggtgggtgttggaatggttacaaagataaacctctcctttaatgagttagtgattccataggatatggatgaatgaatgaagatatactatattatgataagtgctaacatttatatattggcaaatgtcagagtaatcaagacagtataatactggttcaaggatagacctgtagatsaatggaatagaattcacatgccagaaattaacccatacatctatggtcaattgattttcaacaaaggtaccaagacaattcaatggagaaagaatagtattttcaacaaatggtgctaggacaactggatatctacatacagatacttaatttggacccttacctcatacagtaaacaaaatttaactcaaagtggacaaagacttaaatgtaagagccaaaactatttttaaaaactgtaaaactcctagaaaaaattttaggtgggagtaaatcttcatgaccttggattgggcagtggtttcttagatatgacaccaaaagcataacctccccccaaaaaaatagttggatttcatcaaaatttaaagcttgtatatgtcaaaggattctatcaagaaagtaaagacaacccatagaagaaatggggaaaaatatttacaattcaagtatctgataaggatctaatgccagaatatataaaggactcttaaaagctcagcaataaaaagacaacccaatttaaaaacttgcaaaggatttgaatagacagtctctaaagaagacagacatacaaatggccaataagcatgggaagatgcccagcattgttattcacaggaagatgctaatcaaaatgacaatgacctaccacttctcacctattaggatggctataaccaaaataatggaaaataacaagcgttgtgagatgtggagaaatctaaacaatacttgtttatgttttgtctgcatattcactgtgctaatctattccgccattgatggtgggagtgtaaaatagtgcaagcactctggaaaacagtttgacagtacttcagaacatgaaacacagcaatactatatgacccagcagttccactcccaggtatatatccaagagaattgagaacataggttcacmcaaaaacttgtacatgaacattcataccagcattattaataatagccagaaagtagaaacaacccaaatgttcttccgctgatgaatagataagcaaaatatagtctgttcatacaatgggattttactcagccataaaaaagaaagaagtactaataaatgctacaacatggaagaaccctgaaaacactatgccaggtgagagaagccagacacaaaaatctacaggtygtattattccacttacatggagtgtccgaaatatgcagattcatgaacagaaagtagatcagtggttgccagagggttgaaggaaggggaaattgggagtgactgcttacaggtaccagctttctttttggagttacggaaatgttctggaattaggtagtaggggtggctgcacaactccgtgaatatactagagaccacttagttgtacactttaaaatggtgacgtttatgtcatatgaattacagctctatagcaatttaaaaaaattttaatgctcttaaagtccaaaacaaagcataattatttatgcaataatcagaaggcttcgtgaggtgatgcttgagttggrttcagtctgctgttaatagaacgttgaaaatgtcagtgggaccaggagtggtagctcatgcctgtaatcccagcactttgggaagccaaagtgggaagattacttgagcctacgagttcaacaccagcctgggcagcatagtgagaccatgtctctaaaaaagttttaaaaattagccaggcataatggtgcatgcctgcagtcctagctacttaggaggctgaggtaggaggaccgcttaagcccaggggtttgaggctgcaaagctataatcgcaccactgcactccagcctgagtgacagagcaagaccctgtctcaaaaaaaaaaagaaaaagaaaaagaaaaaatgcagtgagtcttgtgactggaaggtgttattggccatgaataccatgaggagcttggaatttgttttgaagtctgtgggaattaatcaaagaactttgagtgggggactgatgacattttcaaaccagtgttctttggagaagtgtgttaaatgtaaggaaaccatcgaggaggctattgcagtagataagcaataatgacagatttaacaagaacagcaggagtaagagcaaaaaggagaggatagcaatgggagacttgtcagagggccaatcagtagaacttatccattggtgaaggagaagaaagaataaaagatggctccaagtttgtgtgtctgggtagatcaggtgataccagtgacagagtgagatagaggagaggagcagagcttaggggaaggaaatgaaggtcagctttgggtatactagtgtaaggtgcccatgagacattcagataaaaaccagccaccaggcatatggagataacagggctgaacttaggagaaaagcctgggttgaaacagagattcggatatcctcagtatgaaggtgatagttgaaactggggactggatgaccgaaagagatcacccagaacaccagtacagagaggagagagctgaggatggaattttgggacataggtgcttctacagcacatggcaccaacctctaataatcacaccacttgctattacatttgatttttgaaagagtagcctgcgcagtaatgggaggaaactagattgtatatgttgatgagcaactagaaacaaagaagtgcagggccctagttgtagactaatgttttgaaacatttggctgtgggctgggcatggtggctcatgcctatagtcccagcacttggggaggccaaagtagaggatcacttgaggccaagagttcaagacccctgggcaacatagcaagcccctgtgtctatttaaataaataaataaaataaaatcagaaaaccacaggctcatatccctttacaaaaaaagaaaaaaaagtggctgtgaaaagaaggggaaacaaatggggcagtggcttgaagaatcatcagaaatgattgaaagacttttgttggggtggtttgtttttgttttaaatcaggaaactcgaacattttgtaggatggagagaaggagccattggaaaaaggagactttgaagatatgtgaacagtgcccaagaagagcccaaagcagtcagagggttaactttttgaaagatttagacatagtttttcttctgagccaggagaaaaagatgactgaagatgttttgaaatggagtacagttgggaaggtttttaccagatggtattatctgccaaggctagagaagggttggggtttgatgggcatggagaagatgaaatattaagtatggggaatttgtaaaatggttgtcaggtagtagtgaagccccagatgagcctagataatatgtgaacccaatgtctttatttaccaacaagctttatggagcatctccttttgtaatgaaatgttaatagctgccatgtattcaggtatctgactttgcgctagacattctgctaagcacttcatatacataatctcactccactattacacccgtcccatgaggcrggtattgtcatctccattttatcaatgaggatgtattcaagcttgcccaagtctatacagctagtaagtggaggtgccagaagtcaaagccaggtgtccctaactgtgaagccctgaggagtgctagataagtggctaggatggtacctgctctccaggagcttcctgaggatgggactggcacaggcattggctgttgtagtcgacactgcttcctctcatttcttgtggttccattgtgtgtaggttccctyttaagcacttttttatgttctggtctggacaatcaaatatttcatacttgagtggtagctgaagaaggcctcatttgggatgtgggacttaaggcagaccttgaagaatggctcagattaggacaggcctttgtgtttgtcttctttctgtggttgtctcctgtgttctttttctcatcacttacatctttttctgatcctgaatgatgttgaaataccgtgcatctacttggaggcagagacctcttctctctcatctttgttttgggataactgcctattctccccactggtgagtcatccattctctattaaccacccctctgccttttcccctcccccttctcctcctcacccatccctagcgtatctgtgaggtctatagccggaaccccgccagcctactggaagagcagatcgaaggtgcccggcggcgagtcactcagttacagctgaagatccagcaggagactggtggctcagtggtgagtgatgtaggcacagctctagtaagggcacatgcagtagaactgggggtagagtgagggaaaaagcaaggacagaaggcttcttgggttatgccaggacctcaaggctgaactagtaagtgtttagtattttacaaagaaaccaaggtcagcaccaaagaggctgagcattgtagtgacacttgggataccataaaaagaaaaagcctatttcttgccctccaacaacataggcaatggaaagaaagaaatatgaaataaacagattgtcagtgttagtctctgaattattcttcccttctgggtagttcttcatagtggatgtatgtacatttctatactggttttacccagtatttcatctggtaccctttcccaccacctatactcaagtaatgagtcttctcaaagaaatacaagtactttttaaagtcagactacataaaagacccccagtctgttgagatggatctgtatcagcagataaccacactttatggaaaactccagagagtagatgattctttatctattctcttcagggactttgctattagtgtcttactgctctccatcaggccttaattcttggggtaaataagaagtaactctccagaaactttaaggtctccaagaataacatttgacaaagccaataggaattaattaaagatgatctacttttgcttttaggatatccagatcaaaaaagtttgggaaacataggcaaatacatttaaactgcttcattttctgaaggacttctcatattacatggctgataggtaggagctcaggttgtggacttagaccatctggattcaaatccagcatcacttctcatcagcttaaagactcttgggcaagttaattaatccataggagccttaacttcctcatttataaaatggagatcacagtgttgtcagagttaaagcatgcctttgacagaggggctgtacatgtttgctgctgccactgcactgttgattgtgctatgaggtgatgagtctgagaaactaagcttggaatctgaaggtctgagcgccaaccctggccttagggttgacctgctgtgtatcttgggcaagttacttaagatctctgagcttctgtttcctcattgataacatgagagtaacatgcctaagccagagccattgaaagattaaatgtgacatagaaaagtgctttgtaaacagcaaagcactatcaacatcgcttccttcacatcccactagctcagtcagtctcaggccaatgcctgtccatcctcctcaaagatctccaaaggtaaaccttttatatyttccctcggtcacctgcttgagtctttttttatacttcttgatggttaagaagttctttcttgtatccaaataaggcaatagatgctttgaggtccagggtgattggataaagctagcttttagaatttcagtaatggtaaagctccctttccaccattaggggtcattgtcatcctcaaactgtacaaatgaagcaatatctcttctagctgggcatttttgaggcaatgaagcggaagaggccactaattgtaagcaaataaggcactgattggtgaaagaaaaccgtagggggagaggctcacagaatttgcccaccctgtgggcctttctgtttcaggacatacttccactatatggtgacaccagccagagaccatcagaaggtaagtcccccatcaccccttttttctctggcatatctctagtccaggtttcttacctgtttaccctcsccatggggcagattccaggaaagaaaatatatagtgcctgccctctgagaaatgaaataatgggagaaagcagtacaaatacacagggaagctggatacaacttaggcagtagaatagagtgtatagccaatagccgggatagataagggctagtaagataccagaatgagtatggtccagacagcagcttgcctgacagctcctggcactaaggaattcagcaaatatttgttgtaagaagaaatgggtggtgaccagaagagggttgggaaggagttgaggagcaaaactagttgtgagagagagttatggagtcttatttcaggaggtgacatggcctgtgcccaggtgcatagacaggtgaaagctagatgtgatgagagcagaggggaggtgtgccgggaagtgtccgagtctagaggtcatgggatgagagagctgaagggaaactggtgaaagaaaaggtggcagctccctcttcctgccctgcacacaggtgcccagaataaaggctctctttcccctaggccacagctccttctgtrttayagaaactattttcttctcaggcyggctctctctggattcccaggagggggacagtggcttggactctgggacagaacgctttccttccctcagtgaggtgagtyccagcagggcaaggcccattcagaacgtgcattcggggtcccttcccttgacccaagttctgctgcctaccagctgcactgaggcctctgtgtgcctcttccatcgttctagttccaaggatataatcactgtgctctgggttccaaagcagaaatttcagatgcatccaacatgcaagattatcaaatctggctttcattttatcattgtcaactctgttatataaagagtaggrtggagagggcggccatggcattaactgtggcaagcctttgagagtgagggagcagagacgaaataatctaaaacagtgacttgaccaaaaacatatttccacctgtccaggaataacatcgtcttagattaatacagtgaacccaacctattcagaagtggtagtctttttttgctgtggatctttttcttcccaaatagcttgtcttttctggaatgactaaaagaatttcaggttttgacctcaaaggttatctcttccaggtgttctcagtttgcacatgtaaactatgaacggcaatacaaaagtaagaatgaatggaagaagtagtaatgaagttagcaaaatatttgcttagccagagtaattaaatatgtgaatatgtggttgaaaagatgttaaaaacctaattttagatcacaattggaattttattttcttactgccctgtccatgggaaaatggtgaaatatatgtgaaaggatcggtatgtgggaaagtcaccaagaaagtggagtgggacagggatcctaaagaatctacagttgacattatctggaaggccacagagttggtgatgaagagtgtgtgctgtgagttgaggctgcctgggttaagtccaggatacacctcatgactagctctctgacttagcaagtctcataacctcttggagtctcagtttctttgtgtgaaaatgggacgaataatagtatctacctcaaagggctactgtgtgaatcgaatgagataatgtgtaatgaagggcttagtataataccaggcacagagcaagtactgcacttctcttagctgatgttataagtatggttatcaccaccaacaccaaatgagctgagccttgagggtcttccggacaaggttccttctcacagaattctttgtttctctagtcattgatgaatcggaactcggtactgtcagaccctgggctagacagtcctcgaacctcccctgtgatcatggccagggtggcccagcaccacaggcggcagggctcggatgcagcagtcccctcaaccggtgaccaggtgagtgatctggagccaccctgcagttttccttttctcagaagtgagatttggaggcatgggtgttaccagtacatcgtcttggatcatcagactaaacccctgcttcagcaacccaaactttgagacagtcacttacatagagagcaaatagtaaagaaagagaacatggcataaatagagatatgaaagtaaggctggctccatttctatgtggagagtgggtgaatgcatctgtagggagtaacagctaaggagcggatagctggtctttctgtctatacagaataggaaataggtttaggcagtgtttctccaggatactaattttcagtttccccgttccttagcaaaatccttttctcaaacaaaatcttattacttggaaccgtaacatagaaaagaaaaaaaaaaaactcagctcccctaggacctttactgatcaacctccccctgccctcaagggcacttccatggagccctaaggttctgcaaaacctgatttgaaaggccctgctctcaagggtggagctagatccaggagagacttcaggaagatgggttttgacttaatgcaaacagcttgcaaagaagctgggctgtctggcaatggaatggacttgagagccagagaattgcctgttgtttttcagacaccgttaaccgtgtctaacaacgttcagacgttgttagacatctaaatattcaacgttctacctgtataatgttacttaatatttttctttaagccaagtttaagttctttaaacttaaattcatctcaaggaaatctgtcattaccttaaattaaaaccagcatcatgatacactgtaaatgtagagtaaatgtaacactaaatataagtttagaaccaagtttgttaaattctacctagaaagatataagacagtgtagaagaaagctgccatttatattaaaaagaggaaaaggagcctctttcttaagacatctctggatgaatgtttaagaaactgatggttattgcctctgatgaggggaattagttggcttgaggacgaagtggatggaagactttttattatctttacccctttgtgtccttttaattttaaactacgtgatgtaacttgctcaaaaagtagagataaaatttaaaacaacccgaaaaataaactctagatcaattctattgcttgtcaaaggctttaattaagcttgagggcaattctgccttggttaaaggtattaaagctatgcaggcaccaggctgaaatttttcctgggttaatcaaaaggatggaatgagaactgaaaagaaactaactttcttacaatatgagccagtattatttaatgccatgtccagatagcacctaaaatcattttgaccctcaacaaaaatcatctcacttaaaatccttatagttccacttcccatgctggaaaacactggtgtcaggagttaaacaggtggtattttcaaactgtgggttgtcatcttttggggagtcatagtttcagtattgaaggtcatgagcagcatctgttttaatgaagtagaatctaatagcatggaaaagaaaataacagaattcatcacatgtaataaaagtattttgtgaaacttctgttttaattacatatgtgtgtgctgagttgcagtgaaagcatatttattagaagtcatggtcaacagaaagtttgaaagctactttctggagttcttttgactctgggagcctgttaatcactgagtccaggaggaggtcttcagaagatggggtctctaaagtaatttggataatgagggagaaatggtacaaggaagaaaacagagcaaacgataatcctactcactgagctctctttggtggtgttgtgattttagtaaacttgtcctctcaccttggagttcagggttccaagcagcatcttttttctcttagagcatttatccctctgctgttacttccctatgtggcttacctcaactttatatgctttatctctgtaggcacctggcacatagtagccaccttcataatgtgtagtgaatgaatgactgaatgggagtaatcaaaattgtcttctgagtggcatcttaggggaggacttatccaggacacagagctcttaagtttcttgaagctgaagtttcacagtgtgatctgtagaagagaggatcatggcctaagtgaacatacttttttataaatctagagttatgcaggcatcaaaagaaaattctaatcaagagctactgtgcaaaagaagaatacatgtgaccaagcctctctgaacctattctggttgggctgccaaattcacaaaaaatagaatttaaaaaagatgacaacatatgatactctagtgttacccattgtataaagtttggttattcttacaatgtggaggggaaaggtggggaaaaggatcggacaggtattaaaatgcctagtgtaccagctgctgtgccagatctttaccaaaaaatctcaagtaattctcacaatcaggaaaaaagttggccattagaatcttcgtgtggtctaagggaatgttcaagggctagccttgttactggcagggtcagaactagaatttagttctcctggtccccaacacggagctctttcctatcctagccgctctttcattgccctctctatacccctatctttgtagaactaaaggaccaagttcagtttgctaaggggttcaggcgtctatcctgttctaggaaaggctttccttcaggtggctcatagaagcaggtgtggggtcaatagtgttggagcccttgttttccttctgaaattttttcatcttctgaaaactaagttggtattttcaagtgttaagagcaaatagagtataatttccagtttcttagtagtaataartgttaataacagcataggaagaaaacctatactttccataaaactgtcagcagcagggaaatggatgcataaggaactctcactttctgttatgtcattctataacatttgatctttttaataataagcatattctacttttgtaatcagaaagaatatgtatttctaaagactttaaaaaaaatcctccccgtaaacaagcaaaagcttagtgcttttcaggtttcaccagagagctcagtagagccagaagtgctcacccaccaccttctggggctctcagaccccaagagggtcagagagtagggtgtttcggagaggaggatactcaggatgtgtctgggaaatacaaatacagcacatcaggcctgattctgcagctttgagcacaccagtcagtctgtctgggcctcacttttttcaattataaatgagtgttagactctagtgtctgagataccttctgggccgctcatgttctgtgactcagtcattctgggcatagagaccataaatatccaggaaaacaaaaaaggggtgaggagcatcagagaggaactgtcaggaaaagccccttaagaaagtgggttaggagggtatcataggtctgggttaaaataggcacatttaagctgagtgggttccagaagcagagaccttgttggggaatcactggaaatgaaaaatatcaaattgagtgagaaatacagttagtagaaaagctttgaaagctcaaggaacctttaggagaaaaatttgttcagtgaagcatctgagaagtttatgcaatatgaagtcttatcatacctaatccatggcatgtccattaagattaggtttttatttaaattagcgtaagggggaaagaaaggaaagccagactaagaaatttggattttagacaggtaatggggatctaacacagattcttgagcgggcaaacaaaataatgcaaatggtgttagagaaagatcagccgcatctccatttgttcagagaggcagagatctactagtaggctctccgatcattatttagccaccagtacttactaggcacagaataactgttcagtagcactgtggtagacactaggtttggaggatgtgtgtttggggtaggggtggctgtttactctattaagtaaaacagcccccaacccagcagtccagcaggagctgttggctcttattttgttgactgacagtcccaccccagatcttttgcaaacaggaagagagcattttctcctacttcccatcttcatatgtcatgtgacmaggctgctctgaatctgccctgccccacccagaagcagttgacttcctgcaagtggaaatcatttcatctgtgctctgattttgggggcgggagtgagatgccaacgttcaccagacccgggtggctttgtgagtgctgtgctgcaactaaacaaacttcactgaggtggttgaatcctctgtcctctataacctctcatctctgcaatttgactctctcccccagggtgtagatcaaagcccaaagcctttaattattggcccagaggaagactatgacccgggttatttcaacaacgaggtaacggtttsctagttttctcctttcatcatttttttttgtcatacaagctgctcttgactagaagcagtttgactagcatcagctgtgaagggaacttgaggcggggagcctcctgttatgaacccaggacggggaatcacatgggagctaagctggaacccgctgtgctgctgtgcccggcttcccaccatgctcatccttctgccttccagagcgacatcatattccaggatctggagaaactgaagtctcggccagctcacctgggggtttttctacgttacatcttctctcaggcggaccccagtccactggtaagtcagaatcatctgtcttgattgagtgcctgctggtactgggcagagaggacctctagcctctgtttctgctccctggctgttacaagtcagatccatgggcacagtcaggcatttcaaggacagacaaaatagccaagaagatgaaacctatggagaggggatttttcactgtatgacacagctaactaactacatcagctgcctagggaggagcaagagagcaaggccaggaaaactcattcttgatcagttcaggaagtcgtcttggagaagttgctcttcctagagttttttttttttttttttttttttttttttgagacggagtctcgcactgtcgccgaggctggagtgcagtggcgcgatctcagctcactgcaagctccgcctcccaggttcacgctgttctcctgcctcagccccccgagtagctgggactacaggcgcccgtcaccatgcccggctaatttttttgtatttttagtagagacggggtttcaccgtattagccaggatggtctcgatctcctgacctcatgatccacccacctcagcctcccaaagtgctgagattacaggcatgagccaccacgcccggcctcttccttcgttttttaaacgaaggtagatacagaccgactagggagttgagagagtggccctgtgagaaaacttgcagatggcaaggcttaaagggtcttccgtgtgaaggtgatgacaagaaggaatgtgaagggatggagaccaaagtgccggggaaagtgctcagagccagcaaccttcccagtttccttattctgctcaactgcttagaacgggagggcagatggagtagaggagttgcggttgtattcttcagaataaacttctcacctggggcatgggctgctgttttgtctttctggggataccatcagaagccagaatgaacagccatccacaggtattcattgaacacctgtgtgcatgtccaagtgccagaagcattcctgaataaagacagggcacaccacaaagagaaataaaacatgaacccttaggaaacaagacgtaaaccagcacaagacacaagtgaaatagcacgtgtggagaggatacagagttgaggagtgatcagtgttgaagatgtgcccgtgggaaagggggtggggattattttaccacaggtttctgaaatactctgaccccagctttctcaactgttctgaactggagaattctttgttgtggtagactgttctgtgcctttggggaaatatggctgcatcactgggctgtacccactagatgccagtagcaccgcacttgcccagtagttgtaacaactaaaaatgtctccagacatggccaaacgtcccctagggggcaaaatcactgctgggggagaaccactgctctaacccagttctctctcctcctagcttttttacctgtgtgcagaagtttatcagcaggcaagccccaaggattcccgaagcttggggaaagacatctggaatattttyctggagaaaaatgcggtaaggcagtcatagattggattataattttatcatattctttgaactactcagaggcagggaaaattaagcaaaacatccaggccaaacrgagacaggttcttaaagagaaatctaggctgagagattaatattcctggattctgttcctagcgccactctcaaaaaatctcacagtacctctgttgttccacatatagaatacacattgcctgtctctggaatgtttggaggaagagmttgtaccaaattctccctattctcccctcattcagtgccctggttccccccaaccctccctgccttgcccatccctaggccgaagaaacagaggtctagagacatcagatgacctagatccgtgaggcaagaggagaacccaggtttctgaagctcagtctgagttgctattactgcccaaaggcaggagtcagagatgggaggccccagagtgtctgggatagacagcacgctgtgcattgggacagagttcccggggtatgtcagggatcccgctggcaagagcatttctgcctgcaaagggcaatcgccatcccagactttctaatctgatcaactagactaattccaaggtgactttattcttttggcagtaagctagtagggttaatgaggttggagaaaattggtttttcttaagagttttatatttgccctcttaaatgggtcttgagtagggaggttagagctgccagttgttctctgttggttgttatggaacctttccagtatccaggtgtcagggacttgtgtagcaaaagccagaacaccatgctaactgcaaggctgggtgacacaaggctagctttcccatgggagtgagcgggagggaaagtccaccaaatagcctaatgaaggcttttccttttcccttgctgctaagtcagcacaggtccactttttggacaacatgccatcccatgcgctctaatggcctggaaataagagtgaaaaaaactgcctgtgccgccctcagaatatagtaccagcttgctctgtagcctcagactccatttcccaaaaaccctagcctagaattcaggtgtgcagttggagagtgatgagaaggatggtaggcagatgtaggcgaaaaggcaagaagttcatgtggccaagccctcctcgccttgcacactgctcatctccctggagtgtgcagacctgactgcttctgctccacacttctgttttttagcctctgagagtgaagatccctgagatgctacaggctgaaattggtaagttggctcattggtcggtaagtctcttcttggtagctttcttgtcctgagctctcaggaggctccagaggacagaagggacatagtccctgtccttgggcaaccgtcctgtaatagaggaaaagacccatgggatgattgctccagaacactrcacagtagcttacggacaggtgcaaatgggacagaccctgcctaggcgctcactctgccggggggagcttgtyatgggaagacattggacttggagttaggagacctgggttcatgtctgccagccttctacatgacctctctgggcctccgttggcttatctgaacaaagaggaaacagacttgattagggattcctcagccaggttgattgtcaagaatcccttggggaactcaaaaaatacagaaactagggcctcgctccatcctccctgcagagttggaatctccagagtggtttttcttattgttttttttttgggggggggagggggggttatttttgtttttataagttccctaactaatactgacagcagcgagtccagagtgaggaccaggcaggctagatggtgcccgtctcccttctccttctaatcatgagtagaagaattaaggrgaggcagtctaaggtgatgtcagcctgagaagctaatcactggcagctttttagaggacaggaattggaagctgcatttagaaagagatgatttacgggcacatgtgacggggaggaaagcccaggcatagggtaaacagagcttgctcaaaagcagagtgagaatgaaacacagctcccaaggacttagcctakcctgggtggagctagatgcagggactagaggagagacatctttcagtttctactggggagctcaggtttcatggagtgtgaagtgcttgccttttttagccttgtgagctgcttctggagcagtagaggggaacaagcctctcagaggtctgcacttggatgtcagagaatggtacttagacatatccaatgagagggactttaatacttctcttaatggagcacagaacatccagaaaatatttttgtccttgccttggactttagatatcagcatccagtcctgaattcaggaatgacctgagaggtccaggcctcctctccttttagactaacagggcagaaagccagcccttcctcccagtgtcatagggagctgaaatgccttgagatgctcagcagaagggatccccctccacccccagtaccccatccactctgctttctctgatctcccactacagactcgcgcctgcggaacagcgaagatgcccgtggtgttctctgtgaagctcaagaggcagccatgcctgagatccaagagcagatccacgactacaggttggcccaggagctgacctcccacctctctcctcgttcacctcckcctcttggccctggcwccttccctctgggacgtgcacatatctcttgttatatgtgtttgtcttgttctttctggatgtccatctgttgagtatttgtgtatatttctttctttccctgtgtttatctggcttagaacgaagcgcacactggggctgggcagcctgtatggtgaaaatgacctgctggacctggatggggaccctctccgagagcgccaagtggctgagaagcagctggctgcccttggagatattttgtgagtctttcagcttcctcccaccccactgaacatcctaagcaggttgacatattttgtgggtctgttctttcaacctctccccctcttccacttcttgcctgattctcctgcccctgaaagatggggagtcctgcactcctgctgcattggtcaggctgagggctgcaggtgttcaagggtgtggcagagcctggagctcctgatagtcatttggtggttatgacagaccacgggccccaggaatgtggtaagctttctgctttcccctgctggccctcctcctgacctctctcccttcctgcctctaagatcttatctgtcacagagagtgaggccagtgatgtgtgtgcccagtggataaagttccttcaggaggcagctagaactggcttaggggaaattgaaccatcttttactaatccacatcagaaaactgaactagtgcaatatactaaggtgcttctggcacagccgcttttgttatgtttttctagcgccattttcgaaagtgtcataggcacctgtgatgcaagccccagtatcacagactttatggggacacttcaggcttagaagcaattttttgccctactactgcttctcactaagtagttatgtgaccttggttaagccattccatacaagtcagatccataggcacagccaggcactttaaggacagggtaaaaatagcaaagaagatgaaacctatgcagtctctgctaaggctgatatttcaactcggcaaatatttatggagttcctgctatgtaccaaatacttgtgcatcagacgtacttctctccttttcccccactaaccctcctttcatctaggaaaaacttaccctcctcctagcctctaaccaggtgaccagcctctgtctttgcagtctgagtcatctgttctttcttccattccaggtccaagtatgaggaagacaggaggtaagcaagtctatgatgtggatttgcagctttcaaggtggaaggagtggggttgagctactatgctttccatttctgacaatcacaggggagtccctcatgttgtacaaccatgaaggaccgtggttcctgaaagtctagcactcaggtgtctgtatgaccataacataggggtgatgaggcccacgcccctgatgctcagggatcactgcctggggatgtgggtctgctcctcagtgggaagacaccaagctgccatcgcttctcacagtcccatacctggtggcagcttctctacccagatgagccctttgtctctcttctcacgtctttcccttaaactacctcaagtagtaacagtaatcgtggaatcagcctgttagtgacatctgcagaggggagctggggtgcagcatagttcctttcttggcacatgttagaatttttttttttgcagcctatatatttatctcattgtttttcattagccaaggttaaaatgagtctgcattccctgagcatacacattaataagggagagaaaatggggttaggagtctgtttaagagggaaatacagacagagctgaagccttgctgcattgaatgcatagagtgggtcatcatccatccagcaaattgtgggtacaaggacatttttaaacagagctctggacattttcatttgtggcagttggaagccacctgacagctccttttccatctctttttctctgtactggggtgggaggatggtgaaggcagtgtaccttggcagaggctgcttggcatttctcctttcccctggcctccccacccctgcacatatgcctgagagtatcagctgcagacctcagccagtcctccacatctgcctatggcttgaccaggcaggaaattatttacttacattttagggaattggcatgttcttccactgaccatcatctgctcatggggaagagttctgcttagggaaagaataagacttctcctgggaaaagtcttattcttggttacctgtgggctcactgtgtggagaaggtcacagcccagacttttagccagcttctgcctgctgtcccatttaattattctagacttttctttgaatactttcacctgtaactaccccttccccactccactgcrtggtggtgaagagattgtttggcacagggaagataacttgagctctctgattcaggacactgttcctcttttacagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaaggtgagggccgggcatggtggctcatgcctgtaatcctagtactttggaatgccaaggcgggtgattgcctgagctcaggagttcgagaccagcctgggcaacatggtgaaaccccatctctattaaaatacaaaaattagtccagcatagtggtgcatgcctataaccccagctaatcgggaggctgaggcacgagtattgcttgaacccgggaattggaggttgcagtgagccaagatcataccactgcactccagcctgggcaacagagtgagactctgtctgaaaaaaaataaaaagaaggtaacagagctgtcctggaaaatatctcctcttgatgcagttctctgtgctgaggtaggtcaggaaagccgttttgcaggtctctggctacatccctccacctggatgtggagtcagtgaggacccccagactagagcagctctcagtctcttccaaacccaggccagaggcgaacatgcttgttagggtaccagcaagagtcagctctccagttacttgctgagggccagccttgggggacagtggcagaattgattagcagccacrcctgggtatcaggacctcctgcaaacaccagtgtctcctgtctcagcagagcagcaattccaagaaagaaaaggatgccttggaggacaagaagcgaaaccctatcctcaaatacattgggaagcccaaaagctcttctcaaagcagtgagtatttggggagcaacagccttgggcattccttgggcagggacctcagccctttcrtgtaccagtatgttggcagagkgccttcctgtgtttctgggagccacaggcccaaactcagaccacagccactttctccccttgccaaatccagtgcaggatctctgaggttcaggtgaatgtttccgagccagggaagccgtgccggtccctgggtcttagtctaggaacccagagcagttctagctaccaaacgaccacgtgagaaacatttcccctcggcaaggatcgccctgtggacagaaaatgcccccttcaccttcatccaagggtctataattggtcctagcacacaagactacagtagtatagatgcgggcgggggatggttgagtcactattaaagtagaactagtcaggttgggggcaagtttgggacccagagattcccctaatgccatcagtaacccaaaactcaactgatcctatcattgatctcttcccagcgtgtgtcatttgtctggaaattgttgctggcccctcccagtcagtaccttaagccccccaatatcaatgggaatctgtgaagggcagtggggtgggctggcctccctttctgaaattgctgcattgcaggaaacggaaagagattcttctagatcagccttgattttcgccactaccttttaattttttggcttgatgtaatttttattttgattcttaaaacattgattgacttttcatggtttacttttgtttttgtttgtttttcttttagcatttcatattcccttgtcccctgtggaaggtaaaaggaccattttatttgggtttgtctttgcattagcattgagtttccatctcccaaatcttgkcttttctgtttctttctcatcatctcccatcctgttcctcctccctccctttctttcttctctccatttctcttatgcgttgctcattgttgctaaagctgctgtgtgctgcaaaccctgtgggggattggggagggcaccaccctcatgccaggtacgagaccttgtctcctaactcagagttccagggggcaaggccccttctcctgcagggacagctccttctggtagttctggccaagactagacttctggttcctctggcagtttttccatagcctgaggccttttctctataattcagtcacatctccaaggatgagggtccaaaaatccagagttctgtataagtgaggggaaccctcacacattgaagggtcttacagtgaagcagaagtgcctcagatttttttttttttttttttttttggagacacagtttcactctgtggcccaggctggactgcagtggtgtgatcttgcctcactacaaactccgcctcccaggttcaagggattctcgtgcctcagcctcccgagtagctaggactacagccatgtgccactacacccagctaatttttgtatttttagtagagatggggtttcaccatattggccaggctggtctcgaactcctgacctcgggcgatccgcccgccttggcctccgagagtgctgggattataggcatgagccactgcgcccggtcagtgcctcagatttttgttttcagttaaaataattaaaatgtcagttttgaaggtgattttattttttatgtaaagtatgggtctccaacagtttttctcttggatatttttgttcttatcatctacttaagcccttcagtatagcacctccatctcttttgacgtttgactgccagcactgtataaccacagcagtgaaaaaagaatgaccctaaatgtattttagaggacctagtatcttccagaatccatgtatttaaaacattaatgtgatacacattaacccacaagaagcttagagcctacagtgaattgtcacagaattgagcaagttcatttcctgttaataaggtccatatgcgtgcaactgattaacactttctaggttctacaataaatatatatatakakagagagagagacagcaatgggatgcaacctggaaactattctgttactgcaatttattttatgtaaaagtgacaattaaaaatattatcttccaaattagtttaaaagttactaaattcctagactgtatgccattttaagcagtaaaaataaggaattaatgtaaaaaagtttataaaacaaggggaaaaaaaagaatggccttgaaatccagtcctcaggtttttttgtttttgtttttgtgttttgagacagggtttcgccctgttgcccaggctggagtgcagtggtctagtcatagcttactacagccttgaactcctggctcaaacagtcctcccacctcagccttccaagtagctggggccacagacatatatcaccacacctggctaatttattttttgtagagagagggtctcactatatgcccagcctggtctcaaactgctgggctcaagtgatcctcctgccttggcctccaaaaatgctgagattgtaagcatgaggcattgtgtgcctcgccactttgctctttttaaaaatgcatttccttctacctgtttctcccctgttactctgggtcattcagttataccagatctcagggctacgcctgtattttgccacagctaaggtataactctatctagaacattaattgtgcattttccaagtggcccatgggaaagggaagagtggactcagcctgccggctttcagttataggatgttcccaggctcccacatcatcacccagccagggcggctcagggctgcggctgcccagctggccctggcatctgcatggcttcaaggcccagatgcacgttcaggctgggacaggcagatctgctcttaatctccaaagtgagagtgatggtaatagccctactcctgtmatgtgcacccacagctacttacacagttttagaaaaatattccctagccacttgcctaaaggctgtcaagttgtaaactgtgaagacagcagctaaatttttttctgttctctctgacttagaagttttcttatgaaagtcagattttgagacagatttgtaagtttgtatatgtagatgtcagaatctctgaagtaggatcagggcccagaccctgggctgttgatattgcctccccatttccccttgtcctttccgctggtctcaggcagccagcatttctagcccacccctgttctaatatggatgggctcagaactgagctagttgacttgaaggtgaattccttatctctcttccctcctgctgagagccacagaactctgggtctgagttctccaggggctgtagttggcattacctgtgccttttcactctaccatctgccctctctgtctgaacaggaacagctctcttctgtcttagctttgaaagggggctggaatttgaatgccagtgaagtctctcctctgttcctcctaggtcacctcttacggtactaaagagtctgattctgtagtgatgaaggccagagaagggcagaaaggacaggaaggagaggcagagaaaaacaaataaagaactctaaaattcatttaaatttgagaaatgtctgatatattttggcaacatggccaaattacatgtagatgtgctttggtcttcctggctgttttttaacctgtatgtggcttttaggaaaaacctaatcatgactttcaagcagaagcgttattataataatgtgagagccaaaagaatgcttatggaaaatatacttccaaaccctctcattttgcgcatgaggaaagaatcaacccagaaaggtagtgtgactgcccagggccacacagcatattcatagaagagccaggaccagaacacatctcctgactcttggtccagtgctgttctcatccacgcttgctcattgctctgtcttctgggatctggggaagtccaagcctgagaagccatccctgaacagcaagcctagtgtccttcattttctttttgcttctagtcaaaccaggcaatgtgaggaacatcattcagcactttgagaacaaccagcagtatgatgccccagaacctgggacacaacgactctcgaccggaagctttcctgaggacctgctggagagtgacaggtagcactggctggatgggactcgccagctgctcgaagagtgggtcatgggcagggctgatgctagggtttaattccagctacttgacccctctccactagcttctaaggctccctttacagaacttcctccccacccccagtaycttcaggagacacattgtgtgccagtgaacaggccagtggaagagcaagcagatccccgacttccagcccaagaactacacacttttcaaattccctttggatttatcacctgactactcagtagccttcatccaagatcgagctaggtgataaaaagcagctaatcaggaaaccctaagtgacaaggataaggaagactatagtgggggcaagagggagtcctggggaaaaaagacccaggcaggcaaaagaaagtggtttcctgtctgtatgtgaagaagagagccagagatgaggttctgctgggtactttaaagacaaatgatgtaactataggcatcagatgtccacctcagcaaagagaggcaaagtggattgattacaaatggactgtttttcccttttcaagaagaaaaaggggaattgagactggcatctctcatattcttctttggtcaggttctaactagagtccccatctggtatgaaaacttgttcttggacttacttgctcttgattgtggcatgacagcagtcaagtcatgtctaaaattctatagccaacacttaaaaaccaacaccacccttaaaggtgacttaaacaggtagagtaatatggtcttgtgtggggggaaataatgcttgtgtacagtcaagcctcagagccactgagctggagtataggcaggcatgaaagcaagtcagtatgcagcagcgtggatattcaagccattttgccttcgtttgtttgtttgtttgttttggggatttttttttcttttttaaagagacaggatctttctctgtcacccaggctggattgcagtggtgcaatcatagctcactgcagcctcaaactcctgggttcaagggatcctcccacctcagcctcctgagtaactagggatacaggcatgcaccactgcacctggctaattgatttttatttttatttttttgagacagtctcactatgttgcccagcttggtctcgaactcccaaccacagcaatcttcctgcctcagcctcccaaagtgctaggattataggcatgagccactgcacctggcctattttgcctttgaaataactaattatcaaaccataagccaacctttcctgcttgaatgcaggttactcctttctgtttatatgaagccttttttcagcttaacacgtgttaaaagattttgctgccatgagaattgacagatttacaggagacaaaggttagatttgtactgggggaaggttgagttctaacattaatgggtaagttaaatacgcaaattatgtgattcctgtggaagcacatgatgtcgtagatatatcaaatattttaagattataagacatcaacattttgagaaaatatttgagaccatttacaaagttgcattcttggcattgctaggtaaatttgccctaagacactygctaggatcctaaagctactctaagcagaagcctttgggtttgatgattatcaactcattggcaatctcagaagaaatagtattagcaatatggtgggtcagagattgttgtagatactcaacaggtataagatgccccagttctagaaggcaataccctaggaatttgggggcaaagacagatgatatgcctcacttcttggtgaggagcattacttacttctgggtgcttgaaggaaggtgcttagctctgcagccccagtaactccactgggtgtttgttgtggtggtacagtgacccattaggacactgaaaagtgttccgagttagtctgggttgggattgttctaacacaattctggagggtgaattcaataagggatcagtgggcagtatgttttctaaccctgcagacaaaaccctcaggaccctaggagatgagctccattttggatcatctggcagtttgggcacaatgaatggagaccgagacatttagctcctcattgcagcaacctgctgtgctattaagagctctgcagacatttccaggcctcctgtggtcctagaagcagagcaggatgtagattactaataatatcagaaaaccagcccaacagggccacagcatggaggtggggtgaccatcmtggggcrgctaggggtcagaggtgccagctgtcttgggctgatgcactgcaggactcgacaccgcaacacccagtcatcagcatctcatcaaaccccagagacactcagtagccaagcacggcaggccaaggagcgggtcctgcctatcagtaaaaaggcccctttaagcacaagcctgtctgctcttgagaggaaatggaatcttaggaacagtattgttaagataagaatggaamtcatccacatcacaactggaaggmtaagaatccagcagcagatagaactttctgacaggcagtgtggaaaatcctaaaatgagctgtgaatatagtgactccactttcctcttaagacctcttaaaagaggttcgcctcaggcagagttaaaggtgggagctgacccgttccaaagcagaggcaacgtgaactggccactaggggcagggagctgggaccttgtgttccctgttgagggacgatgatgtctaccaccttcttgacagaagcatggtgtctcaggcctctggacacactacaactcagagtctgttagccccagatttcatcttcctgttaggatcccttcctaatagctccagaggaagatgactgtccatccatcaggctaggctggggagagaggaggagtttgtagagcagcaaaaatagtctgtcattgagaagcttccactgccatccagctgctttggccatgttcaggaggagaacctgtggcacggaggcatctttgagatggagccacaggtaagagttagccaggrtgtaagcatggcccactgacttcccaagtcccaaagtcttttgtcccttccccccagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtgggcagggctacaacggctgcrcccatggacatctcaggggtggcggcaaggatagagggttgctgagagttgacattccctccacaggtctcttgagaacccaacccctccattcactcccaaaatgggccgcaggtaagtgatgggcacggtggtgcctctgtttggtgtctctgtgtcccatccacacccagctgctcctctcacctgcaaggggctggttgggtggctgtctcctcttctgggcccactggtttcccatgtgcatggggcaagcaggtcgggcaggagagggarggccaaaccctctgtgtgagttcttcctcctaaatgaagctgagctgcctgttttcccccaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatggtgagaacgtgctccactgcccccagctccrctcacacgtgtgggaataggtccagaatgcctaagacacaagggtgggaaagaggtaaatagggtggggggcccctgtgtgctggagcaggtccacattgcctgttgctataaggttcccctcagttctggcccttggagtaagagaaaagttgctgtatgatctgaaactggcacttcagttcccccaaaaatagagtggtgtgggaaccaggtcagggactctagatacttgctgatccgttttctccctggctttctaccctccttgtcacaaccaccgctcagagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacagtaaggagcctgtgcccctccagactcctcttctgctgcccttcagcttcctgttccactttggccccactgccaggacctccctgagtaggtaacctcccaccaatccctggtgagaaaaagatctgtggacagcctgaaaccagcactggagttcaccccgaaagtacaatggtttccagacccttcccatggcactgctgtcagagattcacttctctctgtcagaaaggttctggcagttgagctcaaccccaggcatttctatttgttctcttcctgccccagattcctggtgtgaagccatgaagaagctccgggaggaaggccccatcatcaaagagatcagtgacctcatgctggcccgggtatggctccaaacttctccctcttggcaaggaggagattgggggaggcagggtctcattacccaaggccagagaatttggcaaaggcaggggtctggtcccaggcaggggtttgatgcctggccccgtgtccattctgcctcttcagtttgatggccctgcccgagaggaactccagcaagtggctgcacagttctgttcctatcagtcaatagccctagagctaatcaagaccaagcaacgcaaggagagtcgattccagctcttcatgcaggtgcgtccttggccatgccttggccttccttcatctccatcaaggtcaccaaggatctcctgaacttctctccttctggccacatcatccctgtctacagcaactccctctacccttcgacacacgctcctcaaaagcactgactcactctagacaaagagacttctgtttgttggaaagaatcctggattagcagtcagaggcctggctcacccaccagcacctgtgtgtcctgagatggatctcagtttccttgtctatagaatggcagcaatatgcctgcccttctgttttgaccatatccctttggattggtgtctccctgccaccacacacccttctctacatctttaaggaagaagcttccactgccatttctgagtgatccatctggcgttaggacctgtttgtcatgttcacacccatcttggccctgagcccataagccagctcccagccacgctgacatctcctcccttctgtgtctcctgctgtctaggaggctgagagccaccctcagtgtcggcggctgcagctgagagacctcatcatctctgagatgcagcggctcaccaagtacccgctgctgctggagagcatcatcaagcacacagagggtagcacctgggraggggctggcatcacagkcagtgggcctcgtgccagaccctcattctgacactgctttgtgaccttagcaagtcactgtgccttgtggtctttggtgtcttcgtcctttttctgttgtggggtgtttcagagaagaaaatgattgtaaatgtcctttggaaaatataaggtgtttaatagtgggaggagtaggggccaccatcgaaggccacctgtgtgggcctttgtgcaaatccaaggaaagcatccggtgcccaacacaggctggcactcaagggcacctgggtccctctggttgcatggggctggattttatccccattcatgccccctgcagtgcacaaaagacacagcctatgtggttacactagaggggcaggggaccagactgaacaagagggtctagcctcaggttatcactctccctgggatcctgggcatctttcactacccccaaatttcagacattggagtcaggacagagaggtgttaggaaccccaatctgatttgaacaggctttctagaggcataattgtggccatttaccacagtctctgtcccttgcatctgtagagctggttgtagtagaggcagggattcccaggagctatcagcgtcttcaaagcagtgatctgtctgagacctgaagatgctcagtaaaagttacccttaccacttggggtcctcatgtgaggcaagggtggctcccctccacccacgcctgctggtttgaagcaagccagctgccatggatgaataggcagataacagctggcgccatgttrgacttctcaggcaggagccccaaccatctcttctgtccattttggtaggtggcacctctgagcatgagaagctgtgccgggcccgggaccagtgccgggagattctcaagtatgtgaatgaagcggtraaacaaacagagaaccgccaccgtttagagggctaccagaaacgcctggatgccaccgccctggagagggccagcaaccccctggcagcagagttcaaggtaggaggcagaggctgcagcagtcaacccctcacactttgtgggtacccttaggagcagaacactggtcagggcttggagagtcttagaggtaggagacagagaccagatagggtggcacaatggagccccagaagacacacaccctgctattgtcaccctgtccctagatggacaaggcaggccgccccacctaagaaagactagatgttggaactcagcctgagagagcaggggatggggtagaactggaggtaaggtggagatcttctgggagggaatagagctggaggcatgggcaggaaaagcagtatgtgatcttcttgggactgtagctggcacgtggtaggggcaggtgggagacccaagtcagarccattggtatatccccctgctgccacatggcacatgacttcacagttacctttttgcttgtcttcatcccgcacaagagagtaagggcaaggacttyttcttatttaccaattcccagcaccttaacacaatgtctggcacacagtaggctctcaaacacttgaatgaatgaatgaatgaatgaatgaatggtgtctccttaacagagcctggatcttacaaccagaaaaatgatccatgagggacccctgacctggaggatcagcaaggataagaccttgggtatgtgccaggggactgggactgagcaggaacctgtagtgggtgggcctccctgggctcttctgtctttcccaagcatkgaaacatgactggaggtgatagctcaggacatgggaagggaataatcagagagagaaatggggtcaccagactcccaggacttcctagagcctccaagagcctgtggccctgcattgtgctcatgagggatgagtaggcaccagggaacaccttcccatgaccatacccctccagacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacaggtacctggggagatggtccaggctggcctggggctcagggaccatgtccagcaagtgctgggtgaggcagggccagtctggagcctttacaggacctacctgtccacctgtgttcctttcctcctgtcctgacccagcctaagtggtaggactggcccaaagtggggtaggatgagggttaggatggggaccaagaggaagacagacaacctggcacaggggtggtcagcagtccccaagcacagtgctggatgggatgtgcacacccaggatgggtgagagtgtctgagcaggattgggaagaatgggattaggcagaatgagtaggacaagcctttctgctacagagtgacttgggcagagcttggttacagaagatgttagtacccacggtacagagctgggtccagtggacagggacatttcaatgagaagtgtagtgtgtgtgagaaagggctctggagcaaaattctctggattcactttcttcgtctgtaagataggagtgatacctaccctacctcttgtgggcatcaaaagggatgacgggtatgaaaaagttttataaacccttgaccaggcactgtggctcatgcctgtaatcccagccctttgggaggccgaggcactcagatcacttgaggtcaggagttcaagaccagcctggccaacatggtgaaaccctatctctactaaaaatacaaaaattagccaggcatgttggcaggcacctgtaattccagttactcgggaggctgaggcaggagaatcacttgaacccgggaggcgcaggttgcagtgagccaagatggcaccactacattctagcctgggtgacagagcaagaatccgtttcaaaaaaaaaaaaagttttataactcctaagcaccatacacctatcagccatcactgttattagagcaggagaggaatgggggtggctgtggaagatgacattaggggtcctggaatttcctctgtcccttatgtaagtgggttccaagtggtcctgaagatccacatctgtctcgtgctgcactctccatctgcgttgagggtcagggctttgagtcccactctgtcaccctggcccaggctgcagtcacacctgccatccctagtacagacccttctaccttcctttcctcacacagataaacgggccttcttcatcatctgcacctccaagctgggcccaccccagatctatgagctggttgcattgacgtcatcagacaagaacacgtgagaattgattgaggggttacccgtaactgtggtccctttcggaccagggtggtgtttatgaggacagtgggtagcaaggccaggtttgggccccaaagcagtccctggacaaggggttgggaaggaagtgggaggtaggacagaagtagagaagctgggaggggtcatcacccccgacctggtcaccaggcccgcttctgggagaatgagcttctggcagtcttccagccgctgctgctgcttctttccttcctgccctactcccttcaccattaggcagattagattcatgcatccttctcaggcatttgcctcccacccagcccatgttctttgacagcagctgccagaggtggcatggtacagtggaaggagacaggttgagtcagactgtttcccaactccagggttttcatctgtaaaatgtggctaatgctacctgttagaggattactttagagggaaaacatagaatgctttgcacagagtgtaacagagggttggtgtccaggatttggtagctgcaagtaatataaccgcaagggagcagccagggaggactgtacagggaggtgggcacctgccaggcagagggttcttagggcctggaagccctgttccagtgggctcagtacggggtggtgygtgctgctatcttgctctcactacagtcctctctgttcctgccgagcaacagatggatggagctcttagaagaggccgtgcggaatgccaccaggcaccccggagctgccccaatrcccgtccatcctccacccccaggtccccgggagccagcccagcagggccccacacccagcaggtgcagtgcttagccctccagaccctgcactctctccactccaaacctcctgtttcctgctgcttttaagcccttcgcccccgtgggtagacagccacaacagggaaatgctagcagggagcagacagctccaagtgctggcagatggaggaacatgccccctgtccctgcttcttgtccctgtctgctcccccacagcctgccacctggctataatagagctgagcctgaagaagggtgagggggatgtagagcaagggaccagagaagctcagcyagcagcccccctcctctctgggttgccaagcagaccagccaggtgaagaggcccacaccgtccttctcggatcctactccattgcccattctaatgcatgagtccagggtggaatctcatgggatctcatcctgtgttggtttccttcctcagggtagaactggatgactcagacgtgttccatggtgaacctgaacctgaggagctgcctggaggtaagggccctgaactgtcctgtgggagccagcccaggcctttttctgtaggcacaggttgggtgtgagtatgggggcgatgggagagtccatcagggcccggggtgtgaggttttgataaagagtagagaagaaacagggcgggaggaagagtctggaagaggaaggagagcagactgaacagacttaagaaagggtgaactcgctcacctgaccagaaattcccacccagcctctctgggtgacggcatcagcygtggaagaagacgagcagtctggcgggatccacgggccctgcatcctccagccaggggttactgttggggagggagatacatgctgcaacaatgagaatggaaaacatggcggggctggggagctcaaagggcttaagatgcagttactgtgatgggattggtagaggggacagcattctcattgagagcttgcgtgagaaataacctggggtcttgggtttcaggagaaatctcgggtttcctggctgggtccctgttgtttccttctgcttagaatgcttttcctcctaacgccacacctccttcacgtcttcattccagtgtcctcttggcccaatctgtttaatactgtagccagcactgtccagcccctagccccatgccctgttgttgttttcttctttccggtggaagttactgccttctaacaaactacataattgactgaagtgtcttatttttgtatgtccctcccctagaatgtaagctcaacataggcagggatctttttgttttgcttactgttgtatgccaagagcctgggacagtgctggccatgggaagttctcagtaaacaactgtagaataagtcagtgttcccagccccttggctccaaagctgcccataggctctcccatacgtgccctctccctttccytgccttacaatcttctctcatccgaaacaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatggtgagtgcttcaaggccctgccgtcagcccctggtccccagtcgcacacccagtgtgaactggcaggcgcctgcaccctccaccttcccgaaggctcttcctggtgtgcttgaggagagatggatgcggagacagatgtcattccccacccaacccccaccagctagttggccagagccctccagcttcacctgtgcctgaggtcaccaccttggggtcagtggggcagtacaacgatccttctggcgtggtgtgcagtcccatgctgggaagacatcaccctgtttcccctccagtggagaayctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaaggtaaaataaatgggagtgtccagtggggagacaagcwcccttgctaggtgagataagtcttccgaacagctgcttccttccctatactccccctgggtaccgtgtgagcagagacctacgctgggtcctggaagaaggagacaacgccgatatcaggcaggctttggagttggacattcgagattcagagcttagctctgccacttaatatctgtgtggctttagacaaaattctgaatcatctctgaactttgttttatagcacataaggacatttctttctgcctggcacaaaccaactaccagtaccagtctctgttagtgctcctcactgatctcctgttcccagggaaragagccactcttctcaggagcctcaggccgggaaagacagggcaggtgcatgcagcccctcacgccaggcaacagctccaagggcagtagaggtggcagctgggactggaaggggtggaggacaaagctgggaagacatttggcgagtgagggatgtggggagtgaacaaggtggcagggagggcaccccgggttgggaaacaccatggacggccttgagacaagaaaagccaagacaagctcacagggaggccaatagatgagcccagggaggaaggtccccaccccgggaagagtgggctggtctgagagggtggcaagaaaagtagaacaaagcctggggcacacatgggatggggttccacgctagtgggcctgccctcccctgggattccaytctgcctcccttccagcagcatttttcattccatctgcccaagggccacctgtctcctgggtttctgggaactgaccttccttctctgtctctcggtgaattggtggaaagttctctgcactgcctgggatgtcatcgtgtatgatcttgtgttcaccttgttcttcccattttctcctccccctgtccccacctcctgccctctctccttcctgttctctctcccttccctttccttgtgttttggtctctcctcttcctggtggtggtggtgtcggtgcagctgaggtggcaggcagcaaggttgtccctgcactaccagagagtggccagtcagagcctgggccacctgaagtggaaggcggaacaaaggctacgggtaataactttctccttggagctaaagacaggccaagactggagtgtggaacctgtgagggcagagtcggacccctgcccatggtcacacacacacccacaagctccctcagctgcctggaatggggaggaggaagatctggctctaaagacggggagatctggttctaaaggctggctgtccatccagccttaagaagccacctgtccaggctcctgttcagaatggcagggataaatgcctgtgtgcaattgtgggaggggcagggaagcctggcctgggggtggggacctagtgtccttcacctgatatgcaagcagccacttccccacctcagccgccgctccagtgtcactgtggaaatcggctgaaagagcctcccagattccgcggtggttctctgtgcttcctgcctgtcaggaaccctccacgtccttcctccagctctctctgacaccccttggttgggtcaagggacctccagaggatcgtggcatggatggaagaggggcagggcagggctgtagttcatccagagctggagtcaggcagggcaagagggctgctgcctgctcctttcagaagagcctgaaaccagctcacaatctgtttactcaaggagggggagccactccaatttccccaaatgaaacactgcakctctgccacttctcccttgagttcatcgctcagcatctcccccagcttggggccagactgagcaagtgtcatctagaaggtctcgggagcagggcttttagggggctggcagacagtgagcaaggcccacgttctctgagtttgtctggagaggactgcctggcctgctctgtcaggtggctggggaatcccacaggaacgggaggatagcttcgacttctctgtttgcctcctgatctcattctcttactgtggggacagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccargcctggccctcagggacgtgggcatgatcttccrtaccattgagcagctcactctcaagctcaacaggctcaaggtgagggaarcagggcttgggtccctgcaggccttcagtccatcaccccaaaaccattccccatgagtgagatgtgtgtcttcgcgggasscctagatcctgtcctggcccagggatcttcccccagcccrcccagccacccttaaatcacaccctcctycccaaggcccagcacagaccccttccccaggggccttaggaatagaaggactcgagcagacattcccccgccgactcttccaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggtgagtgaagccaggtccctctcggttcctaccaytgggggagaagtctgccaactcrtgaggacacatcactaagcagtgagagatggtggttctgagagtggtttccccttgagtgaaacgagttcattctctcagcttcagagagggatcttttyagggaagtcccacagaagctccctggcaaaatggggagcttagcactgagccctctttttccttgtgctatggaggtaacaaaccaggaggagcctgttctcacctctaagacttgttctttttttaattttatatatatatatatatatatatatattttttttttttttttttttctatttatttgagacaagggctggcctggctatgttgcccaggctggtctcaaactcctgggccgaagtgatccacccacctcagcctccaaagcagctgggattgcaggtgcacaccatggtgtcggcctaagactcgtgctgattaaatgattcagaaccacactgggtgggccagggacacagctatgtcataactcaggaagacaaggcacatacctacctgacctaagggctttaggcgctgatgaaagtggagttcagtagacagcccttttcaagccctacgagaaactggggtttctggaggagaaggaaggtgatgaaggatctgttctcgtgagcctgaactttctagacaaaacatgtggaagcggtcacctcaggctggccagttcctcaccttcatcctcctcccacaggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctccctyagcccaaccctccaaggcctcatgtctcctaagcatgctgactgcatcygaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctycctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagtyaaatatccttcagtggtggtgtgtgtgtttcttggaatcgctgtgataaaaggtacggtgtttgttccctgtaagactggttaggattggatagtgggaaccagagggagccctctcacccccagacccagatcttgcctgttccctcccagagcttcagctgtgcactcactgaactagggactgggcaaacttaagttgtacaacccccatggagaaaacatgacaagacactgaactcagttacacacacacagatatatatatagatacatatatatacacacatatatagatatacacacacacacacatatatatacacatatatgtgtatataaaggagcagtggacccagagtcaagaggtctcatgagctgccctcaatgagcttgaagactttaaaagccaaatctaagtgggagggttgcctcaggcctggccagttcatcactgtcatcatccatccacatcctcccacagacgcagccacatcaccaagactgtaaccattcacctctgtctcctggcattcagtgttggattaaagtgacaaattctgtctcttccagcccaaccctgactcctctacctctcacaatcctcagctgtgtcctcattagggtacagtctatttgggcatcagaattgatacaggagtcattagtgatgaagggtgggataaagatatgggctgaaagggtcactgaagctctggaggacatggcaagtttccctgcagaagctggggtgaccatcatccagcacctcaatgtgttcagtgttgggaattcaaagaaatgataggttttccctggtgaagctggctccacagccagctgcagagacagagctgggacagtcagactaggagggctccaggcactcagaggcaggagacaggcctaggtgccactgagccacacaaagtaagacagcaggacaagggaattctaggtaggcagaggcagtgggatgagggaagtaggactagagaatgtggaacaggttgaatctgcttagaagtgaggaagaaaggctggtctttgctgatctgcgccatcttggacactgctgtataggtttacaggtaggctccccgaagccagtcctgtgctctctgggcactggcaggtgacctcaatggaggcagcactgaagggtaaaggtttggggaccctgactcagctcaggaacctctggtttcagattgctgacttctgcaggcaggttattagggttcatgttcaatgcttagcctttgctatgtagatgttgagcgtttagcaccctctccaaagtggcctgccaagcctttgttcattttcttaagctgaacccttacctctcctccaaagcagtcaaacacctgggccagccagacggggaagcagaagggagcgggcatggagcctgtgcttaattcctctgcttcacctactcctgctcccactccctcccaagcttatgtgtgtcagttactaatccctatcccaaatccttctgaatgcaaaccctggcataatgcatgtcccctagggaacacggtgggggaatggctattgcctgagcaaggaagaactagcccccaggaggcagaacggcaatgcccctggctaactgaggccagaggagctgagatcatccccagcggaactgtaattcagaccacttttctgccattcctggcatgtaacatggacagacgcaaaatctaaatgttccaagtagttctggaagaaagttttcagacgacctcaaggaaaagtatagcaacagactttgttattggtctgagatctcccccagggaggtcaccccacacagggacaggaggtgcttctgtagccccgagtcttagaggcaagcaggtgggagggggctaggggaagaatgccatggcctcatcctccctgagtttggccttgatgggatcccttggcaacatcagctcctggattatggcgtacgcaggacattgtggggcgaagcaatttttctgaaaagaaaaggaaggctgacatctgacaagaggaatgaagattagtcctctggcagaaaaaaaaaaatggtcctggggcagggtgggttaggggctgggggacatgcagaaaaagcagagtgattaatactgctgattttccagcaagaggaatggaggttatgttgtgattattaaaaagaagcagagaaactacagaccttccttggaaatggggagacagaagctgcctgcagcagctgtctagtatgacagctgataggggcaacgtctgcttcagcaggagagagtgaaagggactcacagccagggacagccacagcagccccactggacccttggatgcactcttggccttggagaactgcatctgatactgcaccgtggcgaggaagccctccagccccacctctgtgatgcggttccctggtggaagttacagacaggtggcctcttagcaccacaggcctcattggcacctgacacaccagacatccccagcatcccagttcctccagctccccactccagactcactggcccaggcacacctttccctgacctagcccttcactcagctcttactcacacactccccatctctctaactcctctcattactccaatcgcctgtcctcagcctcctcccagactcagcacttcctctggcccctccagccctgtgccagagagccttgggggacatgtagcccaaagatgggaggaccagctctgctccatagagtcggggtaaacaccctcaggcaggacagggcccgggtagcctcatgacaggaggacaggggaggttggcagacatacggatgaggttgaggtgcaaaaggaccttgttcccaggcatgaaaactttcccatctcggtgctccacaggctccaggagagggttgaccacctcagtagcctcaacaaccagctgctaaagcagaatactaattgcagcagacagcaggggagctggtcaacaggccattcattcattcattcattcaacatacatgttttgactgccggctatagtccaggctttgtcccaagtgctggggatacaaaaataaataagcccataccctcaagaagctcctttgtgtggaggagccagaaagtgaaagtaacgtggtctggagtgagcgctgacagaggcaagctcagagcactgtgggagcacggaaaaggccaggccaggaagggcctcctgtgaacgcacatgatattgtcagatgaagacgggaaaggtgttctaggcaaagaaagcaggtgcaaaggctctggaagcgtgaaacagtatgtcgcattcagattttactaagtgtttcccaacacctagagcaatgaggagaatggattggagggaagtaacaatgacggcatgatgaaaagaaattgcagtagtcctagtacaatcagcagcctgatcaagacagaggcagagatgaaaaatggaaactgaaaggcaaccccaatctcttcctccctctgaacgtcctcttttgtaagattttgtcttgagtgccagagaagactcctgaaaggagaggggcccttccctgcctagggtgtgcagggagtcttccaatggaagagaaaaataaagagaggcggatgctcaggcagctgacagaacggagggatgagggaccataagagcactgaaggcagcccaggaagatttccaatgcaagcagcaagttggtccaggttgtaagggggcagagaagatccaggggcaaaagagagagggtctgaagaaggacccatgcacagggtagcgtggggcagtgccatgaccataaaaatgccctgccttcctcagggagctgctgagaggggcaaaaaagaagacgcattgttcctatgcaacagtccaagcaagtgatggaggtggtgatgaggaactgagggcctctgtgcctctgggcctctggggaagtagcctggctgagttgagacagcagatccaaagtgtgggctactaatagacaaggaaaaatagaaggggtctgctcttgttattcccacagaagcccaaggtgagatgggagggggtttcaggtgaggttgggacaggagtggaggacaaatttgaaggcaaatggctgctgccacagcatggggctggagaccacattccaggaggggctggggtgagacgtctcaggcaagcctggaatcccaggggtgtgccccctgcctccactcctcctggcaacttacctcggactccaggaggatgctgcgcttctctctgctcccgatcttgatcccttttgccctgcttggcttctgttcagggatggttacctctggggccagaagaggagccagaatgcacagtgcacacttctgataccacccaggctccctccccagagaaaacaggctgtgaggcaaagagaccccccaactttgggtttgggtgcaatagaaatggctggagggggctgggcgctgtagctcacacctgtaatcccagcactttgggaggccgaagcaggaggatctcctgaggtcaggagttcgcaaccagcctggccaacatggtgaagccccatctctactaaaaatacaaaaattagctgggcgtggtggcacgcacctgtaatcccagctactgggtaagctggggcaggagaactgcttgaacccaggagacagaggttgcagtgagccaagattgcacctctgcactccagcctgggcaacagagtgagaatccatcaaaaaaaaaaaaaagagagagaaagaaagaaagaaaagaaagaaagaaagaaaaagaaagaaagaaagagaaagaaagaaaaagaaaagaaaagaaaaaagaaatggctggagggggccccagctaggtgtatgggttctttgaagacagggccacagagctccagctccaacaaagggaatgaggacagcagtgggtcaggatgtctgggctggatgcggctctccacatcatcccactgtgagaaggaaatcaagcccagaggggcatggcgagatgagctccaggcaggcgcacccaggcccagaacagcttcctgcacccggcccggcactcttccctcctccacacaggaagatgccacccaggggcacccgcacttactccccttgcctgcctttgtggcatcttccttcttaggggttccttgtgtgggtgactgcccagaccccaacttctcctctttcttggccaattcctgtggagaatgtgagaagagaggggcaagtcccacctccggaggggatgggcagtggtgagggaaggagcccaggttaggacccggggccttagggggaacttcaaaggcccatgtggccttcttccctccaccacctctgtacatgatggaagccccctcccctgtccgtccagcacccaggatctgtcccattgcacacctacccatgatttctcctttttcttgcccaggcccttaggggttttcattgtctgcgtcttgtctgtcttgtccaccaatgcactattgctgatccctaccatctgactcttctcacggtccgttttggagtccccgtgtcgagaggaggagggctgtgctcacaaatgggagggaaggggggaagaagccagagccccttcctcaatgggggcatgaaaggtagctatacccatacttggggagcagtcgagctgacagcaccctcccacccacctccctgcctaaatgctaaaataatttgtataggactcctctggggtgagatgctttcgggaagaaatagcagagggacctgggtggggtgagatgaagggtgaggcagggtctcagacttatattgagggggaaaaaataacagcttttattgagctaagtgccaggtgctattttaactgcattgcaggaattgagtctttaaatcctctcgacagtcatgaaataggtacaactatccccacttacagatgaggaaactaaggcaaggagaagttaagtaacacaggccaggtgcagtggctcacgcctgtaatcccaatactttaggaggccgaggtgggcggatcatttgagaccaggagttcgagaccagcctggtcaacatagcgaaaccccatcttactaa

SEQ ID NO: 12583 - DNA, 21752 bp, Homo sapiens
cccaaccccctctcacctccccactcctaccacacacacacaccccacacacactacacacaccacactcacacaccacacccaccacacacacactacacacactcacacaccacacacaccacactcacacccacacctaccacacaccacacccaccacacatgccacactcacaccacacccacaccacataccacacaccacacacacaccacatgcaacacacaacacacacataccacacgtgcgccacacatacatgccatatacaccacaaacataaccccccacacacaccacacatgccacaatgacacataccacacacacactagagaggctctgctcctgctggagaagacttgaagtctcctcaaaggaacagatgctccattcaggagcacaggtcaaaggctgtgccttcccttctctccccaaggtgaaaggccctgcttgtcatcttaggaagcagaaaccagcactgtgcctggcagagggtgatgagtggtgattttgctcctgccactggtgctgccctggggatggggtagaggtgggcacagctatgaggcaggctggggtgaggaccccagaaacccctcacatcacacatcccattttccaggcccttttttcttccctagttttgtacctgagggtgatgtttctctagaagagatgcagccctcagtcatgataaatcctgaaattttttttttttttttttttttttgagacggggtctctcaatctgttgcccaggctggagggcaatggcttcatcacggctgactgcagcctcaacctccctgggctcaggtgatcctcccacctcttcctcctgaataccttggaccacaggcatgtgtcaccatgcttggctaattttcttattttttgtagagatgggttttcagcatgttgctcaggctggcctcaaattcctaggttcaagtgatcctcttgcctgggccacccaaagtgctaggattacaggtaccagtcactgggcccacccctgaaggtctttgatgggggtgaagactcaggcacttcaagaagcagacctcaggccaggcgcagtggctcatgcctataatcccagcatttagggaggccaaggtgggcagatcacctgaggtcaggagttcaagaccagcctggacaacatggagaaatctcatctctattaaaaatataaaaatcagctgggcatggtggcaggtgcctgtaatcccagctactcaaaagctgacacaggaaatttcctgaacccaggaagcagaggttgcagtgagctgagatcacaccaatgcactacagccttggcaacagagcgagactctgcctcaaaaaaaaaaaagcagacctgtagggaacaggaggatcaaccaactgagataccacaagaagataggttctggctgggcacagtggctcacacctataattctagcactttggtaggccaaagcaggaggattgcttgagcccaggaattcaagaccagccgggacaacagagtgagatccctgtctctacaaaaaatttaaaaattggctgggcatggtgacacatgcctctgcctgtggtcccggctactcgagaggctaaggcaggaggatcacttaggcccaggaagttgagaccgaagtgagctgtgattgtgactctgcactccagcctgggtgaccgagtgagaccctgtctcaaaaataaataaataaataaaggaaaagaaaaaaggttatctgctcagacatgtaagctggccttgtggccaaggcagagagactctcatggcctatctcagaacagccacctaatgaccatcaaaaccttgacacactggcggggtgcaatggctcatgcctgtaatcccagcattttgggaagctgaaggaagaagactgtttgaggctagagttcaagacttggccaacatagggagactccatctctacaaaaagtttttaaaattagttgagcatggtagtgtgtgcctgtggtcccacctactcaggaggctggggcaggaggatcccttgagcccaggaggtggaggctgcagtgagccatgatggcacactctagcctgggtgacagagtgagtgagactttgtctaaaaaaaaaaaaaaaaacccaaaaacaaacaaaaaacaaccttgacacattcctctacaccccagtgtcccccttttctgttgtttaattttttaaaaactgtctctggcggtcaggcgcagtggctcacacctgtaatccgagcaccttgggaggctgaggcaggcagatcacctgaggtcaggagttcgagaccagcctggcccattaatgtagtgaagccctgtctctactaaaaatacaaaaaattagccaggcgtggtggcacacacctgtaatcccagctacatgggaggctgaggcaggaaaatcgcttgtgccagcaggtggaggttgcagtgagctgaggtggtgccactgcacttcatcctgggtgacagagcaagactctcaaaaaaaaaaaaaaaaattttatctggcctgcttaatgcttaagtgtttgaacatccccaccattttttttttttgtggcactcaagaggccatcccttccacctccatactagtcagtctgattttttccacatcccttctactcaagcatcaaagactgagaaaaatgagtcataaaagaacagatgttctagggtttcaacgtttattcctggcatgactaagaggacggaagagcctgctgacctcatcctacagctatacagggactcccaggccttgccccaagacgtacccttatgttttctgactgtagtaggtgggggcagactctaccttcagaaggaactacaagatgtttctttgttttgagatggagtctggcactgtcgcctaggctcactgcaacctctgcctcctgggttcaagtgattctcctgcctcggctacccaagtatctggcattacaggtgccctccaccatgcccagctaatctttgtattttagtagagacgggatttcaccacgttggccaggctggtctcgaactcctgtcctcaggtgatccacccacctcagcctcccaaagtgctgggattacaggtgtgagccattgcacccggccaggaaatacaagatgttaatgaaagaatttgagaacatgagcgaggtggctcatggccataatcccagcgctttgggaggcctgggtgggcggatcacctgaggtcaggagtttgagaccagcctggccaacatggtgaaaccccgtctctactaaaaatacaaaaactagccaggcctggtggcgagcacctgtaatctcagctactcaggaggctgaggctagagaagcaggctgaggctcttgaagccaggaagcagaggttgcagtgagccgagatcacgccattgcactcgagcctgggcgacaagcacgcaggaagtcaggggacctagccaggatacactgccttttccatcaactggctgtgtgtccttaacctccctggtggagccacttaacctctttggtacttccgtaatgtgaatgaggaggatagatggatataaggccccttactgctctaagaatctatgggattggatttcagttcagcatccatttccaggtttgcgctcatctttccaatgagagacacctgggcaggtagagcaaagagcaattctctggctgctggtatagtagacctaaggcttgagcaagtgcctgatacaagaagaaaaggaattgcccctttttcttggcagccaggacagagacccagtgcccaacctgcttatacctccaaccctgcccatccatcgcctgacagacaggagtgcaggacaagttctcgcccctcattgccctccctacctttccagttctggcagttccttgcaggctctccccaccttgggtttcctcccagccccgtctctgagggcagcaccttcccacatcctgacgcaggtcagtgtagctgtgaaggaggcagaggagtgagtgtctgagacacgagtgatccaggtccttcaagctgcagagtacatccctcacacacatactcaagattcctccagatggttgtcctagagaaggtggcgatgtgatttcccaggttctccgtgaagtagtcaagtattcaaactcctctatgcccttcttcctcttaccccttcattccctctatttctcctgcctctctcattgccattctttcttacattattttgcttccttcctcagttctccaggatcttcacctatttgtttattttgagatagcgtatgacttgtcacccagactgcagtgcagtggaatgtcatggctctctgcagcctcgacctcctgggctcaaataatcctctcacctcagcctcctaagtagctgggaccacaggtgcatgccaccacactcagctttttttttttttttttttttttttttgagacaagttatcactctgttgcccaggctagagtgtggagtgtggtggtggagtgtggtggtgatctcagctcactgcagcctcgacctcccaggctcaagtgatccttccacttcagcctctccccgagtagctgagactacaagtgcacaccaccacacctgcctaatattctgtatttttagtagagacagggttttgccatgttgcccaggctggtctcgaactcctgggatcaagcaatctgcccgccttgccctcccaaagtgctggggttacaagcctgagccactatgctttgccgaagattcccgtcttcccactgaaccttcctctttccttctcctgggccattcctgagccctggctgaggggagagaagggaaggaaagcccctcctgcggccatctcagcatccaaggcaatccttctggggctgctctgtctccagggccccagccatccccagacactgagtgcctgaggggggaccctcactcctgtggcactatggtaagataggaaacagtggcttctcctcaaagcagcctcgccggtcggtcagctgactaccaacatgggaagtggccgaagatccacatggaatgacactgataagcactttgcagtgtctgaaactcttaaacatcagtgctgtcttcctagttttacagacacaactctgtgggttggatgaggtttttctaaatgtacaaatgcagaaatatacggagggagtaaagggactgcctacaaatcacatctagagtgtggtgtacctgatttcaagtcttttattttattctcgcagcaacgggagaatccgcagtcgagggaggtgaaatgacttgctgaacgccacacggcggactccaagccccgagctcctataacagaggaggaggaaggcgggctcagctcctgccacccagcagcgggggagatgcagcccgggactaggctgggccatggggacagatccaggccccgccccctgaccttgttctctgcccgccgggaagtggggaacttgcggggagcagcctcagctagtccctggggcagagtctccacttgggtgcacgccctggggtggggcttcttcgggaagccgggggccttcaactctgctcaggagctcgggccggagaaaggccccgagacttgaagcccttgcccgggagggatgaacacgcaaaggaacccgaggaacggggtaggggaccaagagtaggaccagcttctcctgcgcggggacagggcctgtggagcggcctggaggaatctctcccagccgcgaagcccgggaaggctgcgaggccccagcgcggagcggcccctcccacctccccgagggcaggcggagcgaagcctcggggcccgggcccaggttttgtgcctacggaggctggacttccccgccaccccgaggagtcaccgagagccttctctccctcgcaggggccctgggaggcccgcgctttctctgaaagtggaaggagtgggcggggggcgcggccgaggcggggcgcgggcgtgcagcggcgcaggctccgccccggggccgtctccagccgggggcgccgagccgctccagtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcaggtacgggccgcgggggcggggccagcgccgggcgcgggggctgcacgggggacctggctgggtgctcccggaggacccgctcctgtccatgctccctccagcggaaggtcctgttctcgcggtttaggaggaatctgggggtcagagggaggcgcctggccgacctctcgcctgggcaactttcacctcggctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggcgaggggcgcccccggcctcgggcgtctggggcctgcccataagkccgggtcggcgcggcggggcggggagagctgtggccgcgcgcctgctccgccgcacaatcggctgggacaaggcagggaagctgtggcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaacccttgcctaggtcggggggcggatgccggggcttcccaggatgtggagtgtggggcagtgagaggccccccgccccgcctcttcggaaaagcctgagcagcagctccsggggcgcggaagctctgacacctgagagccggtgcaggcgaaagggcgcgaagcgcgggcgcgtcccgcttccctcttccgcccgcagggactcggcgaagtgcctgggagagggagtgcgctaggaggaggtcctgcggcccaagcctgggtgtagagaccgccccggctaaggtcaagcctcggggacctgggcgaccccgccgccctccgagccgtcgggagccggtgcaaatcgccgctgagggcccttccagctccaaggctgcggcttccaggccttccccacccccaggcccgccggggcctccccgaagtcaaacagccacagcggcggcagataagccaggggctgttgacagaggctgcctgagtccgtgtggaagggcccagggcggactttgcctcgccgcaggtcccagagccgcacagcgcgccggcccaggccaatttagggcttccccaggcaggaagcaaggctggtccggctgaccgtgaaggatgcacgtgggccggactctaggactcccggcttaccagccccttacgcgcggcccaggcaggccggagcccaggaagtttctgcctgcctgcctgcctacctctctgcctggggcatacgtagtccccttcacctcctaggagccctctccagcctgcccagagcagggaaattgaaactgggcagcctcactccggcagaggaaaaagtcacaggcaggcttttcctaaccagccaggggagaagttggaggcccacccgcaaggtcagctgcatgactctatggccttgcctgcctcctcaaacaattgtggggtattgctggaggaaaagagagggtgtttggctcctgttcatctggttttcttctttctgtgctccaggataggtaaggagacctggatgccatcccctcctggactcagaattcccacacatcgctttccactaattatagagcagaatttaggttaacagacttcctttttaaacagctaatgcccatgggaaggtgaagtcgtgggtcacttataccttagtgcaaatcgttttataaatttaaactgattgctcttcccaccaccacgaccacagggagtgctagtttgatagggcarttggaacatggggagggtattgggctggtagagagcttcaaccagagcctggatgactggaggcagggagcaagggtgagtgccaaagacagagcactcacccacctgctggtctgctccrgcagaagatacactgtgtatctggcatgagcaggtgtcttcaaggcttccgaatggagcttagacaaaggagggtctgaggctagtatccagccaagccctgcccagagagaggtactccctgttcagccctaggagtgaggaattatcagagggccctcctgtgacttcattaaagtctctcacacagtcagcaatcctagcctttgcctcaagatacccaggtagcctctggctgtgtgttagtctcccagagagggcaccttcatggagggaggcccgagccagaggatgttcaagcttctcccgggttcaagcgattctcctgcctcagcctcccgagtagctgggattacaggcacctaccaccacaccggctaagttttgtatttttaatagagatggggtttcaccatgttggccaggctgctctcgaactcctgacctcaagtgatgcatctgccttggcctcccaaagtgctgagattacaggtgtcagccaccgcgcctgggcttacattcayttttaaaagcgtgatgttctctgggggaggtatctccctaaggtggaaggtggcagtgatttgagttccatgacacttgcacaactcctgccatgcttggccatacccattactggcaggggggctaaatcctgtcatagcaacctcaggtggtaggacggaggactcagatgagataataggtatgaaaatcttttgtaggctgggagcagtggctcacacttgtaatcccagcactttgggagtccaaggcgggaggatcacttgaaccccggagttcgaggccagcctgggcaacatagcaaaatcctgtctctactaaaaatacaaaaaaaatgtcacggtggctcacacttgcaatcccagcactttaggaggccatggcaggtagatcacttgaggccaggagtttgagaccagcctggccaacatgatgaaaccccgtctctactaaaaatataaaaattagccaggcgttggtggtgcacgcctataatcccagctactcaggagactgaggcaggagaatcgctcaaacctggaagacagaggtagcagtgagccgagatcgcaccactcaaataaatatgtacatacatacatacaaaaatacaaaaaatcaaccaggcatggtgactcacatctgtagtcccagctactctggaggctgaggtgggaggatcacctgaaccctggaagtccaggatgcagttagctgtgatcgyaccactggactccagcctggacaatgggagtgagaccttgtctcaaaaaaaaaaaaaaaaaaaaagtattttgtaacctgctagctaggactggccttagttgctgctgctcttgattcttatgagatgcagaaaaccaaggtcaagagagtaggtgatgacaccattttacccctgcttgggagcaggtccatcaatcaaatggtagtagcccaggtttttagacacacatcaaatcctcttctgccaggcccacctgccagccctcctcactgtttctgcacagttctaaaaggatggttcagttccctcaccctgcctaacccaaggcaagtttcctcttcactaagtccattctggtcccactatcccctaaattcttctagcaggtccctacagccattaaactcattcttttggataaaggcaaaggtggccatccagtagagaagggcccccaggcaggtctcagtgttccccagaagtcaaaactcagactgccttattgctgcacatcacttcaccaygcacaaagcactttctcaggccacatcccatttaacccccaaagggaggcaggatggtagcatcctgctggggatactttggaacctgctggggcagttggaacttggggagggaggatgggctgatagcttcagccagagattgggaggctggaggcagggcatgaggggatgtaactccccttgatttccttctgtaaaatgggaatgataccacttcacgcacttgctatgcatgtgcattcattatggctctcaaactgagtgtgggagaagggggtacaggatggtgctgctgaatatacatggcacatacatcatcttcctggaattttacttgagggtttggaggtggtgagttttataataaaacttggatttattatgcagcagaatgcaaacctggtgtgtatttaaagattttaaaaggagttttgaaagtgatgtcatgcttctagtgggctgcttctggctacacccccagatccctggggattgggcacgtgatcacaccctagtgtgccatgtaagggcttcagtaggaaagtgggagcaatgctgcctgatggaagatgagaaagtgcctgacatgcaataggcaggtagcatttgatggttcgtgttacggcagcagctatgtcctcccaggggaaacaggcccacacagatggcagtacttggttgggttcactcagctggaaggtgacacagccatgactggaaccaactactgacttcccacccagtgctctaccataacttccatctcctccccatgggaaagggctttatggtcagcagccctcttctacttaggccacctcctcagttctctctctccctcttagaactccctcttgtcagggaggtgtattcctctgggggtacaacatgtgtaactgtgctaaaaggcaagtgcctctgtggggaggcggcagacacagttgacatgagccaacctgtgtacttcagagaggacacagggctgccragttgcgggtggtaagaggagaggtccagaggatgggatgctctcaagattagctggaggctagaagagataaggggcacaccaaaaaaacaaaaacaaaaaacaaaaaacaaaaaacaaccctcgtctccttcccaggtttgtctaagttgacaggccctcaggtttgcaccttattttctttctttttcttttttttgagacggagtctcactctgctgccaggctagagtgcagtggctcgatcacagctcactgcaacctccacctcccagattcaagcgattctcctgcctcagcctcccaagtagctgggaccacaggygcatgccaccatgtccggctaatttttgtatttttagtagagacggggtttcaccatgttggctaggatggtcttgatctcttgaccttgtgatccgcccacctcagtctcccaaagtgctgggattacaggcatgagccacctcgcccagcccggcatcttattttcatggcttaagatttctaggtccagataaaaaccaagggtgccctgggccttgccagctaatgagtgcatagaatccagggatagcaagrgaggcttggagagccttttctttctccagccctgttctttctccaggccctgccaggctggccttcctgccctgggcctgtgtacaggtttgtttctgtgtatgtctgtctccctaaatgagaggaaccaaggtcctgagtgaaggaatcagtgattgagatttgttcagcttctgcctcataccatggaatgggatgggggagctgggcgcctatcatgcttaagccttatgtactactcacagcaacccagtaaggatagttatttcctcattttatagatctttttcttacagatgcacagaggcttgtttcttgggccctggaatcttttgaggcattggtagtaataaaaatttggggggccgggcctggtggctcacacctgtaatcccagcagtttgggaggctgaggtgggtggaacacctgagatcaggagttggagaccagcctgaccaatatggtgaaaccctgtctctactaaaaatacaaaaaattagccgggcatagtggtgtgcacctgtagtctcagctactcgggaggctgaaacaagagaaccgcctgaacccgggaggtagaggttgcagtgaggccagatcgcgccactgcactccagcctgggtgacagagcaagactccatctgaaaaaaaaaaaaaaaaaaaaaaaaatggccctactctagaccaacttagaacatccctgcggtaggcctgataatctgcaatttttaacaagggtgaccatcaggtaattccgatgttcacaacagttcaaaaacctcgacagagcattttcgtaacctgcccacgcgttcttcagtggcagagctggagcgcaaaccgggggcttcagatgctaagtccaggctcttgacagctcactggagacgctggaatcaccttcactgcgcctgtatcagcacccgccacwcaggcgcacaaataaaccttcccagagtgaatgaatgaattaatgactcatccagccccagctgcttccggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttyccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaagatgcagcttcctgtgcctcaggcctcagcccctccctcctccggccccctcttcctcagttccggtccctggcatccacagatcgctggaggatgagaagagctttttattagaagcatctgcagggtggggggtctgcccagatgaaggatgctcataatgggagagcaatccagtgctccccatggacacctggggtgtgtgtaaggcggcctctggccccaagatcaaaagctggaagtggctgggcccttccctgggaggcctgggctggtttccagcatggcaagtgcagcgctgccaggccagccccgagacaggcccagacacacagcacagactgcagggaacagaggccgctggcataacaggccacccaggagcctgaggagtatagggagggaccctcagtgcctcagtccttaccctcagggccccttggggctcaggagcgataagtgggattccaaaggttctgaggttggaggcccctggatttgaggggcttgaggccagaggacagccaggggccaagagggctacctccccagcttttcaacttctctggactcagttcctggggctgtgggggtcttaggcactccaaagatctgttccccagcccagaagtcccttcctcctctggggtgggccccagctccattggcaggagtgaattcagcacatccgggtcctgtaatggaagagtcagggagcaggggggcatagagttttctggccctccctcctgacccacaagaccaggatgttagattaggtcgggggcacacctgagtgcagtactgcagacgctccaagatgctggcaaagctagggcggagctcaggctcgtgctgccaacactgggtcatgatgcggtacctggggagaggcaggagttcatgcccacccatggttgtgaaggacctcccttcccgggcagcactcaactcacacaggccctgggcagcccctaggagggtccatccggcctcctccaacgacgaagtccagcacctcctggttggtgcgcccaggatagggcatgtagcccagtgagaagatctcccagagcagcaccccaaaagacctgcatcacaagtgggggaaccaagtgaggcccgtcaggtgtagcctcccctcacatgaggtggctggaaaggacaggattagcctcaggggaggggaacagtggggaaggggaggggaagggtgttatcaccaggaatctgtcttggatgtgaagatgccctccaggaaggcctctgggggcatccacttgactgggagcaaggcccggtcccccctgcggtaataactggccctacaggagggaggaggtgaatgatgagttgttcaccaccaaggtgcggggaaaacccccttggagcaagagccttcccacctcccaagtcccgcaccggtagatatctcgtgccatcccaaagtccccaatcttggccactcggctgggtccagcgcagctcagcaggcagttccgggcggcaatatccctacagagtaggcaaaaaaaatcactgccagaatctagaagttcttgctcttcctgatctatttccttaaaagctgtgtggaagggctgttccttggggagggagttgggatgggggtcccctgagccaggactgctcctaacctgtggatgaagtgattttcctccaggtagtggcagccctgggctatgtcctgggccagttgcagcaggtcccgcatgaccagaggtgatggctggccctgggtcaggcagagggggcatcagtccatgtaggtctcagacacatggacagggtctttagaggggcctggggggggctaagacaagggtctcaccaggtgtggccgactgtgcctcaggaaactcttcatgtcccctccagacatcagttccagcagaatgaggcgaggggtggccctgaggctgagccccacacaccgcacaatgttctgatggcgaaacttgctgagtggggtgggggacatatcccgttaccaggagggagacggaaaccatgttttaggctccacaaagctggagaggccctctgtgtcccctgacttgctacctcagcctcagggtgaagagaaactgttcccgggcattcccctcccgccttccagccctgcccctggtcccaggtgcacctgatgatgagggcctccatgaggaaatccagctcatcctgaggcgagcagagttctggcagggtctggggaggaaaagggcacagtttctgagctgccctgcacgcttcaggagagggggttaaccctagctctagtcattgtccttcccttcagggtgttccgctctcctacccccagccagaagtcccactcctctcaccttgatagctacctgcaggggactggagtccccaggaaggccaattaccagtccctcatacacctccccaaaggcaccatggcccagggctctgcaggaagacacgttggaagggagtgggcaggcggcctggagaagagtcctagagagtctagtaccccctttacctcccctgcccctgccatatgcccagctgaccctatatagactctctccataccatggcatgtccccaggtagaagccctgcaagggtggtgctcactggcatagagccagggcaaaaaagagggcagatgcgggccagagtcaaggtgggagtgcatgatgaggacttccctggtccctgcagacgccctgggcgggaggcaatccctgggctccaagagtcatgattttttttcttttttaaacgaagtctcactctgtcatgcaggctggagtgcaatagcgcgatctcggctcactgcaacctctgcctctcgggttcaagtgattctcctgcctcagtctcccgagtagctgggactacaggcaagcgccacaacgcccagctattttttgtgtttttagtagacacagggtttcaccatgttggccaggctggtctcgaacccctgacctcaggtgatccacctgccttggcctcccaaagtgctgagattacaggcgccagatcatattctttttttattgagacagagtctcactctgtcgccctggctggagtgcaatggcgcaatctcggctcaccacaacctccgcctcccaggttcaagtgattcttctgcctcagcctcccacgtagctgggattacaggcatgcgccaccatgcccagctaattttgtatttttagtagagatggggtttctccatgttggtcaggctggtctcgaactcccgacctcaggtgacctgcctgcctcgacctcccaaagttctgggattacaggtgtgagccaccacgcccagctgagagatcatattctaagaactgggacggagaggtgacattgagcaagttacttccccttctggagcttctcagggcctccctctcccttacacaagggatgtgggccagattttttctgggacttataattcactacagcagggagagaatcagaggtggggattcagagtgcataggttctcagaaggaggcagaagacttacctgagcagagtaacattggctggggaaacctcggtgacacctggtggcagaggccaggactgggccgggccaagccccacctggcaataatagggattgggggctgtcctgatggcagaggttcgaagcttgctcagctcaagctcagggctcggcagcctcatctcctgcaggccctgccacttcttctgcttcactgggggtgggaagaataacggcacaccctccacctgcccatcaactctccctcccccacctgcccaggacacccctccagatgctcattaaggtaaacgttttccccaggcctccccagctccttcctatcttagaatcccagaggagtctaccacggctctgctgcggtgagtggtcttgaagtcagccccgggaccccgcagaaacccatcccagctcactggagaggagcagccttgaatcaactgtgcctgctagacgcttcgtacccagaatcaggaccccacacaccataaggaggctcagtgttgaggttgccaccacagccaccatcagaaccagagggcctgggggcttgtgcaggtctagggagaaagagagacacctccagtgggaaggtcttctctgttcctttaccctcaagttttacccacgcttcaagactcagctcaagtgttaatttttccatgatgccttcccccattatcctgggcaaaagcaacctctccctcttgaacacccctaaagcactttatacctcccacaacaatcgtcacttgagatatacatttacatagctatatctaaacatcctcccacactggacgacaggcctctgaaaggcactgtgcaccgatgaatctccaatcccctgcccagcacccaccacagggcctggcacacagcaaatctctataccatctttcccagtggcctactgctcctcccagtctgtgaccccaggagtccagaccttgggcaaaggtaggacatacccatgcaggtgacgttatccacagctagctccatgccttctgggcacaggcattcagccagctggagctctgcctgccattggcagtctctcaaagggcagtgactgcagttgaggtgccttcggatctctacctctccgtggttctcggtgactgtgagtaaaagaactgatatgatatggtgtggtagggctgggatatagtaaatacatgcctttggctgggtacagtggcacacgcctataatcattgcactttgggaggccgtggtgagcggatcaccggaggtcagaagttcaagaccagcctggccaaccccgcctctactaaaaatacaaaattagccgggtgtggtggcgcacgcctgcaatcccagctactccagcgactgaggctgcagaatcacttgaacccgggaggcggaggttgcagtgacccaagatcgcaccactgcactccagcctgggtgacagagcgagactctgtctcaaaaataaaaataaataaataaataaataaataaataaataaataaatacatgccttttccagccacatggttaattctagcccaggactttagagcaaagagcagcaccaagcttacaagggtggtgagagaagctgggggacttctgtcaagcctgcacactcccaggtatttgaagcgaattcatagcaagggggtacttgaaaagcacgcagcatgccctgcattgccatccagcacgactggcagcccactttccttttttttaagacagagttttgctcttgtcgcccaggctggagtgcaatggcatgatgacagcccatttttcaaatgaccctatgctatgcaagaatcctgtgctatgcaaggttattcacagtgcaggtggctcttcagtgcagtgcaggagtgggctcagggactgcggaagaagtccaggccaggctcagaggtggggttggggccaatacctgccagaggctgcaggaagagctcgctgctggggtgtatgaaggatactccatcttccccatcagcccagaggttgtcagtctctgaagcgtcgccccctggaagtggagagtgatggagagtttgactacaaaaatgggggatgggggagaagctggaatctcccggtggaaatcccagtgtggccctctcttctccagcatcatgatgcaaatgctgtctgttcacaagtgggagtgaaggaggtgaggagggggtaatcagctggagcctgaaggcctcgctgaggctggctgggatgcctcctgcctgcctgagcccctcctgtcccatgtcctcacagtccctttctgtgagaatgtagatcatgtgtgtatgtatgagcagtacagcccagacaggcacaaaggcatttacactagttatttgatcaaaacacagatgactgggactctcccttacagtttctgattcagtatgttagagaagggctgagaattcgcatttctttttaaaaat

SEQ ID NO: 12584 - DNA, 39104 bp, Homo sapiens
tcccagattcaagggatcctcctgcctcggccttccaagtagctgggttacagacacgtgccaccactggctaatttttttgtgtttttagtggagacaaggtttcagcatgttggccaggctgatctcaaattcctgacctcaggtgatccaccagtcttggcctcccaaagtgttgggattacacacatgagccaccatgccaggcctccaactgaggggcattctacaaaacaccctaccagtattactccaagctgtaaaagtcatcaaaaatataaaaagtctatgaaattgttatagccaagaggcgcctaaggggacttgacaactaaatgtaatgtaggtctggcacagtggctcacaccagtaatcccaacactttggtaggccgagatgggaggatcccttgaggctgggagttcaagaccagcctgggcaagatggcaggactctgtctctacgaaaataaaaataaaaaattagccaagcctgatggcacacacctgtggttccagctacttgggtggctaaggtaggaggatagcttgagcccaggaggttgaagctgtggtaaactgtgattgtgccactgcactccagcctgggcaacagaggagaccctgtctcaaaaataaataaaggcccagcatgatggctcatgcctgcaatcctagcactttgggagcccaaggctggcagatcacttgaggtcaggagttcgaaaccagcctggccaacatggtgaaacgctgtctctacaaaaaatacaaaaattaacaggacatggtgatgggtgcctgtaatctcagctacacaggagactgaggcacgagaatctcttgaacctggaaggtggaggttgcagtgagctgagattgcgccactccattccagcctaggcgacagagcgagactctgtctcaaaaaatacatacatacataaatacatacataaaaataaatgtaatgtggtatctttgatgtgatcctagaaaagaaacaatggccgggcgcagtggctcacgcctgtaatcccagcactttgggaggccgaggcgggtggatcacgaggtcaggagattgagaccatctggctaacacagtgaaaccccgtctctactaaaaatacaaaaaaattagctggacatggtggcgggcgcctgtagtcccagctactcggaggctgaggcaggagaatggcgtgaacccgggaggcggagcttgcagtgagccgagatcacgccactgcactacagactgggcgacaaagtgaaaaaaaaaattattcttttgccaggtgcagtggctcactcctgtgatcccagcactttgggaggctgaggcaggcggatcacctgaggtcaggagtttgagaccatcctggacaacatggcgaaaccccgtgtctactaaaagtacaaaaattagctaggcgtggtggtgggcacctgtaatccctgctacttaggaagctaaggcaggcgaatagcttgaacccgggaggtggaggttgcagtgagctgagattgcaccattgcactccagcctgggcgacatgagcgagactccgtctcaaaaaaaaaaaaattctttttagcgacaaagtctcattctgtcactgaggctggggtgcagttgtgcaaacagcttgctgcagcctcacattcctgggatcaagctattcccccgccgctgcatcgctaggactataggtgccaccacacccagctaattaaaaaaaattttttttatagaacagggtcttcctacgttgcccgggctggtcttgaattcctggccacaagcaatactcctgcctcagcctaccaaagtgctgagattataagcatgagccaccacacccagtctttgaaacaaaaaaacatagtcttacccaataaaaatttcataaatcctcgctgggtgtggtggcatgcacctgtggtcccagctacttgggaggctgaggtgggaggatcacttgagcctaggaggtcgaggctgcagtgagtcatgacagcaccactgcactccagcctcggtgacaaagcaagaccctatctcaaaaaaaaaaaaaagtaaatccttaatatcatacaaaatctagtttatatttagtattccctaacagtctcaaaaaaacagtttcaaaaatgaagatataaacaaagaccgcatttcatatgttatagtctctgcccagtgcagtggcttacacctgtaatcccagcattttgggaggctgaggtgggcaaatcacctgaggtcaggagtttgagaccagcctgaccaacatggtgaaaccctgtctctactaaaaatacaaaaattggctggacgcagtggctcacgcctgtaatcccagcactttgggaggccgaggtgggtagaacacctgaagtcaggagtatgagaccagcctggtcaacatggtgaattgaaaccttgtctctactcaaaatacaaaaattagccgggcatggtggcatgtgcctgtaaccccagctacctgggaggctgaggcaagataatcacttgaacccaggaggcagagtttgcagtgagccgagatcacaccattgccctgcagcttggcaacaagagcgaaactccgtctcaaaaaaaaaagaaaaaagttagccaggtatggtggcacacgcctgtaatcacagctacttaggaggctgaggcaggagaaccacttgaacccaggaggcggaggctgcagtgagccgagatcatgccactgcactccagcctgggcaacagagcaagactccatctcaacaacataaaataaaataaataataaataaatagtctcggctggtgcagtgactcatgcctgtaattccagcattttgggaggctgcggcgggtgagtcactagagcccaggagtttgacaccagactaggtgacatggcaaaaccctgtcactacaaaaaataaaagaattagccacgtttggttcaggcctgtgatcccagctattcaggaggttgaggcaggagaatcgcttgagctcagcaagcagagggaagcagaggttgcagtgagctgaggttgcaccactgcactccagcctgggcaacagagcaagaccctatctcaaaacagtagaaaagattcatcagtaagttcatataatggcaacctgatccatccatataaagtctgcatcaacctttcacctagttgttaaacaatgactgttaaaactattaggtcaaaggttgatgaagactttatatgaggctgggtgtgttttccaaccttagcaggcaccaaaattaagtggaaggcttgttaaaacagaatgctggagctggggatggtggcttatgcctatagtcccagcatttgggaggccagatcacctgaggtcaggagttcgtgaccaacctggccaacatggtccaaccgtgtccctactaaaaatacaaaacttagctgggcgtggtggcaccattgccaggagccattatctcgttatttcattgcgaacaattattttctactatcattcattctgcatatttggctccagttcctctccctcatcccgctgcctccataacttctgaccaggtctagtactattttggacctcaagatgactaaatcctagtagccgaaatttacatctgtagttgaagccaagaggattatagatctgctatagtgcgggaccagcagcatcacctagaaacttggtagaaatacaaattttggggctctattagaaacctactgaatcggctgggcacggtggctcacgcctgtaatcccagcactttgggaggccaaggcgggcagatcacgaggtcaggagatggagaccatcctggctaacacggtgaaaccctgtctctactaaaaatacaaaaaagtagcccggcatggtgacaggtgcctgtagtcccagctactcaggaggctgaggcaggagaatggtgtgaacccgggaggtgcaggttgcagtgagctgagactgcgccagtacactccagcctgggcgacagagcgagactctgtcacaaaaaaaaaggaaacctactgaaacaggccaggtgcagtagctcatgcctgtaatcccagcactttaggaagctgacgtaggtggatcacctgaggtcaggagctcgagaccagcctggccaacatggtgaaaccccgtctctactaaaaatacaaaaattagctgggcatggtggcgggcgcctgtaatcccagctactcgggaggctgaggcaggagaatcacttgaacccaggaggaggttgcagtgtgccgagatcatgctattgcactccagcctgggcgacaagagcaagactccgtcttaaaaaaaaaaaaagaaagaaaaagaaaaacctactgaatcagaaactcagaggttgaggcccagcaatctgtttcgttttgtttgaaacagagtctggctctgtggcccaatctggagtgcagtggttccatcttggctcactgcaacctccgcttcccaggttcaagtgattctcctggctcagcctcttgagtagctgggactacagatggacaccaccatgccctgctaatttttatatttttagtagagatggggtttcaccatgttggtcaggctggtctcgaactcctgaccttaggtgatctgccagcttcagcctcccaaagtactgggattataggcatgtgccactgtgcctggccccagcaatctggtttaacaagacttccagttgattctggtgcctgttaaagttggaaagccactggactaacattggctgccccatgatgtcctttggtctagaaatgatttacttaaggtcctactatgtgcatggcaacacgttgggtgctcagtatttagatgcaaagtacaaggtctggtgcccacaaggaactgacagtctattcaagggaacaggacataagcctgtgaaaaggtaaccggtgacagttggtagttggcagtgtgttcttagcataccacacaactggtgcaggcggtgagattccaggtgaatccaaggaaagtttggtgagtaggcgtggctggcagaggttttagagttgacgccagctaggccttaaagagttatcctttggagacaggggtggcagggaaaagagggaggatttccaagaagggagagtgggatgaacaaaggcaagattctggagaagatgataaccttgctagcaaggaagctttattccctctcttctcaccaccactatttctgcagtgcacactggcagtgttctttccttgggcctttttcatggttaccttctagctcttccataaacacattcgtcacgttggggtgtgtgtgtgtgtccacgtttctgtgtgctgccgtgggcgtgggtgctgggatgtgggatgtggtaacactggctggtgagtgcagagggacgtctgaggaacgctgtgtccctgccaggggtgtcgtaagtgcagaaggggctgtgcctgctgtacatcagaagcatgtgtgggccaggcgcggtggcacatcctgtaatcacagcactttggggggccgaggcgggcggattacctaaggtcgggagttcgagaccagcttggccaacatggtgaaaccccgtctctactaaaaatacaaaaattagccagacgtggtggcgggcacctgtaatcccagctactcgggaggctgaggcacaagaatcgcttgagcccgggaggcggaggttgcagtgagccgagattgcgccacagcactccagcctgtgcgacagagcaagactctgtctcaaaaaaaaaaaaaaaaaaaaggatgtgtgttctgggtgatggtatagagcttacgtgggggtaataaaccgccagccgcgcagcaccgcgctcaccagtccgctgcactgaacaagcaaagcccagaatgctccgagataagaccgggagaggcggggctgggctgcggggcggaagctggaatctggcggcggcggaaacgcgatctctgcggggcaagatggcggcgcccagacaggcctggagcacgtaggtggcggggctggagggacggatttcaggtgatctgggaggaggacccagggtagcgtgtccagtttctttgctggaacctgcctgcgggcctttggtctgtaagggagcaactgtggcctcctctgtgcatagatctcgggcacggcccttcaacgggcggcgaaagctgcgactcgrtgattcctcattgtagagttgggtggtccaggaggcttaactggagcccttracctgagcggtaagggcagtcacgcgtcccgactcgggattggatcctggctctggaggataggctgcaatgtaagagccccagagactcctcagaggccaacataaacccagaggtccattgttaggactacttttttttacgagttactctttaggcattactctttaggattacaggcgtgagccaccgcgcccggccaacccattcttattctattaataactgaaaatgttatcacttctagcactgattggttctggacaaatctgcgctggatttgtggggaaacacactggtggctttacttaggactaaaataattgttactgaggtttatttatataagtaacaggcactgggctaggcgttttgcgtgtatagtcatttaaatcctcacacatttcctattatataggacctgttactcacattttacagttgtggaaatgggacttaagacagcatagaggccgcgcacggtggctcacgcctgtaatcccagcactttgggaggccgaggcgggcgggtcacctgagatcaggagttcgagaccagtctggccaacatggtgaaaccccgtctgtactaaaaaaatacaaaaaattagccgggcgtggtggcaggcgcctgtaatcccagctactcgggagcctgaggcaggagaatcacttgaacccaggaggcggaggttgcagtgtgccgagatcgtgctattgcactccagcctgggcaacaagagggagaatctgtctcaaaaaaaaaaaaaaaaaaaaaaaggacagcattgataatttgcctaatttcgcacatttagtgcatttagtaagtagcggaactggtatttgacttctggcctattgattccaaaactggtgcccataaccccctggctctctttgtgatgtaggtatggcgcaccctatgaagtgagctggactttgcttttggatcacatgaatccatggataagtaggaattgtttctgcttatgtagactcttataggagtgaattgttaccatactatggattctcagttcatctagttcagccttccttagggcctttgggtaggcattggggtaggagactttttccttgtttgttggtcagactgcccaacaattagatatggttatctgccctttggctatataaataataagaatcataactggcgtttgtgtcctttcatgtatgagactctgttctaatcttcttacatatatataattaattcaggaggtaggtacagttatcttcatgttacagatgaggaaacaagcacagtaacttcagtaaaataccttgcttaagcttacacagttagtaaatggcagagcctggatttgaacacaggcagtccattttcatactgtttacctcccatccaggaaaaggcacatctgtatacttcgctgttgtcatgctacaaatagtaattaatacaagttctatgccaaatttaagatgaaattttgtagacaggtctttgctcacttcatccacttccttcagttctctacttatctaagttttctctttcaatattgacctctatttttaacctttagggatttttcccacctctgaaatcgtgtagcactgatcttctatgcaattaatttcatcactgggatgtactgccttgtaaatttatatgtgtgtttaccatattctctcaccccaactttgggtacatcattgaccaaaggaagacctttacaatcttggagacatcatttaaactgtaaacctttggaatttctagrcttgtgtgggcaaagagagataatgaagtgggaaattattaaaagacccagcatttcggcatggtctctgtctccccagtaagccccttgaacccagggactggattttactcccatttctttatatttacagccccytgtacaccgctcagcccagagtaaactctcaaaaaattttttgataatgttcttaaggtcacaccgtcatgtgattgtttcaccatttctacccctttagcctgcccccaacccctgtgttgggaggtgtttccaaggctggcttagttattagatctgatcctgcttagaagtagatgaagaaaaagtaaggaaatgtgtcattcagcactttttttttgagacagagtctcatgctctgtcccccaggctggagtgcagtggcacgatcttggctcattgcaacctccacttcccgggttcacgccattctcctgcctcagcctccccagtagctgggactacaggcgcgtgctaccacacccagctaattttttgtatttttagtagagacggcatttcaccgtgttagccaggatggtctcgatcttctgacctcgtgatctgcctgccttggcctcccaaagtgctgggattacaggcgtgagccagcacrcccggccttcattcagcactattgttagttccagctatctagcttgtctacctctccatctcatcctccttcaacttttaggaggtggtcaacttcatcatgttctcccatgtaccatatttattccctgcttttttttttttttttttcaagatggagtctagctctgtcacccaagctggagggcagtggtgtaatcttggctcactgcaacctccacctcctgggttcaaaccgttctcctgcctcagcctcccaagtagctgggagtacaggcacatgccaccacgcctgcctaatttttttgtatttttagtagagatggggtttcaccatgttggccaagctggtcttgaactcctgacctcagatgatccacccacctcagcctcaaagtgctgggattacaggtgtgagccactgcgcccggccctattccctgcttctatacctttgcccagctctcccttctggctggaggcctatcttatccttcaaggtctggttcagtggttttcaactgggggtgatttttttctgaggtgacatttggcaatgtctggagacatttttacttgtcacaactaggggaggaggtttgatgatgacgtctagtgggtaaaagccaggaatgccgctaaacatcctacagtgcgcaggacagcttcccacagcaaagaattacccagctataaagatcaatagtccctattgagaaaccttagtgtagttgcagcctttgctcttcaggagattctttatagttcttccccatctgcctcactattccagacttccaggacacccaggcaccacacagcagtaggcagtagaacatagtgggtaagagcatggactgactgggattgaatcctaatcctagcacacacttacactgagaccttgagcaaatacttaacttctcagcactattcttttctcagctgtaaaatttgaataatagtagtaactggcccgttgcagtggctcacgcctgtaatcccagcactttgggaggcagaggcgggcagatcacctgaggtcgggagttygagaccagcctgaccaacatggagaaacccagtctctactaaaaatacaaaattagctgggcgtggtggcacatgcctataatcccagctactagggagactgaggcaggagaatcgcttgaacctgggaggcggaggttgcagtgagccgagatcgtgccattgcactccagcctgggcaacaagagtgaaactccatctcaaaaaaaaaaaaaaatagtagtaacctacctcctaggctgttatgaggattaaatgaatgaatatggaaaaagtgcttagagaacagtatgtggtgcatactaagtgctcaataagtgttagatataacaatatttttattattatcagcatctagctcaggggttccaaaactagccagccagcttgcagatatctttggccagcccagcgttttttgttttataattgatttatagtttatataccacagaagtcatcattttattttattattattatttttttgagacggagtctcactctgtcgcccaggctggagtgcagtggtacgatcttggctcactgcagcctccgcctcccaggttcaagtgattcttctgcctcagcctcctgagtagctaggattacaggcacctgccaccacacccggctaattttttttgtatttttagtagagacttcaccatgttggtcaggctggtttgaactcctgacctcgtgagccacctgtctcagcctcccaaagtgctgggattactgatgtgagccaccgagcctggccagaattcatcattttaaaagtttacaggccaggtgcagtagctcaggcctgtaatcccagtactttgggagcccaaggtgggcagatttcttgagcccaggagatcgagaccagcctgtacaacatggtgaaatcctgtctctgtaaaaaacacaaaaattgtggggcacggtggctcacacctgtaatcccagcactttgggaggccaaggcaggtggatcatgaggtcaggagttcgagatcagcctgaccaacatggtgaaaccctgtctctactgaaaaactacaaaaaattagccaggcatggtggtgggcgcctgtaatcccagctactcaggaggctgaggcaggagaatcacttgaacctaggagtcagaggttgcagtgagccgagatcgcgccattgcacgccagcctgggcaacaagagcaaaactccgtctcaaaaaacaaaaaacaaaaaacaaaaaaaaaaacaaaaattagctgagtgtggtggtgcatctgtagtcctagctttttgggagactgaggtgggaggacggcttaagcccaggaggtagaggttgcagtgagcyaagatcacgctactgcactccakcctgggtgacagagccagactctgtcacaataaattaataaagtttacaattcatggcttttagtatattcacaaggttgaacattttcattactccaaaaagacgctccatacccattagctgtcaattcccatttccctccagctctcctagcccctggcaactactaatctactttctgtctctatggatttgcctattttggacattccatatgaacagaatcatacaatatgaggtcctttttggctagcttctttctttcttttcactaaataaaatgtttctgagtcatatagcttctttcacttagtataatgttttcaatgtttgtgcattggaacttcattcctttttgttgacaaataaatgtaaggtctctatgttaatttcttttttgcctttgtgccatggttacgtaaagtcttaacctttggagaaactgggtgaagactacatatggaaactgttcatactatctatataaatctgtaaatctaacattataacaaatcacaagtttaaaaagtacataaatttacagtatatagagaaaaatagaaatatgcatattttatcatgatacaaaacatttgattgctgacctgtttgttgattttttttatgttttttctttccttttttatcctctaagcctctgatcacttatcattgtcaaggttgagcagacagagaagtgcatacattctgcagcttgagtgcctaacttgagattctgtttctgacatttactgtggatttggggcaattaaattaactttctgtgtcaagtgggaggatcacccaagcccaggagtttgaggctgtagtaagctatgatagcagactgcactccaacctaggtgacagagtgagatcctgtctgttttttgttttgttttgttttgtttttttgacagagtctcactctgtcgcccaagctggagtgcagtggctccatctcagatcactgcaagctccgcctcccgggttcacgccattctcctgcctcagcctcccgagtagctgggaatacaggtgcccgccaccacgcccggctagttttytatatttttagtagagacggggtttcaccgtgttarccaggatggtcttgatctcctgacctcataatccacacgccttggcctcccaaagtgctgggattacaggcgtgagccaccgcatccggccaatgcaattgttttcttaattccattttctgcatgttctttgctagtgcatagacatacaatttttttttttttttttgagacggagttttactcttgttgcccaggctggagtgcaatggtgcaatctcggctcacagcaacctccatctcccaggttcaagcgattctcctgtctcagcctcccaggtagctgggattacaggcgcccaccacaatgcccagctaattttttgtatttttagtagagatggggtttcaccatgttggccaggctggtcttgaactcctggcctcaggtgacccaccctcctcggccttacaaaatgctgggattacgggcgtgagccactgcgcctggccacaaatgttttttatattgatattttacagcccaaggtttttaataatttacatacctttaggccaagcatgttctctccagtttgatacagaatcatcacccccccattatgacaacatttatctgctcggcccctgatgacattttcctcaggtctcctgctggttgttcctgagagttttatcacctatagattgtaaacaacctaagttggctataaatattgttgctaggctgatgacatcasggagggctgaagacagagggaatggcagtaaggtatgaatgaggaggaatgagttcatgttaacccaaggataaagaagatcttcgctgttgcccaataaagagaatcagggttcagttgcagagggcccatattctttcttgctcttagggatgaataagagggaacccccacayggagacactgctggagagagtcgtactggggaggcagctggagcagcaagatgctgtygagaccgaagccaggggagtccgaggtggacctgctgcacttccagagtcagtttctcgcagctggtgcagccccagcagtgcagytggtgaagaaaggaaataggggcggtggtgatgccaactcagaccggcctccgctccaggaccatcgggatgtggtgatgttggacagtgagttcccatggatgtgaggctgagaagtagagagggtacagcctygggccsctccctcttcctgttgtggttggattcagacacatcattattatttcagacactgcatagcctgtgtttctgcagccccattttacagaggaagaaaatgaggctcaaagaggttaaatatcttacccaagatgacacagcttgagccagggccccatggcagctgtctttcttccctagcctgcagtgtcttcctaggaaggtgtgcatatactcacgtttgggatcttttctttctcagatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgtgcgtctcactctggctgagtaggataagatgttctagggcaacagggatattggatgctcggggtgggtgaggcttatcagtggagggtgcttcagaaaggtagacttttacccctgaggtcaggwtgggggctgggttagaatcactgccctgaagggaggagggtccgtaaccccccagagtgaggttctcatcgttcagaactgggctaataggatcgggtccagcctggggaagtttctccattgtgcttcacaactttgtgctttgttgctacaggaacgagatacaagttcagtggccgtgaatctgcctgtgcccagtggtgttgctttccctgctgtgttccttcgctcgcgggacacacaggtaggcaagggtaagcttaggtggtgctcaggagacagacaggtgagtctcatagtgcatcttctccaggcaggtagttttaatgatgataagcaatttaatttacaaagcaggatcatactaagcacttcatacccattacttcttttaatcttcataacaaacatataaggcaggtatcatgatgataccttggggatgaggagtccttattcccatttttcatatgaggaaactgagaccccaaagagataaataacttgtccaacaccacacatctaataggtagaagagccagaacttcaacccaagtctgtcagagtctaagacctttactcttatagacctctcctttttctgagaactagggttgtgatccctggaaattgagcaaatccccttttatctctttgttccagaggccttgatataaagaggttgagaggaaagtgggatgatgagcatcagtracctgggttttctttttgccccacaggggaaatcagcaacatctggtaagagaagcatctttgcccaggaaattgcggcaaggaggatagctgaagccawgggcccatcagttggggaagttgtgcccaacgtgggcccaccagagggtgagccggggttgaagaggattgggcttggcctttttaaaagacacaatcatarggtcatttttgaagatatgtcttcctgcctcaaatgagaggtgcatttgagccatctcaagtagtctgagaatactaggtatgggaggcttgggtccatatctgggtctcaggtgctgggagtggggcaggccattatgcagtcctaagagaaagggaatagggcagaagtgtctggcagagactgtaaaataaatgtgttggccaagatccctttaatgatgcaaattattagcttaacagctgggagcaggcccctggctatagatgcctgcctagatatctaagaggagtcagaaattaggatgtttctgaggaaaaccttttcatataagtactagggaagcagtgagtggagaagccacctggagtccctgtgccagacccagtggggtctccactctgaggaaagyttgggtctatacctgtctccagggctaatagccttatagaagaaggccaaaaagcccagttagagccctggaggacagagcaatgaatgtgatcatacctttcttccaggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttggtatgggtgcctggctttcctgctgagaccaggctaggagaggaataccacttattgagctaggcttactgtgagttccgggcactgtgctgagtactttaatgcyttttttttttttttttttttttttgagatggtcttgctctgtcacccaggctggaatgcagtggcacgatctcggctcactgcaacctccaccttcacggctcaagcartcctcccacttcagcctcctgtgtagctgggattataggcacacaccaccacactcagctaatttttttttttttttgsggggacagagtttcactcttgttgcctaggctggaatgcaatagcacaatctcggctcaccacaacctccgcctcccgggttcaagagattctcctacctcagtctctcgagtagctggaattacacgcatctgccaccacgcccagctaatttttttatttttagtagaggtagggtttctccatgttggtcaggctggtctcgaactcccaacctcaggtgatctgccctcctcggcctcccaaagtgctaggattacaagcatgagccaccatgcccggcctttttttttttttgagatggagtttcggtcttgttgcccaggttagagtgcaatggcgcgacgtaggctcactgcaacctccgcctcctgggttcaaatgattctcctgcctcagcctcctgagtatctgggattacaggtgcccaccaccatacccaactaatttttgtatttttagtagagacggagtttcaccatgttggccaggctggtgtcgaactcctgacctcaggtgatccactggccttggcctcccaaagtgctggagccactgcgcctaggttttttttttttttttaagacggatttttcctcttgttgcccaggctggagtgcartggcgcaatctctgctcactgcaacctctgcctcccaggttcaagcaattctcctgtctcagcctccaaagtagctgggattacaggcgcctgccaccatgcctggctaatttttttattttttgtatttttagtagagacggggtttccctgtattggccaggctggtttcgaactcttgacctcaggtggatcaaagtgcctcccaaagtgctgggattacaggtgtgagccaccgtgcctggcccccagcgaatttcttttaaggtttttgtagagatgaggtctcactatattgcacaggttggtttttgttttttgttttttgttttcagagtctccctctgtcacccaggctggagtggaatggcacgatctcggctcactgcaacctctgcctcccaggttcaagtgattcttgtgcctcagccttttcagcagctggaattagaggtgtgtaccaccatgcttggctaattttttttattttcagtagagatggggtctcaccatgttggccaggctagtttcgaactcctggcatcaagtgatccaccgacctcagcctcccaaagtgctgggattacaggcatgagccaccgtgcctgacctttaatgcattattcagttctgtccttaaacttgtcctgtgaggtaggtggtattaaccctattttacttatgaaagaaactgaggcctaaaatttaaaagaaattctacccaggtcacacaccttataagaagcacaggacacaggatttaaacccagatctacctggtctcatatagatctacctggtctcatatgccctgcttttttttttttttttttttttttgagacggagtctcgctctgttgtcctgggtggagtacagtgacacgatctcagctcactgcaacttgtacctccctagttcaagcgattttcctgcctcagcctcctgagtagctgggattacagatgtgcaccaccacacccagctaatttttttgtatttttagtagagatgggtttcaccatgttggccaggctggtcttgaactcctgacctccagcgacccatctgcctcggcctgctgaagtgctgcgattttttttttgagatggtcaccgtgcccagccgaggccctactttttaaccactgtgctatgtataactgtactaccctggtatagtatacactatgctttattatagctatactctagtatatgtatagtctcttctactctgtgatactgttctatgctatgcctcacccctagtgtctgttcaccaaaatgccaggcactcagtcaatcttgttacccactgtatactagcacctctatagastataatacgtgttagggctcagtatggtgccttgccctgtaattccagcactttgggaggttgaggtgagaggattgcttgaggccaagagtttacgaccagcttgaggaacatcatgagaccccatctctacaaaaaataaagatataaaaaattacagccaggtgtggaggctcacgcctgtaatcccagcactttgggaggctgaggtgggcggatcacaagatcaagacattgagaccatcctgrccaacacggtgaaatcctgtctctactaaaaatacaaaaattagctgggcgtggtggcacacgcctgtagtcccagctactcgggaggctgaggcaagaaaatcacttgaacccgggaggcggaccttgcagtgagccgagatcgtgccatggcactccagcctgggcgacagagtgagactctgtctcaaaaaaaaaaaaaaaaattagccagatatggtggtgcatgccggtagtcccagttacttgggaggctgaggcgggaggattgcttgagcccaggagtttgaggctgtggtgagctacgattgtgccactgyactccagcatgggtaacagagcaagaccctatctctttaaaaatatatatttacagcctgagcaacatggtaaaaccccgtctctagtaaaaatacaaaaattagccaggcgtggtggcaggcacttttaatcccagctactcaggaggctgaggcaggagaatcccttgaacctgggagatggaggttgcagtaagttgagattgcaccactgcactccagcccgggcgacacagcgagattccgtctcaaaaaaaaaaaaaaaaaaaaaaataaataaatatatatatatatatatatatatatatgtgtgtgtgcataaataaattagctaagagaaggaaattctttctgtaaatgccttctttttggccctagtcaacattaacttattcattctacagccacttacattggaactgtgacctgaaaccaaagggataggcataggaacctgggccagtggactgtgagggatagagggaaaggtgggcaggtgggcaggtgggcctagtgaccccacaggtgtgagaaggctgggtcattgatgggccacaggagcacccagaaggctcaggcccaggctcggaagcagcttgtcctgtccttggcacccacagacaggcgatattcagcgggttccaggtctgtaggaggccagggaggatctaccctcactcactctcccctctaccttcgcctctagaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccaggtttgcaggaggcgggggtcatattttggtggataaaagtaggggaaattgtcccttttcctaggcctggcaaatgagagaagagagaagcttctgtgcttttggacatctaacattaatcctcattattggcttcaagtcagtcttcattgctgatgcatgtcttcttcctgcacatgcttcctgttttcttgtcctgttactgccccttctccgccttcccttttaagaggcagcaatgcgtgatggctgaatcccactccacccgctcccggcagactatcttcctgtccttgctgtagctgccccagctctggctctgtccatcccactgttctttctctctctgctcacagtgctgggggaaagatggcagggccagagtaataagagaggcagaatctgacaaagatcttatgaacatgccagaccagaagcagagaggccagtggaagcactcatttcccagaaactagattatttcattagtgattawcaaaataagaaattgaattatgagagccaggaacctcatgcccccggaggagctccaggccagctgagcaggttgggtgggggtaggcgtgaaggaggaaaatgctgtgggatttgtttctgtatcctgccccccaggagcagtatagttgcctcctcctcattgtccccactctcctactcctttaagggctggtactggaaagtggagatggtgccttcctgacatatgtggtcctccttcttcatctttttctcctttctttctctttcttccttctccttctcctcctctctcccctcccaacaaatccttggggtcagcaaggggctggagcccaggatggagtgtgtctgtcatatttgagactttcaccccagccccaggagttccagtccctgrgccatgccatttagccataaycgagggtagaagctggcagatcctggaacagaagtggatgtggcagctgctgggtgatggtggggacccctgtggatagtgagctgagccgtttgggtaatactatcatgctttgtctccccagctctggcattgcccrtgacccctcagaaagaatggctgcacatggacactgtcgagctggagaagctccactggacccaggacttgccccctgtccggcggcagcagacacaggaggtgaggagggccacctggcctacaaggggtgggtgakatagggcaggagaggagctgctgctcttgccctcagaactcaggcctttctattgcccagagcctgagaagcatctctcctttgctctcacccacctttaccatcactctgcctggcccccaaggccagataagccccatttctggtagaagtagagtcagtacctaagtcctgaaaggcctgggattaaaggtggggagtgggtgtgggaaggttgctggagcccccagaccacagtcctctttctcttcccattagaggatgcaggctcgrttcagtcttcagggagaactactggcccctgacgtggacctgcccacccacctgggtctgcaccaccatggagaggaggcagaggtgaggcatgggactggagaggatggggcagctcttttaacaaccccatggaaaaggatctctggtcaactgcctttgaccttctgtgtgccctgttctagttcatgcctttgctgtgcattcagtttctttttttggagacagaatctcgctctggcccaggctggagtgcagtggtatgatcttggctcactgcagcctccacctcctgggttcaagccattctcctgcctcagcctcctgactagctgggattacaggcgcatgccaccacgtccagctaatttttgtatttttagtagagacggggtttcaccatgttagccaggatggtcttgatctcctgagcttgtgatccgcctgcctcggcctcccaaagtgctgggattacaggcgtggcattcagtttcttaggctcaaaatcttgatcctctctccgtattctggtcagttgctagaatttgccgatcttctgtcacctcctcatgatgcctcctgcrctgtggccttgcttccttggtctgctcactctccatgccctccattctccgcccccctgccattccatgtctctcggggctgctgtgctgatttcttctggcccagctcaggccatgccttgcctccagaagtttcccagcttccctctgctcacaraataaggttctggtctcagctgggcaagatattccttctaccttttgtccctgctgaccctgctgctctgcctccttcacttcctgctacaccactctgctggcttctccccacatacctcctgtgctcagggccctccaggactccactcgctccaggaaatgcctttgccttttgctccatgtcaggccatcaaagctctacccatccactgagaccaatttaattttccaggttcccttctctctctctcctgtccgccggtcgcaaattaaacatcagttatcacgttcctctgcatctgcctcatggcatggttacttgtatgcaagtcttatctttaccggcttgaggctccatggaaagcagggcagatttcacttatttatctttgtctttcctgtgataccttgcttggtgttttgggggcactgtgctgtatcctggctgcttctgacttcttgtccctgccccagagagcggggtattccctacaggagctgttccacctgacccgcagccaggtttcccagcagagagcactggcactgcatgtgttagcccaggtcatcagcagggtgagtggattgccagcctggtcctgcccacccttcccttcaccccacagcctcagacttccccatctcctgcccttttcactctggctcactagccagctatgtgcttttaacaacctaggatcataggggggcaaacgaaggattagggcaaagcctctagataacttcagcatcttcagcaaggttttaccctcctgccctcaggcccaggctggtgagtttggggaccrgctagcaggcagtgtcttaagcctccttttggatgctggtttcctcttcctactgcgcttctccttggatgacagagtggatggggtcattgcaaccgccatccgtgctcttcgggctctgctggtggctcctggagatgaggtaccacagggataggaatggggcttgggctgggaggtgccagggtccatattcctgttyctgggcatggccccattgctaaggctttgygggcaagatgtagaatgggatggcaggcgtctccctcatctcctaaagtccctaaagcccaggaggcttgcmtttatggtttttattggggagcatcctctctactcctggatccatttcctggccccttcagcattgccccccaactcccgttcctctggcaggagctcctcgacagcaccttctcttggtaccatggagctttgacgttccctctgatgcccagccaggaggacaaggaggatgaggacraggatgaagaatgcccagcaggaaaagcaaaaaggaaaagccctgaagaagaaagccggcctccacctgacctggcccgacatgatgtcatcaaggtaaagggacagcttctttcccatcccatggcccaggggacaagcacatgctggaaagaggggccatcaatgcccagggtccagctgcatttgtcagtgggtttctctctccaactcccaggggctcctggctaccagcctgctgcctcggctgygctacgtgctggaggtgacatacccaggacctgcggtggtccttgacatcctggctgtgctcatccgcctggcccggcattccctggaatcagccacargggtgagaaaaaagggagcagggaatgggcaaaaagcctagctgrgccttgtcttgacccacagcctcccttcctcccttttayctcctgtctcccataggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctggtgagcaggacacagggcaagggatgggggaatgcatgggacagggttgggttgggagctaaacatggctcctgaactctgggtggccagctcttgccatcttcttcctctctgatccagttgcttagaaatgcaacagaaatcaccaggcatgaacctgtttactggagcctgtttaytggagcctggtgcatcatataggtatactgtggtctcatgatgtaataggaggtctccctgttccctagacccagatcagaagggcttcatgcacataggcattcatcatctatagccaagtagccctagagaaggtgcccagcaagccttgctataaagagggagggctgggtgtagtggctcaggcctgtaatcccagcactttgggaggccaaggcaggaggatcacttggggccaagagttcaggggccagcctggmcaacatagcaagactcygtctctacaaaaaacaaaaacaaaaaattagctagatgtggtagcacatgactgtagtctcagctactcggtaggctgaggtagaaggatcacttgagctgggaggtggaggctgcagtgggctggttgcaccaatcactgcactacagcctaggcaacagggcgagaccccgtctcaaaaatactactactggccaggtgcagtggctcacgcctgtaatcacaacactttgggagaccgaggtggtggatcacttgaggtcaggagttcgagaccagcctggccaatatggcaaaaccccacctctactaaaactacaaaaattagccaggtataatagtgtgcgcctgtagtcccagctacttgggaggctgaggcaggagaattgcttgaacccgggagatggagggtggagtgagccaagatcacaccactgcattccagcctgggtggcagagcaagattccatctaaaaacaaataatagggccgggcgcggtggctcacacctgtaatcccagcactttgggaggccaaggcaggtggatcatgaggtcaggagttcaagaccagcctgaccaagatggtgaaaccctgtctctactaaaaatacaaaaaattagccaggcgtggtggcatgcgcctgtaatcccggctactccagaggctgaggcagagaattgcttaaacctggaggggcagagattgcagtgagccgagattgcgccactgcactccagcctgggcgacagagcgagactccatctaaaaaaataataataataaaaataaaaaaataataggggctgggtgcggtggctcacacctgtaatcccaacgttttggaaggccgaggtgggtgaatcacgaggtcagcagttcgacaccagcctggccaacataatgaaaccccgtctctactaaaaatacaaaaattagtcgggcatggtggcgcatgcctgtagtcccagctactygggaggctgaggcaggagagtctcttgaacctgggagacagaagttgtggtgagccaagatcactccactgcactccagccagggcaacagagcaagactccatctcaaaataataataaataataaaaagtaaaataataaaattgaaattttaaataaataataagaaggaagggcagggtggatgaggtatgactttgtggcaccagaggggcctgggtcagggttgagttaagccactctctgtccagctgagagtagctggacttgagactcacagctgaccctgatccycagactgtgcccatttccagttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacaggtgaggagaggcagggggtaggctccccctagacaccttcagttctgctcttctggccaaatcaaacacctcagccttgctcaaggtcccaagcttggaggaaggataagaatgagtgggagggcttctgccagatgtgaaaaggcttaggagtcaggcccagccagggaagagggggataaacctggcttaaccgtattctatgctcaaaatcattagccgggcactgtggctcatgcctgtaatcccagcactttgggatgccaaggtaggcgtatcacgaagtcaggagttcgagaccatcctggccaatatggtgaaaccccgtctctattaaaaatacaaaaattagccaggcgtggtggcacacacctgtaatcccaactactcggcaggctgaggcaggagaaccggtttaacctgggaggcagaggttgcagtgagccgagatcactccatcactccactgcactccagcctgggcaacagagaatgtctcaaaaaaaaaaaaaaaaaagcattggtatctgtgaaatcacatttaaattccctgttgggggcagccttgaaggacaacatcctttccattctttagggctgagccttccaagagtgccccactcttcctcctcatcctcctttatcaaactgcagatccctgggtcagggccatgacctgtgtctcatgtctccacttgctttcatacagtgaaaatcagtccctgttcttccctagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcaggtagtttatagccaggacccacaggacaggtggagggctcctccacagggctggggtggctggagtgtaaaggggcgtgaggcagccagatcctcactgtggcmccctttggcacttttgtagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaagtgagtgcctcctgccggctgtccaccaggcccccgcaccctgccttcagctacattccacccgttgctccctctctgtgtccatctctccactcctacttccccatttactatcttcccttttaattcctacccttcctcctctttctacctccatatccccgtggagcttcccaggagccatgttggtggggaccagagagcccacgcagcasctcagccttcctgtagcctgtgtgctccctctttatgccccctacacatcggggccttctctcccttcagaaggctcagcctgcagaagcctccaaatgtgctcytttgggctgttgggatggtggcattggcctgggtacacagggtctaggagaatgaatggctgggccatcagctcagtgaattccttggtccaccagccaagctcatgcccggaggattggctccaggacatgsagcgcctgtcagaggagctgctgctgccactgctgagtcagcccacactgggcagcctgtgggattcccttaggtatgtactgtgtttggtagctgggggaagcaggggaggaggcaatttctttccttgtgggattcctgggtccagctcccakgtccatcccagggtgcaggccctcggcccgagggaaacccgagtccctagcaggcagcagtggggtgggctctgaggagtgtgagcagcactgacctccacagccaggccccccgttagtcttaggtacagacccagaagctctttccagcttggcacacgccaggccagagtccccctcagactctccacttcacctacaggcactgctcccttctctgcaacccgctgtcctgtgtgccagcccttgaagctccccccagcctcgtgtcactgggctgctcgggaggctgcccccrtctcagtctggctggctcagcctcacccttcccattcctcactgccctcctctctcttcttaataccctggcccagatccacaaggggctgtgtggccaggtaagtgtggggtgcctgattaggggccaggcaaggggccaagatggcaggaatcagaaagaaagtgggagggtgggatgggcgcggtggctcacgcctgtaatcccagcagtttgggaggccgaggtgggcagatcacctgaggtcgggagttcgagaccagcctggccaacatggagaaaccccatctctactaaaaatacaaaattagccaggcatgatggcacatgcctgtaatcccagctactcgggaggctgaggcaggagaatcacttgaacccgggaggcggaggctgcggtgagctgagatcacaccattgcactgcagcctgggcaacaagagcgaaactccatctcaaaaaaaaccaaaaagaaagtgggagggtgtcccatggggaagggaggccttctgctggcactcatttccctgagtctggagaggggcagccacctggggagccctagaaggcatgagagtcaatttctagatctgaacaaaattgcttttcctcagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagyggtaggtccccctgtctgacaggttctcctgtcatcccattatctccttcctgtttctgtggaacccagcctgcttctgccaggccatgcagctcccactttcctccagacaygccctggacctstgcccttcagcctcacttttatcctcttcctcacttctctctgccacgtccccttctcctgtactaggtagttccctgcttttctgtctgcaggcagcgctgcagccactgccagccacccatgctgccctctatcatggtatggccttggccctgctgagccggctgctgcccggaagtgagtacctcacccatgagctgctgctgagctgtgtattccggctggagttcctcccgtaagtgcttggttggtggcatcaactcagcccttttggacgctgctgcagttgttaacagagcagccctgaatttggagccaggagacctaaattctctttcttccaccgacgacacttaactcttccgagcttccattacctcattagtgaagtgaggatcaggctaaccacacccaagaatgattgtgagacttcagtgtgactgcatggctaaaaaaatggtatctaaatcagttacacacatgtaatagccatccgctactgagtgtttactctgtgtttgatactcccttatgtatttatctacattttaagtattttacttggaccatgagatagatactattattatccttattttactctgaggaaactgaggcccagagaagttatgtaaactcatgcctaggcagctggctgtagtgtgcatcctcttaactgctacacagcactgcgcgggaagtagttaagggagcagagaggcacaggtctggacctaggagcctccaggaagttccaaagagctggcacagcctccaagtgctgtggttccagccctcatttttggcttttgggtcccattacagggaaagaacatcagggggtccagaggcagccgacttctctgaccagctgtcgttaggaagcagcagrgtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattsgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccaggtactttctcagcccagcaggacctgcaagggtaccctgcactgggcctcgggggcagtcctgagccttgaggagctttggaagacctcagcttcctcatcttacctcttgggggctttgaggggattaagagaatcaatgaaaagggcttaacatgggctgggtgtggtggctcacgcctgtaattccatcactctgggaagctgaggtgggtggatcacttaaggtcaggagtttgagaccagcctgggcaacatagtgaaaccccatttctactaaaaatacaaaacttagctgggcgtggttgcgggtgcctgtagtcccagctactcaggaggctgaggcaggagaatcgcttsaacccgggaagcggaggctacagtgagccgagatcgcgccactgcaccccagcccagtgacagagcaagaccctgtctcaaaaaagaaaaaaggaaagggtttaacctggtgtctggcatatagtgggtattcattactattaataaggcatagctccttgcttatcagtgctacaatctagataagaagagatttactgaaaacctacatagttgtgaattattcagatgctaggtggtatcaggattcagagaagggaaagatcaaattgggctttgtggaagaagtggggattgacccaggcactgtaggttgggtagaatttgaattggtgaggaggtagaaaggcaggagattcctaacagaataacataagcaaaaggagcatgacaaagggcagaaggagggaggagagatttctgttgggaacttaaggctaaaaataagaagtgaagtctgagagggcctcaaatattaggctaaggacttaaatttataagctgtaaagagttactatgtttgccaggtgcggtggctcatgcctgtaatcccagcactttgggaggccgaggtgggcggatcatttgaggtcaagagtttgagaccagcctggccaacatggtgaaaccgtctctactaaaaaaaaatacaaaaaattagccgggtgtcgtggtgcatgcctgtaatcccagctactccggaggctgaggcaggagaatcgcttgaacccaggaggcagaggttgccatgagccgagatcataccactgcactccagcctgggcaacaagagtgaaactccatctcaaaaaagaaaaataaaaaagagttactgtgttatggctgcgtgaggtggctcatgcctgtaatccaacattttgggaggccaaggtgggaggattgcttgaggccaagagtttctgaccagcttgggcaagaaagctagacaccatctctacaaaaaattattsgaaaattagccagacctggtgatttgcccgtagacccagttactcaggagcctgaggcaggaggatcacttgagctcaggaggttgaggctgccagtgagctatgatcacaccactgcattccagacttggaaatagaacgagactctattaaaaaaagaagttattgtattttgttttttgtttttaagattttgggtttttgtttttgtttttgagacagagtctcgctctgttgctcaggctagagtgcagtggcctgatgatcttggttcactgcaacctctagctcccaggttcaagcgattctcctgcctcaacctcctgagtagctgggattacaggcacacagcaccatgcctggctaatttttttttttttttgagacggagtcttgctctgttgcccaggctggagtgcagtggcgcgctcggctcactgcaacctccgcccctgggttcaagcgactcccctgcttcagcctcccaagtagctgggactacaagcacccaccaccatgtccagctaatttttgtattttcggtagagatggggtttcaccatgttggccaggctggtcttgaattcctaatttcgtgtgatccgcctgcctcagcctcccaagtgctgagattacaggcgtggcccactacacatggccaatttcatgctttttaatggctgcttctcagttcccagttttccccaacatctgctctgtagtctttaaccctgatccttgtgctagaaggacagatgtttgtctaggacctgatctctgccctcatgatttggtttcatgtgatcgttatccacacacsttatgtatgtatatacattcctaccctccccctcagcacgtcatttcccctgtcacagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgaggtagggtcagggccattaggagggtgggatattagaggatcttgggggacagagaccacaacaggatctcattacccacttcataagttttctttcctttctgcagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaatttgatctggactgatttcagccatgttagttcagggttagtatctgggggtgggttatcccaggtgaggagcaggactgctgtgagagagatggggaagaatcataagtgggaggtaaaaactttgtccacatctggagacaacaagaatgtggggcctgccaggcacagtggtacacacctgtagtcccaactacttgggaggctgaggcaggatgatcacttgattccaggaattcaattccagcctagccaacatagtgagaccccatgtctgtctgtctgtctgtcggtcggtctgtctatctatctatctatctatctatctatctatctatctatctatttctgagacagggtcttgctctgttgcccaggctggagtgcagtggcgtgatcatagctcactgcagcctcgacctcctgggctcaagccattctcccacctcagcctcctgagtggctgggaccacaggcaagtgccaccacgcctggctaattttttgtatttgtagagacggagtttcaccatgttgcccaggttggtcttgaattcctgagctcaagcaatccacccacctcagactcccaaagtgctaagattacaggcatgagccgctacacttggcctattttggtagtttctacattgttctttggtctgaattctaaactttaggctttcttagactgtcttttgctgtgtggattacttattgtgtttgcaagtaaccagagtcagagcagtgtgccaaggcctagccctgtcagtaggtagagagaacccagtcttcataaatggagctgctgaacacagaattatccaataggtttttttgggtttttttttttttttttttgacacgaagtcttgctctgttgcccaggctggagtgcagtggggcaatctcagctcaccacaacctccccctccctagttcaagccattctcctgcctcagcctcccaagtagctgggattacaggcgcgtgccaccacgcctggctaatttttgtatttttagtagagatggggttttgccatgttggccaggctggtcttgaactcgaactcctgacctcatgatccgcccacctcagccttcaaaagtgctggtattacaggcatgagccactgggcccagcctttttttcttttttttttttgagacagagtcttactctgtagcccaagccagagtgtagtggcatgatcttggctcactgcaacctccgtttctgaggctcaagtgattctcatgcctcagcctcccgagtagcaggggctacaggcatgcaccaccacacccggctagttttttgtatttttattagaagcggtgttttgccatgttgcccagggtggtctcagactcctaagctcaggcaatccgcccacctcagcctcctaaagtgctgggattataagtgtgagccacagcatgtggccccaataggttttattaagcaactactgtatcagcaaataccaatgattctcaaactttgtgacaaaaatcatctggaggatattttaaaacagatcactgggtcctaccaccagaagctgctgattcagtacatctggggtgaaacccaagaatctgcatttctaacaagttcccaggtaatactgatgctgatgttcagaacaaaccacacaaccacaatttgaagagcagtggcttaaagagactttgcaaggtaaattctgtgatctcatagtgtgatatctagtgttaagtagggcatagagaccagggtttttttgttttttgttttttttgagatggagtctcactctgtcacccaggctggagtgtagtggtgcaatctcggctcactgcaacctctgccttccaggttcaagcaattctctgcctcagcctcccaagtagctgggattacaggcacctgccaccacgcacggctaatttttgtatttttagtagagacggggtttcaccatcttagccaggctggtcttgaactcctgaccttgtgatccaccccacccccaccgtccccttggcctcccaaagtgctgggattacaggtgtaagccaccacgcctggctgagaccagactttttacaaaatcactgttctgtttacaccttgaattagactttaccaagtagctaactactataacttctcttttgaagtattttgtattaaacataggtctcagactttcaagttaggattttttttttttttttttttttgagatggggctttgctcttgttgcccaggctggagtgcaatggtgcgatctcgtctctgcaacctctgcctcccaggttcaagccattctcctgcctcagcctccagagtagctgggattacaggcgtgcgctaccacgtgtgtctgattttgtatttttagtagagacgggattttgccatgatggtctagctagtctcgaactcctgacctcaggtgatctgcccgcctcagcctcccaaagtgctaggattacaggcatgaaccaccgcacccggcaaatgatcatttaagcaaatgatcgaagactcaagacacaaaactacctgaagggagtggctcccacatttgtagggtaccttacagagcaatttcccttcatatgattttgcaggtggtggggaaactctcagggcagttgtggcctgtgctacatcacccattgaccagaggtgccagtactagtgctcaagatcaatcgatcgatcggtctacctacctatcatctattgaccttcagtgctactaaaaacactcggatcttctaacgtctggtccagtctttcaccccatcacagtgagaggctgtgcacaggggtaacacaggcaacggaattatatgaggcaaacacagagatccaggtttctgggagtagcaatgaggttcagccttgcagtcacaaaggcaccactaaaaggcacaagtaatggcaggtaatgaggccttacttggagcagtttagagtacttcccacgtgtggtgacgcatgccacacactcaccaccaccaccactgccacaaatgaagtgcacactccactgctcctgtcctcaggaacctggaagcccccacctggtgtccgaggtgtggctcccactttaagcgtggggcacctcctctccggcctcaaacctacccgagctcccagcaggctgcggcacatctgacggctggaaactagaacccctgggtggggactccttaaggctcctcccggaagcgtagggacctcgctgcccacacgcccctccctttcctcctctggcgtcctggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggtaagtgctatctggcggtcaggggaccgtccagcctgaggcactttcctaggcttgggggtggccggtcaacaggccaggtgtcagtggttcctccagaggcctcgaactctcacagccaaatttctccggtccgtgcttctggagtgcgggccgagaagcgccaagtgcgtgcgaatcccagagtctggatcacgcagcttgggaaggaggaacattctttggggtctcagcaccgccttggggcggggccaccaatctaagttgaggaaagcattggggaggctgcaggaccaaattcattgcggcccctaagttattcactgggaaaggcgctcgaggagagaaactggcagacctatcagcgcgcacccgcggggcttctgcgaccggagtcgggtagtggcttccaggctgagagcgcggctgggccgggtgacgggtgtggccgcgaccgcaagggcagctgttgcggggttctctctttctttcatatcctatttccacccgccttaacgtcctgcgccttctcccaacacctttcaggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggtgagctttagacgcctccttcctctttcgctcaccataccagacccctctggcccagctaggggctcgacgacccttgcctcgctccttgctctcaggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgtaagtgcacggcggaggtagggtggacagtgacctgctagttggaggtttcaccctcagggtaacgaagtccacgtgcgcaccgacttgcgtcttggactattccgcggggaggtccaccttgagtgcccttcaaggtggcagtagtcgccaccgagttagcccttacccggaacctcttacaccgagcggaaggcccccaaccagggcggcgccaaggggtgcttgagcctccccacatttccacgaaccctcctgaaataagtgtaatatctgatttttcggtgtgcaaacctacccttcccatcccgtcagagtcgattgcagcctccaagtccctcagataaaaaataattctggagcctcctctgtcgccaacttctgcccggagcggccggcctgagcaccgaaggccggggactcaccgtccgttccccgcaggatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggagtgagcgcagccagtggggatggggcggcgccggcgccgggggcgagggctgcctgggggccgggggagcgtgctttcctcggtgccgggtcaccagcacagcgaggggaggctcccgggccccgccgattccctcccccgctgcccgcagggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtacgtgctcccttcggcgctcagcgttggggtcccaatcctctccccaggggcgctcacgcaccggctctccgtccgtcccttggggtccccctatccctgcgctgggctgggctggcctgggctgggctgggggcccctgcccttatccaggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtgagggcgcgggccgcggggagaggcgggcgtgctccccgtgtggctgccaaccttcctgctgtcgctctgcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcgg

SEQ ID NO: 12585 - DNA, 33251 bp, Homo sapiens
tacacaaattcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggctacaatagtaagtttaatcttgatatgcaccagaaggtccacacaggagagagaccatacaattgtaaggaatgtgggaagagttttggctgggcctcgtgtcttttgaaacatcagagactgcacagtggagaaaaaccattcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctgaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaatgcagtctcatctgaaagttcacaaaggagagacacattaaaatatgaggcacatagtaagcacttccctttgagtattttatctctgaatccatgctggtgataaatttcacccattcttggaagagggaaaacatttgtttaagataacatcagtgcttcagccatagctcagcatgccccagtagtctcaggaccaccataatggagaatccttgtaaatggtgcaataaagcttcattcagaagtttgataattacagctatcattcaggagacaggccttagaaagagtaagagttcatgaatttaccagactaatggtggacatgtccaaattgatgtccactagaatgtaaactacatgtgtctttgctgctaagtcgtcacagccttaacattgattagcactttgtatgtgttcagtacttgtttgttaaatcaatgaaaggataaaacatatgtatggatttggatacaattttgtgtatccaaaaagggaagcctgcaaaaaataattctgggaaacatgagttgaaatgcagagtaaactcagtactgcaatccatagcaatattttgcatattattattttttcttttaaatttttttcttgatcagatttatcatattcattgaacattattttattgcacttggctcctggcttccccccatcctgtgctctgaagtcagagtattatttgtggctctatgaaatgtccattgcttgtatacggtataaatttaattatcttttgtagtttttctcacagtatagactgaaaaggtttggttaattttgcaataacagaccactgcatatttcacaattaagtgttttcaacagtattaaggcaagatttacagtaacacttttaaagtgccagatgtacattgacagaaattttcttagtcaatcctagattgatcatgatttgtgatttctatgcaggccttggtatgattgccttttaattgctgtacaatttcttttttttttttaacttctctggtataaaatattctaaatttgaatgacagcttttgtcaaccttcttatccaatattcttccaccaacgctatgaaacaggaagagaaaatggagtttggtaatttcatcaaatatattcattattgggggcaggagtaacatttaaatcctcctctttattgctggcagtaaaaatatgtcttttggagagcagaacatgccagaatgtataaggtgcaactgtttgatatgaaaaccataggataggaaactatgcctatgacactaaaactccaaaaagtagaagaccacattgatgatgtcactgcattttaaaatggaaagaacaagtgttcaagaacaggaatttgtgtgaattgcatttattcctataataatatgaactcaatgagatgatgacatagacacaataacaaaaggagaaaaacaatgtggctttttttagccttcataacctaatcaaataaatatctttgtgtgttttatgttcttttgagtgtttacatactgtgtaaatgaatatttttactgatctttgctggcaatgagtgtttgcaggcatttttccattttatacttccatgcatttttaatttttttatgccacgatcttttaaacaaccagctcttgtgtgaattaagagtgcgaactcattcattaccatggtggggacaccaatgtttatgaaggatctgcttccatgaccaagcaccttccaatagtcccgacctccaacactggaggtcatacttcaacatgagatttggaggggatacatattcaaactattgtcagatgttaattcatcaggtatacaccatagtaatatcttaagtgtgttaagttaaagtgatatattttctaaggtatagaacaaatagggcttatcacccccctacaagcaaagaaaatgtcacaatgcttagtgtgccatttttgatattggatgcaacttattgtttcgattgtgctactctgacttttatgagtgacccaaaaactttgacttgtcccagacaagagaagtttgtgtaatatgtcccagcttccacgtaagcttctctgccactaaaaccctgtgaccccgggggtccaaaagtgtttgaaatgtccgtggcagatagtatgtttgaagcctatggttggccctaattggagaatcaaaattcagatgcttagtattttgaagcaaatttctgccatcctctgcatatacttactctcctctggagaagaagcttttcattttgctagggtgttttgttttgttttgtttttgtttttgttttttgagacgagtcttgctctgtggcccaagctagagtgcagtggtgcaatcttggctcactgcaacctctgcctcccggtttcaagcgattctcctgcctcagcctcccgagtagctaggattgcaggtgcccgccaccgcacccggctgatttttgtatttttagtagagacggggtttcaccatcttggccaggctggcctcaaactcctgacctcgtgatccacccgccttggcctcccaaagtgctgggattacaggtgtgagccaccacgcccggccactaggggtcttaaaacggacagaacacttgaccacagaccaccaaattaacatgtgacttatgctttccatcatgaatcgggtgttgacccctgcacctttttaagttacatgtgcagattagtattccatttggaagtggtatatatgagattgtgtttgtgcaggctctgaagccacaggtaagtgcacctaatattcatctccctactcttgctgtattcagaatgagtgaatataaagagaagtcatctgaaattattgtgtctcagcagcagaaagaagtggaatacacggttggacgcggtggctcacgcctgtgatcccagcattttgggaggccgaggcgggtgaatcacctgaggtcgggagtttgagaccagcctgaccagcatggagaaaccccctctctactaaaaatacaaaattagccgggcgtggtggcacatgcttgtaatcccagctacgctggaggctgaggcaggagaatcgcttgaacgcgggaggcgaaactccctctcaaaacaaaaaacaaacaaaaaacaaccaaaactgaaagctggtaatgaaacaaatacgtatacacgaacatttgtagcaacactgttcactacagccaaaaggtgaaaagaagccaaatgtgcgtcaatgtatgaatggagaaacaaattgtagtataaacataaaatattcatctatgaaaaggaatgaagtactgatacgtggtatgatgtgaataacattaaaaatattatgctaagcaaagggagttagaaacaaaatgttccattcatttttatgatttgtccaaaataggtaatagaaaagagagaaagattcatgtttccccaggaatgggattatggacaacagtagtgattgcttagtgggcatggggttttctttgggtgataaaaatgttttgtaattcaagaggtggtggtttcacaatgaagcagctactttgtctgaggtttaaacccggggttcgtcgttaagcgccagaaaaatttaggacacggacacacaaaaactcctcagtttaggagcggaggtttaataggaagaagagaaagagaaacgggttcctccatagaggaaggggtctccgagcggaaaagggtcggctggcagtgaatgtgctgagttttacagaccagtttgaggaggcagtgtctgatttacataggggtcatagattggttcgatcagttatgacgtttacatagtgcgtggggaaggctggtcgccccaccctaatcttcttatgcaaataggcttcccagttgattggcccatcttgccagcttcttactgtgcacgtggctgacaaagagaagggaagatggagccgccatctttaacatgattggcacaactgctggtatctatgtctgcggcagctggattttacaggctgctcttccttaggaagggaaataatttggggctgcttttcattaaaaagaaaagccttaccgagggctcccataccctatctgcctaagtgatggcttcttaactcgtatatattaacaacactgtattcgtactagatgccattgccattgaattatgtgccttaaaataattttgttttgtgaattacacctcaaaaatattttttaaataataaaacgaccacgttaaaaacgttttgcatagcgaaaaacaagtcaaaggaaaaaagctttttggttgagcaatatttgatacaatgttaatatgagtatgtaaataatacttaacggaggggaaaaaactaaacactcaatagaaatgtgggcaaactatttgaccaattcacaaagactataatagtggcaacggaaaatatgcacggatgttccactttatttacaaaagaacaaatacaaattaaaactacatttagaaaccatttcttaccattagattagcaaaacttaactcctcgaagactgtgtcttctcgcttgttccctttccaataacactcctgttatcattggaggcgtttagacttcagaaattcctgtctattcagtattttctgtcctggaccagggagagagaaggacgactctcaggataacagttcacattccccactaggcaggcgctcgtggctttgggattcgttcccagtgggcacctcggagtggcaacgcttccccctgaagaatgagattttgagcgtttttccttcagcattcggaggagtgtaatccaaatgctctgtggagtcgtacacactggctccagaaggaggatacaagcaattctgggaatggtagtccagacgctcagtggagtagcggtcagcttggctccggcaggcgaatcaggggatttctgggaaatgtagtccagacgctcagtggagtctcggtcaatttgactccggcaggtggatcccagggaattctgggaagtgtagtccagacgctcggggtcgtcgcggtcagtttgtctcaggaattctgggaagtggagtccagacactcagtggagtagcgggccacttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggtttggcggagcggggccgctgttttcgttctcgtcagtggagccttcttgggcttggggctctcctcgcgtccccggggtgtttgggacttggtcgggtcgcgtctcgcctggttttagggtctccggggctctgagctcgcccactcggcctccctgcaccccacgcgcgtggccacttcctcgcgataaaacgctgggatgttacttaatctccttgggtctcccgttacagttctttaagatggggagtttaggaccatcctaatagaatcgttttgggaactgaaagcggtaacacaaatgagagccttaaagcagcccctgtcacttggtgactggtggtctcttgttaatttcccacgaagcctgtcaggtccccgggtggggtgaaactccagctgcaggggcaccggcccttctccctgattcctgcaagacgctgggtgatcccggacgccttctgacctctcttttaggaaggcgagggttgcatccacttccaggaggggagaggagcatttaacttttatggggcacggcgaccacggtcagagtgtttcacagccttctccttacccagcccgacctttccaaaagagctgcagggagggacttcttggcttctgagggcaaagctctacgtgagtgatccttggcttttttctttgacagagatgctcaccccaaccgagagtgtataggatgtgtcttcgggcatgggtgttgctttcagttgtcatgtttttctagtctttaatcttgaaagatagcatagctttcatcgttttttcttggtattttatccttgttatttttgaagagtatagatgaagttattttggtcaaagatgttcatttggagtttttctgatgtatttcacgtttaacttcaaaatatgcattttttgctggaataccacagaagtggtaaatctctctctctctttttttttcttgagacggagtttcgctcttgtcgcccaggctgtagtgcatggcacgatctcagctcattgcaacatccacctcctgggttcaagctattctcctgcctcagcctcccaagtagctgggattacaggtgcctgccaccacatccggctaatttttgtatttttagtagagaagggatttcaccatgttggccaggctggtctcagactcctgacctcaggtgattcaaccgccttggcctcccaaagtgtgggattacaggcatgagccaccgtgcccagcctgaagtggtaaatttcttattgcaacataacaggggccatatgtcagtttgtcacttcattggtgatctcaactttgttcacttggctaaagtcatgtttgtcagatttccgcattgtaaaattattttgaatttttttttttaccccaggaacacagattcaagttgctctcaatatacactccctaattttttagttaaataaaattttgtaaggagaaatacatttattagtgcacattctactgtaaaggtgaactctcccttctccttcatttgcttattcattcattcaactataaatattctatcagtgtagatccagaatccagtcttattaagttaaatgacatgtggatgaacaattaccaatgctttgtccaactttattgaggtgtattctacatatcatagaaactacccatttcrtgtgtacactttaatgatttttaggaactttgtggagtggaataaacatcaccataattcagtttaaataattttcatcccccattaagcctccttgtgctcacttatagttaatcctctttgtcacctcaaatatgcagagaccacctayctactttctcgttatrtacacttgcctactctggaatttcatagatataggatcatgcaatatgtgggccttcctatgtgactggcttctttcacttagcataatgtttccaaagttcatgcgtgttgtagcatgaatcagtacttcattccttttaatttccaaataagattccattgtatggataggccacaatttgtctatccatgtackcataggagggartttgttggtgtgcagttttgggttactatgaatgatgctgttgggaacattcatgtgttaatttacaatacacattcgtgttggtggatggcatccctggccacactttcatgtctctttttctgccttccctggtactttccaggcaggattctgctttcccttggactrtatcactcaggactctgaatattccctgaaataggaggaaaaatgaccacgttgaaggtgagtagagcttgcctctcttgctgttaaaatttcttttatggagacttgttctgtcgccaaggctggagtgcagtggcctgattttggctcattgcaacctccacctccggagttcaagtgattctcctgcttcagcctcccaagtagctgggactacaggcacacaccaccacacccagaaaatttttgtatttttagtagagayggggtttcatcatcttggccaggctgttctcaaactcctgacctcaggtgatctgcctgccttagcctcccaaagtgctggaattgcagatgtgagccaccgtgcccggccgtatttcttctcactactcatattctcacaggttcttctcagtcttgggaagacttagggagtacaacagagatatagcatgggacaaacagaatctagctcttcccgtgtgaacacctccaataatccttgtgtgaagcagcagttaagcagttatagcctgttgtgttgtgccaacacgagagccagcgtccacaggtggcactgctcctcccaggcaccattttggggtgatcttctttcttcctgacatgacacctactcagatgcacccagtgctccaggcacccaaggacagtgataaccatagtcatgatagaaaatctttactttcagtatggtaaagggtacctcacacaatgttaccagaaaatataacagcctagagcaaaaatattcactacttgtatatttgaaacagataaaatccaaaataagaatcttatgtacagaatagaaaaagaaaatccaaaggaatgtgaataaaagacattaacaggcaagtttaaaaggagaaattgagatggccaataaatatttgaaaaggtgatggtattatttataatcaaataagtgagactgttaaattcttcctaatatgattacaaaaatcatgggaaaattgataacctgctcttggttatggtaagacaaatcagtgtacacgtatcctcttgaaagattagggtttggtaaaaaattgagacctgatattatatgatcacaattttaaatatgcctatttattgacattttaattttcatttaaaattattttaaataaacagtagtaaaatctacccaaaatgtttttttttacaggattggtattaatgagcatatataaaattaaagattatttagagtagataaaaatagattatcaattctttggaatactatgcagacatgaaatgagataaaatagatggcaacaatgacaataataataaaaaaaattttaaaaagctagtgtttattaggtatttagtctgcamtgatcaactttcccaatgctgcatgtatttccttgtttaatcattgaaaaaactataatatgaaaattattagagagggagtaaataggtgaacttgtccaaggtcatgtgaccaggaaggcacagagccttgggatgtgcttttaggcacactgtctgcagatcrtagatcaatgctgcaatcaatgtatgtagtttatgccttgagagtacacaggatgtactgtatagctgtcccacacaggttaccacaagctttgttagtttggtggcagatattaaagaaaaatgataacattcagggttcaagtatgagagagaacaatgggaattatcaggcaagactgggactgaattgttaaatgttactggggcagttggcaagattcactgaaacctatatacgtgcagcccaggatgctgcatttagagtcctacagggttacttacaaggagactcagtaagtgcacaaagtaaacctacaggaggtcttttccatcactgcacttctggtggagctcaggaaaatccatcattatcaggatacagacagaatgaatagcaaatctatgagctggctgggcgcagtggctcatgcctgtaatcccagcactttgggaggccgaggcaggcggatcacctgaggtcaggagtttgagaccagcctggccaatgtggtgaaaccccatctctattaaaaatacaaaaattagccaggcatggtggcaggcacctgtaatcccagctacttgggaggctgaggcgggaggatcacttgaacctgggaatcggaggttgcagtgagccaagatcatgccactgcactccagcccgggcaacagagcaagactgtctcaaaataaataaataaataaaataaaataataaaaaaggaagtctgtgtgttgacctatgtctctcaagatccaaaacagcttctcattcctcccctctgtctgctcagtgccacccctctctcagtagtcattggtcatgagactgaggttgcatatgttcgatgctgtaggaggcagtgaccttcaaggacgtggctgtggtcttcactgaggaagagctgaggctgctggaccttgcccagaggaaactgtaccgagaagtgatgctggagaacttcaggaacctgytctcagtgggtgaggacaggcaccctttgtaagggaacatcaggaccaggagtggctttgtatcctagagtgttcaagtttgagtatgcattgggaacctaagtttccagtaaattttacttagatttttttctaggatatattggcactaagcacatgacttttcacgttcacagggcatcratcactccacagagatactttccacttcctaaaggaagaaaagttttggatgatggagacagcaacccaaagagaagggaatttaggtaagaagcaagcaactctgtgtccttgtgcrtgactctcccatckgtttyacttctgtccattgcccagstctgttgtcctggtctaaatggccagacctctttcctgaattattacagctgactttcggctggtttccctgctcccacttttcccaccctgacatctgttttcctcatggcagccaatgtawtccttaggaaagtcagactgccattcctcggctcaaaagcctttctggcttcttttttttttttttgagatggagtctcgctgtgtcgcccaggctggagtgcagtggtgcaatctcggctcactgcaagctccgcttcccgggttcacgccattctcctgcctcagcctcctgagtagctgggaatacagatgcccgccaccacgcccggctaattttttgtatttttagtagagacggggtttcaccgtgttagccaggatggtctcgatctcctgacctcgtgatccgcccgccttggcctcccaaagtgctgggattacaggcgtgagccaccgcgcccggctggcttcttatgtttacttaagttacaagtgttttaagtgccttttagagaccatgtgatctgcttttcatcccccaccacctctctgactacatctcctgtcctctcccttttgccttgtccttccagccacgttgtcctccctaccgtttctctgacctgccaaggacactgtattgcctgttgtagtaaccaatgaccacacatttagtcgactaaacaacaaaaatttatcatctttctgttctttaggcctgaagtctgacacgtctcaccggacaattatcaagctgtctgtaggtgtttgtttctttctggatgctcttgaggagaagcctttattttggtttaccagtctctaggcattccttggctcttgtttcccttcctccatcttcaaaggcagctactttgcatttctgacccttcttccatagtcatgctcactctgccactcttcttatgcctctctctcctgcctttcaggttccttgtaattgtgttggttacccctggatgattcacaatgacctctctttcttgttagctgattagtgaccttaattgcatctgcaatcccagtcccccttgctgtgtaatataacatgttcataggtcttgggtactggatgtggacatcttttatgaatcattgttctgtctactactgaagcttctgcctcagagcccttacttgcttttctgtctgatcagaatactctttcacctcaaaactttctggcttctcctttaagcatattcaagtctctgttcagttttagagaggccatttccaaccaccctatttaaaatactattctaggccaggcgcggtagctcacgcctgtaatcccactactttcggagaccaaggtgggtggatcactgagatcaggagtttgagaccagcctggccaacatggtgaaatcccatctctactaaaaatacaaaatttgccaggcgtggtagtgtgtgcctgtagtctcagttactcgggaggctgaggcaggagaatcacttgaacccaggaagcggaggttgcagtgagccgagatggcgccaccgcactccagccttggtgacaaagtaagactctgtctcaaaaaaacaaacaaaacactgttctatttttttcttcttgtgctgtcttgcactgtgtcttatatatttctgtttacctgtcacttttacccccaggaatgtgatgtctaagaggatgaattttagctgttttgctcatggctgtctattcacaggctagaaggtattgttctggtacatggcaggtatctaattatttgttatcctgataaataaattaatggatgaggggaacttcagtgtctccaggaatcatggagatagatagctaataagtgatacacaaactagagtgaatgagagctattgcagaacatgtttctgtcttttgatggctgcctatctaattagaactttcttaggattccttgttgggatactatttttaggtatgtgcagttcacctacatcccatggaaacttctaagtgttctttttatggccacactgagtattatgccttctctctgacttgtcttggagctttatgtttttatttttattttttaaaaattttccacaagttattggggtataggtgatatttggttacataagttctttagcgacttgtgagaatttggtgcgctcatcacccgagcagtatatgctgcaccatatttgtagtcttttgtctctcgccctcctcccactctttcccgcaagtccccaaagtccatttctctcttttttttttttaagcagagtctcgctctgttgcccaggctggagtgcagtggtgccatctcggctcactgcaggctccgcctcccaggttcacgccattctcctgcctcagcctctcaagtagctgggactacaggcgcccgccacgatgccctgctaattttttttatatttttagtagatacgggttttaccgtgttagccaggatggtctcgatctcctgacctcgtgatccacccgcctcggcctcccaaagtgctgggattacaggccattgtctcattcttatgcctttgcatcctcgtaggttagctcccacatatcagtgagaatatatgatgtttggttttccattcctgagttacttcacttagaataatagtctccagtctcatccaggttgctgcaaatgctattaattcattcctttttatggctgagtagtattccattgtatataataccacagttttctttattcactygttgattgatgggcatttgtgttggttccacgattttgcaattttgaattgtgctgctgtaaacatgcatgtgcaagtatctttttcgtgtaatgacttcttttcctctggatagatacccagtagtgggattgctggatcaaatggtagttctacttttagttctttaaggaatttccacattgttttccatagtggctgtactagtttacattcccaccagcagtgcagaagtgttccctgaacaacacatccatgccaacatctactgtttttttgatttttgattatggtcattcttgcaggagtaaggtggtatcgcattgtggttttgatttgcatttccctgatcattagtgattttgarctttttaaaatatgtttgttggccatctatatcttcttttgaaaattgtctattcatgttcttagcccactttttgatggggttgtttggtttttttcttactgatttgtttgagtttgttgtagattctggatattagtcctttgtcagatgtacagattgtaaagatattctcccactctgtgggttgtctgtttattctggtgactgttccttttgctgtgcaaaagctctttagtttaattaggtcccaattatttatctttgtttttattgcatttgtttttgggttcttgatcatgaaatccttgcctaagccaatgtctagaaggatttttccaatgttaccttctagaatttttatagtttcaggtcttagatttgagtccttaatctatcttgaattgatttttgtataaggtgagggatgaagatccagtttcattctcctacatgtggctagccaattatcccagcatcatttgttgaaaagggtgtcctttcccccactttatgtttttgtttgctttgtcgaagatcaattggctgtaaggatttgggtttatttctgggttctctattctgttcctttggtctatgtgcctatttttataccagtaccatgctgttttggtgactatggtcttatagtatagtttgaaatcagttagtgtgatgcctccagatttgttctttttgctttagtcttgctttggctctgcgagctcttttttggttccgtatgaattttagcattttttttctaattctatgaagaatgatggtgatgttttgatagggattgcatttaatttgtagattgcttttagcagtatggtcattttcacaatattgattgcacccatccatgagcatgagatgtgtttccatttgtttgtgtcatgtatgatttctttcagcagcattctgtagttttccttgtagaggtcttttgactccttggttaggtgtattcctgagtatttgattttttttgcaactattataataggggttgggttcttgatttgattctctgcttggttgctggtggtgtgtagaagagctactgatttgtgtacattaatcttgtatccagaaactttgctgaattcttttatcagttccaggagctttctggaggagtctttaggattttcaatgtagatgatcatatcattagcgaacagtgacagtttgacttcctctttaccgatttgggtgccccttatttctttctcttgtctgattgctctggctaggacttccagtactatgttgaggagtggtgagagcagatgttcttgtcttgttccagttctcagagggaatgctttcaacttttccctattcagtgttatgtttgctgtgggtttgtcatagatggcttttattacattgaggtatgtcccttgtatgccgattttgtgagttttaatcataaagcgttgctggattttgtcagatgctttttctacatctattgagatgatcaagtgattttcatttttaattctgtttatgtggtgtatcacatttattgacttgggtatgttaaaccatccctgcatccctggcatgaaacccatttgatcatgatggattatctttttgatatgttgttggattaagttacctagtattttgttaaggattttagcatcaatgttcatcaaggatatcggtctgtagttttcttttttgattatgttctttcctggttttggtattagggtgatgctggtttcctaggatgaattaggaagggttccttctttctctatcttgtgaaatagcgtcaaaagaattggtatcaattcttctttgagtgtctggtggaattctgctgggaatccatctggtcctggactttttttgtttgtaatttttaaattaccatttcaatctcatggcttgttattggtctgttcaggatatctaatttttcctgatttaagccaggagggttgcatttttccaggaatttatccacctcttccaggttttctagtttatgtgtgtaaaggtgttcacagtagcctagaatgatcttttgtattgcagtggtgtcagttgtaatatctcctgtttcatttcttagtgaggttatttggattttctcgcttattttcttgggtaatcttgctaatggcctatcaattttatttatcttttcaaagaaccagctttttgtttcatttatcttttgtattttttgttttgttttgttttgttttgttttgtttcaatttcatttatttctgctctgatcttggttctttcctttcttctgctrggtttgggtttggtttgttcttgtttctctagttccttgaggtgtgatcttagaatgtaagtttgtgctctttcagtctttttgatgtaggcatttagggctatgaactttcctcttagcaccatcttagctgtatcccagaggttttcatrggttgtgtcattattgtctttcagtttgaataattttttaatttctatcttgatttcatttttgacccaatggtcattcaggagcagattatttaatttccatgtatttgcatggttttgaaggttcctcttggagttgatttccagttttattccactgtggtctgagagagtgcttgatataatttcagttttcttaaattaattgaggctcgttttatggcctatcatatggtctctcttggagaaagttccatatgctgttgaataggatgtgtattctgtggttattggatgaaatgttctgtatatatctgttaagtccatttgttgcaagacatagtttaaattctttgtttctttgttgactttctttcttgatgacctgtctgatgctgtcagtggggtattgaagtcccccactattattgtgttgctgtctaccacatttcttaggtctattagtaattgttttataaatttgggagttccagtgttaggtgcatatatgtttaggattatgatattttcctgttggacaaggccttttacattatataatgtccctctttgtctcttttaactgctgttgctttaaagtttgttttgtctgatatcagaatagctacccctgctcatttttggtgtccatttgcataaaatgccttttccacccttttactttaagtttatatgactccttacatgttaggtgagtcacctgaaggcagcagatggttggttggtgagctcatatccattctgcagttctgtatcttttaagtggagcatttaggccatttacattcaatgttagtattgagatgtgaggtgccgttgcattcatcttgctatttgttgcctgtgtactttggtttttgtatttttttgtttttgctttttaatatgtgtttttgttgtataggtcctgtgtgatttatgctttaaagaggttctgttttgatgtgtttccaggatttgtttcaagatttagagctccttttagcagttcttgtagtggtggcttggtagtggcaaattctgtcagcgtttgtctgaaaaagactgtatcttccattcatatatgatgyttagttttggtggatacaaaattcttggctgataattgttttgtttaaggaggctgaagatagggccccaatctcttctagcttgtagggtttctgttgaggaatctgctgttaatctgataggttttcctttataggttacctggtgcttctgtctcacagctcttaagattctttccttcgtcttaactttggataacctgatgacaatgtgcctaggcaatgatctttttgcaattaatttccaaagtgttctttgtgcttcttgtatttggttgtctaggtgtctagcaaggctgggcaagttttcctcgattatttccccaaatatgttttccaagcttttagaattctcttcttcctcaggaacactgattattcttaggtttggtcctttaacataatcccatacttctttgaggctttgttyatattttcttattcttttttctttgtctttgttggattgggttaattcgaagaacttgtcttcaagctctgaatttctttmttctacttgttcaattctattgctgagactttccagagcattttgcatttctataagtgtgtccagtgtttcctgaattttttatttttttttatttaagctatctatttccttgaatatttctcccttcacttattgtatcattttttggatttccttgtgctgggcttcacctttctctggtgcctccctgattagcttaataactaacctcctgaattccttttcaggtaaatcagggatttcttcttggtttggatccattgctggtgaactagtgtgatattttggtggatgttaaagtgccttgttttgtcatattaccagagttggttttctggttccttctcatttgggtaggctctgtcagaggtaaggtctagggctgaaggctgttgttcagattcttttgtcccacagggtgttcccttgatgtagtactctcccccttttcctatggatgtggcctcctgtgagccaaactgccgtgattgttgtctctattctgggtttagctacccagcaagtctacccagctctgggctggtactgggggctgtctgcacagagtcctgtgatatgaactgtctgtgggtctctcaaccatagatatcagcgcctgttccagtggaggtggtgggggtgtgcaatggactccgtgaggtttcttagctttggtggtttaatgctttatttttgtgctggttggtctccctctaggaggtggcactttccagagagcatcagctgtggtagtatggagaggagccagaggtggatgaggccctagaactcccaagattatatgccctttgtcttcagctaccagggtgggtagggaaggaccatcagggagggggagggctaggtgtgtctgagctcagactctccttgggtgggtcttgctgtggctgctgtaggggatgtgggtgaggttcccaggttactggagttgtgtacctaggaggattatggctgcctctgctgagtcatgcaaattgtctgggaagtaggggaaagctggcagtcataggcctcacccagctcccatgcaaaccaaagggccggtctcactcccaccatgcccccactaacagccctgagtctgtttccaggcagtgggcaagctgggcttgagaccttgccccaggctaccacctctcagctgcaaaagaaaagggcttgggtcttcccctgcctgtgagtctgcacactggattcacaccctcccccaagttctggccaggaggcttcttgccyggttcaaactgttataaagttcagctggatacttctttctccttgtggagttccccaccccctgctcctctggctgccttcctgatggatccctgtgatgccaggcaagaatggcctgcttagggacccaacgaggtcccaaggcctttctgttgctttgtctacccctgtatcttactcagctctctaaattgactcagctccaggtaaggtcggaaacttctcccacaaacagaccttcagtttctccagtgagggtgtgtgttcagtagaggaggctttttctcacttccacagttggggcactcacagtatttggggtgtctccagggtcctgcaggagcagtccacttccttcagagggtctgtgggtcctcttgggattgctagtttgtttttgcagttgatctggaggtaaaattcgcaatgggagactctgtatgccgcactgtccgtctgagttggagctgcaatctagtcctgccttccgtccgccatgatgatcttgtcttggagctttttgtagggagaatattcatccgtggaaagaaaccttttattttatttttctttctttattttattttattttattttttgagacggagtctgcctctgtcacacagactggagtgcagtggtgccatgtcggctcactgtagcctccgtgtcccgggttcaagtgattctcctgcctcagcctcccaagtagctggtatatgccaccatgcccagctaatttttttgtattttttagtagagacagagtttcaccatgttggccaagctggtctcaaatacctgacttcaggtgatctgcccacctcggcctcccaaagtgctgggattgcagggaatgagccaccactcctagccaaaaaaaaccttttcaaaggaagattctgatgtctccttctgaaacagctctcctatacaaggggaaaaaactttcaattctctgatgtctcagaaaataaccagctttccagctacctttccttcgagagatttacccatctgcagcctgtttgcctcttccaatgtacatcaccaatgtacatgtacatcaccaacccccggtttctctttccttctcctagagaaagaagaatgaggataagggtgacacaagtcacacatctgaatgttgcctgtatttctagtcatctttgtttgatagcgtggtatatatttctgcatctttattttttacaaatttgttaaacatgttaaagaatacagatttcgtacagtcttccttttctttgtatagagacatggtgctgtattttgaactggtgaactttatatcctggaaggaatcaggaaactgccctctcaaaatgttaacatcctgaaagagactcctccttcttcccaaaaatctcttatttataagggatgatgttttaattatatccatgtactaatgtgcaccagtaggtacacacttacttactaatgtttcctaagattcagccattgaaaattaactttccatttgattgatttacttaattcagaatgtggtaatatcctgaccaagattttcaatgttttatgaccatgagccatagtaagaaatacatctttcatcatcaccaggatgaaaatattttgtgcatgtagatgtgtatgagtacctttagtaggcatttcatataatggcacctttcctgtttgtcacgatgctatgataatttctattctggttctttttcctaaatgctttttagaaggtttcagatttattttacagctcactaagagtctgtagtgtttattttgaaaatgggtataaaggtctgtttctttacatcatattttttctgctatctgttttcaatgagacagtccaataacttcacatggaaccaatcagggcatgaccccttaggcgttcttttcatcccaggtgatcttaccaactttcattgtctcatcaggatcatccccctttgtgtatttctgtcaggtccagcctttcagattcccatcaaaactgaaggtttctgatccttttctatttcaggtaaccaagttattgttcatatcagtacagacaaatgagattatacatgttctgcaaaaattcttgtacaggaatactctgaaaatgtagacataaatactcctaggtatttgatatttagtattgtgaagagcttaaccaattgcaaagtttaaagtgacagctcacagaagactgctgtcactgcataccaatgacaaattcagtggtttccccaaattaytttcatgttccatattcttaaaattatgggtttttataggggaaagatgcatattacaattaggagaaaaatcaagtaagacasagtccagggaagtatcaaatgagaactttttattgtactctccccatgaaatcaggatgcattacatccccaagattaaggtgtgacattagacgggaggagagcctatcagggaagctttcctgagccctggtattcagagtaatcgttgtctgttaattacatagccattattggttgatttctttcccgtatgagtagtctcagtctcctggttgactgattccacatgacctaaagcctcaccataaatcacattgttggtctttctcacatagtgagcaccacattctcctcataggtgtggccacccataatcctaaatcgtagaattacaccgtccagagtgacttactagacctactacctccaggcaaacaaagacactctcctagggcatgacattttaaggactgagagattgcctctcagatgctgaggacatcacccaggcctctttgtgacttaggataatttctttacttcataaggatatacaatacaaactaaaatatacaaagttttgacgatgttatggcttctccttaaagttcacatttgattcatatttcactgtttacataatttattagttacataatttaccatgcaaggttttatttctaccaagtatttcacatatgacacgtggtgtggttctgaattggtctcatgcaaaccagagtccatagtgtacctggaaaacacattggctgggcacagtggctcaagcctgtaatcccagcactttgggaggccaaaatgggagtatcacttgtggccaggagttcaagaccagccttggcaacatagcaagaccttgtctctacaaaaagtgtaaaaattagctagttatggtggtatgtgcctgtagtcctagctactcaggaggcagaggtgggaggatcacttgagcccaggaggtcaaggctgcagcgagccatgattgtgtccctgcactccagcctgggtgacagagggagacactctctttaaaaaaggaaaatacagggctgggcgcagtggcttacacctgtaatcccagcactttgggaggctgaggagggcggatcacgaggtcaggagatcgagaccatcctggctaacacagtgaaaacccatctgtactaagaatacaaaaaattagctgggcgtggtggcgggcgcctatagtcccagctactgaggaggctgaggcgggagaatggtgtgaacaacccaggaggtggagcttgcagtgagcggagatcacgccactgcactccagcctgggggacagagcgagactccatctcaaaaaaaaaaaaaaaaaaaaaaarggaaaatacaatctgaacattccctatatttattaaaatttcaggctatgtcctaagtatgaaatcttgataacactgaataaaagctttacttgcccacatctcttaattctgtgtcattataggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatygtaaattacacacaggagtgaaacctcatatttgtgagaaatgtgggaaggccytcattcatgattcccagcttcaggaacatcaaagaatccatactggggagaagccattcaaatgtgatatatgttgtaagagcttccrtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacrcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacacyggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaawcatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtcaccctgtagtggtgtaaaacactagaacttattcctcctacctgcctgtatttctgtattcattaaccaacctttggctaccaccctgcctcctcacctctaagaactactattctactctctacttctatgaagttaactttttgagcttccacatatgtgtgagaacatgtggtatgtatctttctgtgcctggcatatatcacttaatataatgccctgtaagtctcattcactttgctgtgagtgatagaattttgttgtttttcatggctaaatagtactctgatgtgtatatttgccccattttctttattcattcatccagtggacacttaggttgattacataccttggcctatttcttggctatcgtgaatggtgctgcaataaacatgggggggtggagataacactttaacatactgatttccttttctttggatatgtaccaagtatcatataatagtatgacatgactcaaaattaaggaataagattgtggaaattggttttcaaaaaaaaattctctagtttgaatatagagaaaaattggtgagtgtcttcagctgtcctcatacataatgcatgtgagctcgctttaagcataagtgaaggagtggaaaaatcctggagatagaaatcaaggggtatacatgtggatgtaaaaaatcaacaaagattcttttaagaaaaggtgtgtatgggtagggaacaatagcatgacagcagtgcggcctctaacagtctggaaccagttaggamaaagagcaggattgagcgccattccattcatagacaccgtggtgatattttgagtacattaggttaaaaggctttcttcagcaaaayctmtctctagagatagatttgatttttataatcaaayctmcymgagatagatttgatttttataatcaaatctactagagatagatttgatttttataatcaaatctactagagatagatttgatttttatacttaatgttctagactgtatcttttcaggatgctaggtactttatgaagatccatgctgtctcaatttgcatagtgggttggaggtccctaagacaatctctccagattctatgatttgctaagaggactcagaatatagttgtactcatgactatattatagtgacaggatacaaataatcagcaaagggaaaaggttcttgtataatatctggagggaatcagatgtaaatttgtaaagatcctttgtgcatggagtaacaggtctcaattcctccagtattgaattgtgactgtacttgtgaaatgtctacaatggaaattaattatcaacccgtaccaaaggttcttattggaactaatcatgtaggtaccatccctctggkacatatcaagattctagactccaagaaggggagcaagtgttcagaataacttgaaccatgcctaccrgttatggaatggkggcaaccctctcaaactccgtgtttcctaacaccagctaaaggccagtcttataagcagtcctttctaagatttgcagtctcaggcctgttatattaactttttgtgcacatagtactagaaaactgttggctcagtcttctttttgttttgtgtgttttggtttttaactgtcaccgataccagaatagctcatctccaaggtaactgtaacagaacactyagcagattaaacagaaaatacttgcttattataattattaaaagtttggtagggtctatgtctgctctctggtgtgtcctggatcatcaacttggttacaacatggtgttaacatgtgggactgattgtgtttcttgttaatatttctgtttctcccaaccacgctgaatattaaatacctagttctatatctagtaccctgagcttatgtggggctaatattctttgccatttttcaccacagatttgatttcctttttcttttgtggacactggtgagttccctaatataactttgacttggttatattttcacaatcggtggggattattacagattatcatccttcctctgcatttgaaaaaggagggaggcttcaagtcaggttagttgaccttcctttgttggtcttattatccataacataataaataaattgatgaggatgggcatggtggctcacgcttgtaattccagcatttagggaggctgaggcggcgttttagaccagcctagccaatgtggtgaaacctcatctctactaaaaatacaaaaaatatgccaggtgtggtggtgtgcgcctgcaatcctagctactcaggaggctgaggcaggagaatcgcttgagcctaggaggcggaagtttgcagtgagccagaatcgtgccactgtactcctgcctgggtgatacagtgagtctccatctcaaaaaaataagtttatgagaagtctattaaattgttacataatctatataggtagaaggtttctatttcaagtgaaccaaagtgtaacttgaatcgtctaatgcagactcacagcccaaaaataaattccaagacatgtccactttacaaatccacaattcctttgatggggtgggagggcagttctggataaggatggaccctgctagattgcaaaaaatttacagcactaattttttccccagagatctccataaggacctatggtcatgaacttctgtgactgtgtactcaaaaagagaaataatcacacattttggcagtgactgaattcttgttttcaagtaggataaatccaaagagactcacactgagacacattataatcaaaaagacaaggaacatcttgaaagcagcagcatgaaagtgacttgtcatgtacaagagatcctcaataatatcatcaatggctctggccaggtacagtggctcatgcctataatcgcagcactttgggaggctgaagcaggtggatcacttgaggtcaggagtttgagaccagcctagccaacacggtgaaaccctgtgtgtactaaaactacaaaaattagccaggcgtggtggtgtacacctatagtgccagctactcaggaggctgagacaggagaatcacttgaacctggaaggcagagattgcagtgagccgagatcatgccactgcactccagcctgggtgacagagggagactgtctcaaaaaagaaaaaaaaaaaaaaaaaaagatcatcagtggatttctcagcaaacctccaaggccagatgatgtattaaagtgctggaaaaaaacctggtatattgaggattctatattcagcaaaactatacttccaaaatgagagatcaattaataacttttcagaaaaacaaaagctgagagaattgccagtagacaagttattcaagaattgaaaaggttgggaggctgaggcaggcagatcatttgaggccaggagtttgagaccagcatggccaacatggtgaaaccctgtctttactaaaaatataaaaattagccgggcgtggtcgtgggcgcctgtaatcccagctacacaggaggctgaggcaggagaattgcttgaacctgggaggtggaggttgcactgagccgagattgtgccactgcactccagcctgggcaacacagtgagactccatctcaaaaaaaaaaattgataaagggaatcaatccttcaagttgaaatgaaaggattttagacaataacttgaaatcatatgaaaatataaagatctatactaaaggcaattgcatgaagcaatacaaacaacattatgatagtaattttagtttgtaatcccagtttttattttccatacaacgtaaaagacaaatgcataaaaatgactaccaatctatgtaaataagtacacgatatgtaaagatgtactatgagatcagtaacagtgcgggaaggaaagagctgtgaaggagtagggtttttatatctgattgaagttaagttggtatcaatttaaaagactgttataactttaggatgttacatatacttttggtgactataaagaaaatatcaatgaaacatgcacaaaagaaaataagaagtgattcaaggcaaggcagggtggctcatgcccgtaatcccagcactttgggaggccaaggcgggtagatcatgaggtcaagagattgagaccatcctggccaacatggtgaaatcccatctctgctaaaaatacaaaaaaaattagttggggatggtggcacgtgcctgtagtcccagctactcgggaggttgaggcaggagaattgcttgaacccgggaggtggagatcttgtagtaagctgagattgtgccactgcactccagtctgggcgacatagtgagacaacatctcaaaaaaaaaaaaaagtgattcaaaattaatcactacaaaaaaagaactcaacacaaaggacaattgtaatgaaggaaatgagaggcaaaaacacaataggacatataaaaaacaaatttaaaatggtagtccttacctatgtataattagtttaagtgaaattaatgaaactccccaataaaaagatgtagtttgtcaaaatgattgaaagacaatatgtaattatatgctctgcacattagaattaatgacatgcataggtgaaaggcaaatgatggaaaaagatatcccatgtaaaaaaaataacagcacaggtagctatactaacagataaattagattttaagtcaaaaactgttaaacgagacattaaatattgctaaaaggttcatttcactaagatgaaacagttataaacatatgtgcaccaaatatcagagttccaaaatataaaatgtaaatactgacagaattgaagggagaaatatacagctctccaataatagtaagagactccctacctttctttcaaatgcataggacacccagacaaaagataaataaggaaacagataatttgaagaacattatacaccaattcaacctgagagacattgacataactctccgccccccaacagaatacacattttctcaactgcacatgaaacattcttcaagacagaccatatattaggccacaaaacaagtcttgataaatgtaaaagtttgacaccataaaaatatattttccaactacagtctagatcataataactagacatcaatagcagtataaaaagtgaaaaaagcctgaggcgagaggatcacttaagtctagaagtttgagaccagcctgagcaacatggtgagactctgtctctaccaaaaaaacaaaaaacaaaaaggctgggccgaggtgggcagatcacttgaggtcaggagttcaagaccagcctggccaacatggtgaaaccccggctctactaaaaatataaaattattcgggcgtggtggtgcatgcctataatcccagctacttgggaggctaaggcaggagaatctcttgaacctgggaggcagaggttgcagtgagccgagatcacgtcattgcactccagcctgggcaacaagagggaaactccgtctcaaaaaaaaaaaagtatatatttgctagttttgtcagctgagagggtcaagaataaaaaacactaaggtagcagcgatcatacctagcactcagttctttgtttctaactacattttccacaaataggaaccagaagtcctaggagaaatatctgatctcatggctagggtagggaaaatacccaatgaacttgaaaaatacctaatgaacttggaacacacagtatcagaaagtaaaccagtgcacaaagagctcatatcatgatgaacaggaggagccagaaggcaagaggggactgcttgaagaggattttactggcaaaatctgagacaaccagagaatcaaaatacataataacagtagtagatgtgaactcattaatataacaagaattcacaaatccacactggtataaacaaataaataatatagatggaaagctttttcttagagcataatgccaaaaaatcaacatagaatgagttggagtatctcagtttttcaccagatagtagtaactttttaggggaaaaataattttagagtgcagaattctggagagaaaccccttaatcaactgttcaagtttagcagcaccagtaatggataaaaactagtatctggtatatcctgagatcatgcactaaggacagaaattgatcataatccagaaagacataatcttgaatgttggaatcgctgaagatcaaaatgttaaaaatataaccctggaaaaaataattttaaattttttagaagatattgactgatttacatttctttcttttcttcctttttttttttgtttttttttctgagacagagtctcgctctgtcactcagctggagtgcatttcccttccttcctccctcccttccactttttttttttttttctgagacagtgtctcgttctgtcacccagattggagtgcagtggcgtgatctcggcctcccaggttcaagtgattcttgtacctcagcctcctgagtagctgggattacaggcatgtatcaccatgccacgcccagctgattttttgtatttttagtggagacagtgtttcactatgttggccaggctggtctcaaactcctggcctcaagtaatccgctggccttggcatcccaaagtactgggtttacaagcgtgagccactgcgcctggccgagatggagcatctcaataaattttgtcatttggaagggccgactagagcaacaatacagctgtaactagtatagaaatagcagtcagtcaattttcaaagagggggatgtgtggcattgtgtggttagcatagtaaccttgtttttatgtaaacacaattgtgaaaaggtatttttttagtttataaaatgaatctagaatgtgagacttcattttttaaaaaacaaaaatatagattgataagtgtattagtccattcccccattgctataaagaaatacgtgagtctgggtaatttataaagaggtttcattggctcacacagagtcctgcagcctgtaaaggaaacatggcagcatcagctcagcttctggggaggcctcaggaaacttacaaccatgctgcaaggcgactagggagccagcacttcacatggccagagtaggaggaaaagagcgaggagtgagatgctacacaattttaaacaagcagatctcatgagaactctatcaggagaacagcactagagggatggtgctaaaccattagaaacctccccggtgatccaatcgcctcccaccaggccccaactccaacactggggattacatttcaacatgagatttgggtggggacacagatctaaaccatatcaataggccaatgtatgtttatggggagaaaaaaatctggttatctttttttttttttttttttccgtgacagagtcttgctctgtcgcccaggctggagtgcagtggcatgatctcggctcactgcaacctctgcctctcaggttcaagcgattctcctacctcagtctcccgagtagctggaattacaggcacgcaccaccatgcccggctaatttttgtattcttagtagatatgggttttcaccatgttctcctggctggtctcgaactcttgacctcatggtccgcccgccttggccttcccaaagtgctgggattacaggcgtgagccaccgcacccagcccctggttatcttgaagaaagattttagatgggtttttttctgattttgctttattctattatttatttgtatcaaccaatgtaagccagat

SEQ ID NO: 12586 - DNA, 19416 bp, Homo sapiens
cacgggcactgggaatgcagtgccagcaatgctgtggcccgagtggccacctccacgaacgtctacgtgctgggttagtggctggagagagggccaggggctgggagaaactacttgggaatcgtttttggaggcccagaaagaggatcatgggtgtgggacccctgggatgatgatgggtgaaggtcagtggccctggggcccctgctactctgtacactccctcaggccctgaccaccatccctccattcccccctgcctaggcactagccctcatgttgtcaccaatgtgtccgtggtggctttgcccaagggtgccaatgtctcctgggagcctggctttgatggtggttatctgcagagattcagtgtctggtacaccccactgtgagtgacctgctcctgccatttctctgtgccaatcttgcctcctttcctctcctccttgaacctatctggccttctgccctttcttctgtccctctatccctcaccagtcctggctctgcttccctgtttccagattctgaggcattcagggccaaggtcctgagaccttggatggttgagcagaggggaggtggttagatctctggaccccagatcttctggtcttcctagctcacgaggtgccccccatgtcctcatgtctcccagggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaaggtgagaagcttctcgtcccagaacagcagagacaaggatggggaagggctgctgggagagctgggatatgggaggccctgggtgggaaggggcagaggtgctggccagcttggggtccagaggggtgtgtggaagatgatttgagcttgtcttcaggggttctgggagaagagttgggcactgggagttgtggaaggccaggggaggggcgctgggaatccttgctctgacctgcctttctgtcccacgcagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggtatgtgcgaaaggcgatacagagagaggcctcctaggggctctcctgcgtccttctccattccccaaactctatcttctcatcttgatttgagctcttcacctctgcgtcctacctcacccttccgtcccacgtgcacggtctttccgcgccccgctgggttgggcggtgctgggccctgacctccctcctggtaccccatccccatcgcaggatgttctctacgagttccgcctcgtggccttcgcgggcagcttcgtcagcgaccccagcaacacggccaacgtctccacttccggtgagcacctggcgtgagggaggagccccagggctgctccgagtccactgaccctccctcgtggacccctgcctaggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaaggtaagtccctccaccctcagccctgctactgcgcacttgggcctagcctccttaagcccctcctacctgggggaaaagccctcgctcctgtgtgatccaggtgcattctcttagtcctgcatctggtcctgcctacgcttttcccagccggatggggttgggcgcctggtgttgggtgagagagtctccgcctagagggccttgatttttgcctgtgtcacctactattctcatgcccttccagatccacctcttatcttctctccgaccgggaagtcagctgcaccgtaagtgcctccacctccttggctttcttctgcctttccattgtacgtgccagtatcttctgcttccttttttgcatctttaccagggggatgttgggtgttggggaggaacaaaagtgggagagggtaagaaggggtgtgcagtggccccagcctgaggccgttccagtatggcctgtgccttccctccacccctccaccttgttggtcctttcctcgcttgttcttcctagctctgctctgttgttcaccaaacctctcaaggcctgacgctggctcctgggagggggacctgcccctaccacagaccctgatctcctgtccttccccagctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagcgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggtgagagcagtccctgcccatccctgcctccgcctcagtcccaccccagacctctcacccctctcccaataccctgcaccttctctgctccactcccaccctgggaacgggaaaacttgtcccttttagaagcttttgctgaggtccagggatttttcaggggaaacccatgacctaacgtgagtttgcggtcgctgaattcagacttttctgaacagcctctattcctccacccacaccatatgtttgtctttttttttttttacaggaggaacacatctgtggacgagaactatgagtgggactcagaattccctggggacatggaattgctggagactttgcacctgggcttggccagctcccggctcagacctgaagctgagccagagctaggtgtgtgagccccccggaaaggcaggcatctcggccatactgtcccacatccccccgccaccttaggacccatctattcccagtcaggccctgcctcccaggctcctctgctctagactgtgccttgcccccttgggccatctgtactggaagggcctagcgagcttcacatctgagctcttcactcagtgaacctcagggcttcttctcattgtcctgcccgcctcttgcaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcacagaatgcacaacagtcacacagcaggtaaagggtagagcaggtggggagccagtcaaggaagggaaactgtcctaggcagaggaatagcctttgtaaaggcacagaagagtgagaatgcttgacaatcagtgggactggaatatagggctgtgtaggactcggggagggaacagagaataatagaaaggttggacaggactggatattgacatcctggaatctcaggttcaagggaggactctatcatgtgtgcagaactccaccccgggggactctattcaactgaagcctgaaaggatggggggctctttcttcacccctgaactgtgctgtcctccaccctcagagacaaaagaaccccagccagcctcctcgcgctgaggtctccccctctgatccctccaggatttaggaagagataccaggtcatagaaaaggagatgaaaggcagggagaagacaggtctgagccctgggtcccaacaccgaaaacacccctagggccctgggcagagtgacctcactgttagtccctgcccaggcttgaagtaagaggtgagcaagatcacgtgggggtgctgtcccggcctgcaagtcccagtcctgtcacacactagtcagttggggtcgggggaaggccttcctgtgcctccttttaccttgccagcctctaaactaggaggcttcttcctacataaacacgcccacagtgtttagctaactttctaggcagaaagtttcctactggggcacaagtctacgggctctcggtggaggctgaggtactcacgggtggagaccactgcagccgcctttgtagattcagactccccgaacctttaacccttgctctggtctactgtccctctgtctcaagcagtcctccctccttctgcgctgcggcgcctttaaaccttcttggcccttgccccgccccgggtccgccccgtctgaggcgggaccctcctgaaaatccccggctgggcagggcgcaccacttgcagctgcagcccttgccttgagtcagtgcgcygctctccagcccgcttgaacggtgagcaggtcgggggtacgggggtcggggacatgtgcgtgctgtgtagaaagcaagaagccagcgctttgaacttgctccagcgagctcggggatcaagggctggtaccaggcaagrgtccggtgactrctttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatckctgagtcctcactggggcgaggggaaaaaagggcgtcggactttagctggctggccccgagtgaccccgggtcgtggcgccggccctgggccagctcgtgctcctgggctttyccgcgcgacccttcacttcctggttccaggagcacgtgtgagcactgcgtgccctctgagtccccgaggccgcccttttcattcctgttcctgctagcttgctattctggggacttgaggtcacgggctggggctagggggctctgcatgggtcgcacggtgaccttctgtgaagctccagtcatctctatgacggtcccctgacctcgggggtctgggtgctgcagccctgactgcgccccggggtgccctgtgtgaggttgtgggggtggtggtggctgcttttaccctgcccgagcgccgctgcccccaccgggtgccccctgctgctgggaaagccggtggtggccgcgggcggacgggcgggctgcccagaccactgcgtcaccccagcggcgggagggcggtgggtgactcatctgttgtaacggcccagggtgtggtcgtgggggtggggggcggcggctgggaggccggacctgcaggaccggaggtggactgccgcctccccccgcgccctgtgcctcctggggctacctgaagccggtgtcctgggagatctgtgagcagttggtatctgtggggcagagagaaacggggtgagagtggggatggagtgtgggattcgatgtagaagacctgcggctgggacggggctcccccagtgttctcattgacttcaaagcaccagacagcaatrgctctctatctctagccccctcccagtttctcctccccactacaaggggcagacctacaactgcagaggaggccaaggcagggcgggcccagtagggccctaccattccagaaccaacaaataggttttgtccaaccgcaactccctccctcaccccaaggcctctgcccctgtcccccaccccgggattggcccctaatcctttcttcattccatcccttctccctccagaattttcagctgtgggttctctagctcagaacactttcccttcccaggggatttcttctcctgaacaactacttcctgmgtcctcttcttcaccccaacacgggtcatttcctatcttcccccacacgctgtccatccccactatagctgtctcctggaataatctcttgcacctggctacacccgagcactgctgagacgatcccacttctgctcccgtgctcacagcctgctcaccacaacgtctgtgttgacagggtgtttctgcccggagcccccacccagcctccaacactgtttggtacacagaagccatggcaacrgcccccacctcatcccctcctcccacgcaagctttggagcttcctgtttgtgtagcctcagctttctcttctgctcctgactctcggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgaggtaagcttccagcccagggtctgggtggggccgagtgccttgcgtggcccctccccgtttcccgcctattgtaactccagggtgagggtgagggttgttctcacagctgcagtagcgctagggtttaggttgctccctgccagtccatcccccaggttgttcagctgtcaccttcctttggggtccccagctctgggggtcccccacacctgtcttccagctgggcatatctcttctcaccctggtaggcaacttgcttactgttttctttatgtttgagggaaggcaggggcaggtcccctgggtgtccctagggtgggccttcccagctccagcagccrcagcccatsagcttctgcctgcccgtgggggtggggaagagaaacagctgctgaccaggcctggcctggttggaactgccccttctcaggaccccgccctatggytctggcacctcagagcttgagggcaatggccccagagtggagcagatacastgcagctggaggccgtgaccctgccagctgtgtccaggccccagcgttgggcggtggagggggttcctcagcatccactttccacccagtggtgggtctgggaggccaagtttgtcctgccttggggggttggggggcactggaagtgtctggcttcaggcctttctctctgctcttaaccccagtgtctaggttaatcattctcctgccctttctttacctgtgccatggtgatccccgagcctcaggccacttggtccctggaaacagccctgagcacagccactcccaggagagaggtctggaactgggctgcggaaagggggcttactggtggtagtagctcttagccccttcctcttcctacctgtcttccagccattcccctgtgcatcagaggttagaggtttctatggtggagtggcctctgggaagggcagggatgcttctcttggtttctcctcagaactcagccaccccaccccgcctgccttccccaagctgatggtgtgtgtgcctggcgctgtgggtcggggcccagactgacatttatctggcccagctttcgggctgggggaagtggagggggcgggttgctcttaatgaggtttaaaaataactgatttaggggaggatctgcyggaaatgtgcagcttgataagctggggtaaaaaggagcagccatgttggagtcgggacgggagggactggcccaagacacagcctctgcggccgagaggtgttgagggtttgaggcaggctggtccccttgtatttcgcagagccccaaggtccattgagagggggtgacrggattgtttaacctgggtgtgtgggagagggggagctggagtgacttcatccctgaaggccaacctggcctggagccagatgtggttagaaggggtggctctctttcttccccttgaacgcagatgcctgtcctgggggtcccctttcgtgagcagcctgacagctagctctgttttggagaagagagaaaagccaaaccagggtggggatgggacagaaaatggggactgtggcccattcttggttcttggctccccttggcatccataccatgcccgggtcttgctcagcccctgagtgtcagacccaggtggtgagtgtggtgggaacacactgccacagtgaggtccgccaactcaggccattggtcgggaaaccacccagttcttgctaatcaagctcctccaacgaagttaaagaaaccctcctgtgtatttccccgtcttgccttctcttctccaggtttccccaaaaatatcacccagggctcctgtattagtttcctatttctgctgtaacaaattgctacaagcttagtgatttaaagcaacacaaatacagcatcttacagttctacagactcaacaggggtctcactggctaaaatacaggtgttggcagagctgtgttccttctgggggtttttgggtgaatctatttccttcccttttctggcttctggaggccacctgcattgcttggttcatggccctgtgtgactctgacttctacttccattttgttgttgttgttgttacttctcccactctgactcacctatctcccactttcagttagtaaggcccttgtgattacactgggctcatttagatgatgcaggataatctccccatttcgagatcttaatcacatctacgaagtccctttttgtcatataagataacaatatccacaggttctgggaattaggacatggacaccttttgcgggggcatgattctgcctgtcatagctcctagaggggaaagtagaatttgtttttattgcctggtttttcataggaaattcgatttgtttgctgaaatccctcaaggacctattcaagcctacctcttccagaaagccttcccaggctgcttctgcccgtctgcttcttttaactcctacaacatgtgatctgaactgtgcactttagtattctttgtgtgcaatccttacctgttcatatgtactcactttgtctccctgatggcactgtgggcacttgaggaccaaggacttctactatctctttcacaatccctagcacagatagtaggtgctcaattaaaatccagtggtttgcaccaacctagatggttaaaaaaaaagcaaagaaaacccagaggttgagggagggtagatccaaccagtttcctaagctgttccacattcctcctcctctccccaaatcattctctttcccagggctataaagagcagggttgcatttggtarcagttctggtcctcatccttggggctcaccgtgggggaaatggtgtatatccctgcaggcagaattcctgaattccccactccccaggctgcaaggtgttgaccaaaagcccgggtgtgtcctctccctagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgagagccgggccccactggcttggaagtgcagggagagcaggactgggtccagtggactggggattgtttaacctgaagaggagaagactgaaggcacacatgtcccagcctcttcctcagcttgaaggcctttgtcaaggatgtgagagggcccatgctttcctcccttcccgtggagtggagggtaagggtgaatgtgcctcccaggcagtggaagactgaggtgacactgaggaagaatgtctctaaggaaagaactgtgggagggtatattagcaaggaaagactaaacactggcttttcactctgggctcggaggaaggaggctggcaagaaggactgtgaggcttactctagtgaaagagtccaagctgtcttcaggcaagacaggagcctctctggttcattgtctctggttctgagggtggtgyacgctgagctgcgataggtaggcatattctcacctttccacccctgctgtcctcatccaggtgctatgtgagctcattaaygcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggtgggacagggcgaggggctgggtcctgtcatccaggaggccagagattgggctgggccctcttgaccaggcagaaggggctgttttctggctccctgcagagaaagaggggtgtgtttgtgttccatggagcacttggtcatattggaggctggaatggagaagggtatggaaatgaacagtagaaataattaggaagccaggcctgctgacttagcgatagaggcggaaccctggtatctaggacactgcggaggctgacacattcccattctccttcccaggaaagaacatggcctgtgtgcagcggacgctgatgaatctgggtgggctggcagtagcccgagatgatgggctcttctctggggatcccaactggttccctaagtaagtattgctgggacagccgcagggtccagcaggtgcattgtttctgcccaatcctgtccctaggaaataacttatctcagtagcagctggccctttacaaagcactttcagaaaattcctcatctcacttaatcctcacaacaccctctgggatggcaaatgactgtccctttggacagatgaggaggtggcttcagagagcttatggctctcgagggcagagctggcaccagcccttgagccaacagcaaagcctgtgctctgtccaaggaagggatttactagggcagcctgtgatctcctctaaccaccactcccttgtcacccaggaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtytggggcttgaggaagatgagtttgttgatttaaataaagaatttgtcatttttgaatggactctggctgtgtctggggccactgtgccactgtggggaagggaggaatactgggcaaagtgcagtgagtgatacaggaaggagggcagagatgagaggttgcagtgctaacccctgtcttgagtttcctccccatcctcattctcacttgctttggggggtggtgtaggttggaattgagaggggacaggacctcacagctgaatgcagactatgtaggcagtgtccacagggaagtaaggccctttctagtcaatggaattggctaatcctgcctgctgcctttggctgggtctgcctctacagttggaacagcttctcagtcactgagagggtggggctggctgctggcacagccatcagtcctggcaagtgaagctgtctccaggtgagaggtccctcaggcgggcttggggtgaggtggtctgtgttggagtggtgagggtgggggttgcagtggtgaggaaacgtggagagctggggaatgagcaggagtgagttggtggtggtcgctggagggaagaagccgtgttgattgatcctaagcacctgtgaactaagtgcctgggagagactaaaacttcctttctagggtgtggccttgggccatgatcatcaattttgggtcaggttgtctctagcacctatccttgaccgaggcatgagtgttccacccacagtttctttttttttcttttcttttttttttgagacagagtcttgctttgtcacccaggctgtagtgcagtagcatgatcgctcttgttctccaggctggagtgcagtggcatgatctcggctcactgcgacctccgcctcccaggttcaagcgattctcctgcctcagcctcctgagtagctgggattacaggcatgtgccaccacgcctggctaatttttttgtatttttagtagagacggggtttttccacgttggtcaggctggtcttgaactcccgacctcaggtgatctgccagcctcggcctcccaaagtgctgggattacagatgtgagccaccgtgcctggctattttttgtattttttatagagatggggtttcaccatgttggccagcctggtctcgaacccctgagctcaagcgatctgcctgacctcatggctctgccttttcttgccatctcccaactccccagcctcagcctcccaaagtgctgggagccccacccatagtttctaaccactaggtgttacctttaccccaaggcttcccagtcagactctgtgtctccccagggggaatttgagggacgctgggccagtctgacattaagttccagccccatcagcctcacccagaggcctggccttccttgcccctttccccttttctacctgagggtatctctgtctcctaggaggagaaagccacaacactgtgcctgagggaaacaggtttgtatccagagcttttgttctctccccttttgttcccctgcttctctgaggctccctcttccaaaaagcacccactaggggcgaggcccaatgccaattcttcatagccatggctgtcagcctcatccccacaccacgcttagccttgccacaccacacctcgggagagactgtatttgcttgcttgctgcactcccacaggctgtggcacagataagataggctgcagcctatgggcaaattcccaggggattagatcctttatctctcattcaggaaggctttgtggaatgctagtcagggagagtgatgtcattgcagagaaaacattgaattcgctatgtatactaaaacaacaagccgtttgccaccttccctggtttaactatttatagctataaattattggccacacgcctcacaactctgagaaatgccatttgttacagtgccagcgctgagaaccactgccttctcccagaagattctcacaaacgcccaggaggtggatattactgtaatgtgttccccattttgtctttagatgaggatactggtctcagaagggccaaggaatgtgcccagggccacaaagcaattaagggagaagcagggatttgcatccaatcaagctggctctgaacctggctgagcctgtgcagctctaggctcagcaagaagtgaagctgtcaagggactaggggacagaggtggtggtgggtggcagggcaatgctcctcatctgtaagctgaagatgataattccttcctcgtgaagttgccgtgaggattagatgaaccctggaaagcactttgcatggggaatgctagcacatagtgctcaggaaatggaagtgtggggaataaaaggtggaacatttgtgtatggaccctgggctgagagggagctgatgcccagcagtttcatgcccttcaccactgtcctgttgaacacgggccaagatgctttcagtggccttatcccctttacctggaacagcttattttcaagggagacaccagctgtatttgagaggggctcagccattgggctcaccttcttctggctgcacccaccaccacccaagccttgtgaggaatctcaatgttcccttaattcatctaactgcagactcagctgcttccttctggagccggcctccagtggcatctcaacattttccagctttctgtttgtctgctttctagcattttgtctcacctgaggttacaatttcatccttaacttggcttctctcatctctgaccccacttcaggccctggggcccagactaggcaccagcctgtgtatggttctgccttttcttgccatctcccaacaccttattctgtgtggctgtctacagtggtgtctctctctctttttttcttacatttttctttattattattattattaattattatactttaagttctagggtacatgtgcataacgtgcaggtttgttacataggtatacatgggccatgttagtttgctgcacctatcagctcgtcatttacattaggcatttctcctaacgctatctctcccccagcctcccacctccacaacaggccccggtatgtgatgtttccctccctgtgtccatgtgttctcattgttcaactctttctttctttctttctttttttttttttttaactttaagctctgggatacaggtgctggacatgcaggtttgttgcataggtatacgtgtgccctggtggtttgctccacctatcaacccatcacctaggttttaagccccgcatacattaactgtttgtcctgatgctcaccctcccctcgccacaccccttccccgaccacagaccctggtatgtcttgttcccctctctgtctacgtgttctcattgttcaacgcgctacagaggtgtctcctaacactctgcacttgcagggcttctcctgccgcctggaacaatctccttccaggtgctgccctcacttgctcctttatctccttcaggtttttgtttagacgtcatcttccctgatcacctcatttaaaactgcacacttcaccctcagcctggaccccgtgctccattcctgctttcttttatcaccacctgacacccaatatattttacttatttattttctgtccccacccatagaatgtaaactacacaaaggcaggcttttgttggttttgctcatgtagagtagtggttggcatgttgtaggtgctggataaatatttgttgaatgaatgagtgagcatgacaccaccctcatgctcctcagccccctggcttggcaacacagtgcccagccagcccaagggcctagcaacccagcctttcatcatatctgagatacagcccagctcatgtctctgcttccaatgcttccagattattcatttccaaaaaataaaaacccaagaagctgcatttcctacagatagaggagaggaggttggagggtggattgcatgctctggacacatggaaggtgatttgaggatttgggggaaaaaaatgggaggagggcaggaggaagaggtaggagccagcttgggttcatttgctccttgccttcagcctggaagtggaaaatcactgtggaggtggagggaaagtaggcttggcccatgatggccaatggaaaggagagttggggaagggaggcagagaggaggaggaagagggggagaaggaagaaggtttcagatgctccacccagtttggctcacctgtgggtaacaagcgtagctctctgcagcctattcatatgcgtgtgagtgtgcatccaggtgtgtgagaattctcagggctagggctgggggccagggggtggggtgcggtgcaggtgggaggagataatctgtgactgtgtgtggaggctgcctatgagtatgtgtttaccaaggattggggataatgggtgcagagaggtgtttgtcctgcgtgtgtaggcatctgtgtgtttgtacatggttccgtggagaataatatgtcccattcctgcctccacagctgaaggaggcctttgagagcttggcagaaggcccaaggagcagtggaatggggaaagtgctggatgataggaccccagggagggaacaataaagggcctgggattaaatttgttgaagaaaaggctaaaagggtgaattaataactgtcttcttgcaaagaaatggattttagtccctgtggccagggaggtagattagaagaaaatgcaccaaagttgcatctagagaaatttagattagacaaggaaaaatgatcctcttgactctgaaggttattagcctttggaatctcttaagggtcaggaggaatgtcttcaataataggacaaaatgcatcttcttgcagaggaaaatgggcagttctgcctgggaatcgtcatatacacactcatttttttcattcatatattcattcatttaacaattattgagatcctactttatgtcagggtttatggaggatgtggattattaatacatgatctctttgctcaaagagtgcatagttctgtaggggagatacaacacagatagaagccatactatttatttattttttgagacagagtctctctctgttggccaggctggagtacagtggtgcgatctcggctcactgcaacctttgtctcccgggctctagcaattcttctgcttcagcctccccagtggctgggattacaggcgtgtgccaccacgcccggctaatttttgtatttttagtagagacgggatttcactgtgttggccaggctggtctcaaactcctgacctcaggtgatccacccaactcggcctctcaaagtgctgggattacaggtgtgagccaccacgcaggccagaagccacaagaatttaggaaacctgtgacatttgcctttggagaaatgcaaatagggctttttgggaagactactgcctccctctcaatgctctggatgaattcctggatggtgactggtggtgatgtcatggggagctgaggccgcgtacctcagggatcatctcccctgatcagcccaggggagtaggagagccagctggggggactgctctggaaaaaggagcagtccctggctttgtggtcagaagtcaagtttcagtgtggagcgaggggctatttctttcctgcctggggtggggaagggcaaaaaggcctgagtcagggtgagaaccagggatcaggtaaggacagatcaacatcaatggagctgggggtaggtctgaaggggttatataaacacttcctcagacactgggactgtcagctgtttcacatcattgctggcaggacctgaatttttttttttctttttcttgagatggagtcttgctctgttgcccaggctggagttcagtggtatgatctcggctcactgcaacctctgcctcccaggttcaagcaattctccctgcctcagcctcttgagtagctgggagtacagatgcctgccaccacacctggctaatttttgtatttttagcagagatggggtttcaccatgttggccaggctggtctcgaactcctgacctcaggtgatccacccacctcagcctccca

SEQ ID NO: 12587 - DNA, 45836 bp, Homo sapiens
gccacaagatgagccagtttactgatatggcagatgtcagctgatccatcaagtgcagggtctgggaaatatctcaatctctgatcttaggttttacaataatgatgttatccccaggagcaatatggggagggtcagaatcttgtagcctccagctctatgactcctaaactgtaatttctaatcttgtggctaatttgttagtcctacaaaggaggcaatctagtccccaggcaagaagggggtttgttttgggaaagagctattactttttttcttttttttgagacaagagtctcgctctgtcgcccagactggagtgtagtggtgcgatctcaggctcactgcaacctccacctccagcaattctcccgcctcagcctcccaagtagctgggattacaggtgcgcaccaccacacccagctaatttttgtatttttagtagagatggggtttcgccatgttggccagactggtcttgaactcctgacctcaagtgatctgcctgccttggcctcccaaaattctggaattacaggcgtgagccaccgtgcctggccagagctgttatttttgtttcaaactataaactataaattaagttcctcccaaagttagtttggcccactcccaggaatgaacaaggactggttggaagcaagatggagttggtgaggtcagatctctttcactgtctcagttataattttgcaatttcaacttaggaagaaataaaatacagctagcttgtgggtattcgataggtacacaaattttctacctttcaggcatgcagaagggaattctgctaaaagcatgccacagtctctctctttttttttttttttttcagatgaagtctctggctcttgtccccaggctggagtgcaatggcatgaccttggctcactgcaacctccacctcccaggttcaagcggttatcctgcctcaacctcccgagtagctgggattacaggtgccggccaccactcctggctaatttttttattttcagtagagacagagtttcaccatgttggccaggctggtctcgaactcctgacctcaggtgatccgcccgcctcggcctcccaaagtgctgggaatacaggcatgagccaccatgcccggcccagtctcttctttagtttactttcatgttgaatttcacacattttagatattagataagttgtgttaagtttaaaactaggaaaataagctatttcttagagaccagttcaagttcatggttaaaaatattcataaaattgtgtattccaccttcatcactgtcagggagaagagattctcctggacatgaggtatggaattcatttcttttactgcagtacattagatagtaagcatcaaggctgggtgtggtggctcacgcctgtaatcccaggactttgggaggctgagggggtggatcacttgaggtcaggagttcgagaccagcctggccaacatggtgaggactaagctctgatttttttttttttttttaatcttcctatctaaggggactggggagttatgccttacaaaccatgacttctcatcagatgggttttatttaatcatgtatatcgtgacttactttccaatctgactctggcataacaagaaaatcaaaatgttttaccccaaaatacatttccttgccataccttgaaattgccctgcaaagtcttttgtgggaaaaatgcacatcctatagagaatcccttttccctttgttttccttcctttctttccagatccaggagataatcaactaagaagcaggcacctttttaattcctgtaagaaacattttacaacctgctctctctgaagtcttttatctgagcgcttcctctgcccaataaaactccgtctccacaatcttctatctaaacctgaacattccctttgatcccaggtcttcagacaaactcaaccaattgtcaaccagaaaatgtttaaatttacctatagcctggaagcccctgctttgagttgtcccggctttctaagccaaaccaatgtatttgttaaatgtatttgattgatgtctcatgcctccctaaaatatgtaaaactaatctgtaccctgaccaccttgggcacatgttctcaggaccccgagggctgtatcacaggccatggtcactcatatttggctcagaataaatctcttcaaatattttacagagtttgactcttttagtcaacaatggtgcaaccctgtcttaaaaaaaaaaaaaaaaaagatcagccggctgtggtggcatgtgcctgtaatctcagctactcgagaggctgaggcaggagaatcgcttgaatgcgggaggtggaggttgcagtgagtcaagattgtgccactgcactccagcctgggcgacagagcaagactccctctcaaaataataagcaccagaaattgttatatttgcttcagtaaatagctggttacatatgtccttttttgtttgtctccacatgtcttctgcatggggtgactaggttctttgaggttcacataaaagagaaaatgagaggactgaagtatctatactcttggggtccatctcatttggcagtgcaaggaaggggaattggggtggatgggtagtgcagaggttcttaattattcccagggaggacatttagaggtctgttccaattttatgtgtgtgtgtgtgtgtgtgtgtgtgtgtgtgtgtgtgtgtgtgttgcctcaagttgagagattatttctatttttaaaatgtttaatttttctattgcattgtgttatattgacaaagtcttgctcactatagcctagaactcctgtgctcaaatgatcctcctgcctcactcagcctcccgagtagctaggactacaggcacatgccacaatgtggggctaattttttttatagagatgggtgtctcactatgttgcctaggctggtctcaaactcctggcctcttaacagtcctcccatcttggtcacccaaaatgctagcattacaggcatgagacaccacatctgcccccaaattttatttttaaaatgtttacttttccaaaattgtaatgtcgacggagtcaaactctgtaaaatatttgaagagatttattctgagccaaatttaagtgaccatggcccatgacatagcctcaggagatcctgagaagatgtgcccaaggtgtttgggctacagcatggttttatatacattttagggagcgtaagacatcaatcaatacatgttaaatatacattggttcagttcagaaagatgggacaactcagaggtgggggtggggggatggacctgctgtcacattggtatcttactgctacaaagtgtgtcagtgttaaggtctctgttttttttttttttcctgagacagagtctcgctttgtcacccaggctggagtgcaatggcatgatctcagctcactgcaacacccaccttccaggttcaagcgattctcctgcctcagcctcccaagtagctggcattacgggcccaccgctatgcctgcctaatttttgtgattttactagagacagggtttcaccatgttggccaggctggtcttgaactcctgcccttaagtgattcacctgccttggcatcccaaagggctgagattacaggcatgagccactgcaactggcctcaggtttactttagaatgcccttggctgagaggatgggcctattcagttggttggggggcttagaattttattttcgttttatagtaagaagccaaaggacacaacagagtgaaaaggcaacccactaagagggagaagatggggccgggcatggtggctcatgcctgtaatcccaacactttggaaggctgtggcaggaggatcacttgaacccaggagtttgacaccagcctgggcaatacagggagaccctgtctctaaaaaaaaaaagaaaagaaaaagtgggagaagatatttgcaaatcctatctgataaggtggttaatatccagaatatataaggaaccaaaacacaacaaaaacccattaaaaaatgggcaaagccaggagttcaaggctgcagtgggccatgatcatgacactgcacttcagcctgggtgacaaagcgagaccctgtctcttaacaaaacaaaataaaacaaacaaaacaaatgggtaaaggacttgaatagacatttctccaacaaacatatacaaatggcatgaccaataagcacaagaaaagatgctcaacatcactggtcattagcgaaaggcaaatcaagaccacagtgagatacctcacacctattaagatggctactatacaaaaataaaaagatgtcagtggagatgtggggaaattggaacttgtgcactcttggagggaatgtaaaatgttgcagccactatggaaaagagaatggcagttccgccgggcgcagtggctcatgcgtgtaatcccagcactttggcaggtcgaggtgggtggataacgaggtcaggagttcgagaccagcctggtcaacatagtgaaaccccatctctactaaaaatacaaaaattagccaggcatggtggcaaacgcctgtagtcacagctactcaagaggctgaggcaggagaatcgcttgaacccgggaggcagaggttgtggtgagccgagatcgtaccactgcactccagcctgggcaacaagagtgaaactccatctcaaaaaaaaaaaaagtacggcagatcctcaaaaaattaaaaatagaattactacataatccagcaattccacttgtgtatatatattcaggagttgaaagcaacagatatttgaacatctgtgtgtatacccaaaagggttaaaaaacagatatttgtatatccatgtttacagtattatttcacagtagccaaaagtggaaacaacctgttatccattaacagatgactgaatgaactggtatatacataaaatggaatactattcagccttaaaagaaattctgacacgttaccacatggatgaaccttgaggacattatggtaagtgaaatcagttacaaaaagacaaatgctgtatgagtccttatatgaaatacctagagtagtcaaattcataaagacagaaagaatggtagtcgctgggaaggagggaggggaagaatgaggcgttaccacttactgggtacagagtttcagttttgcaagatgagtgctggagatggatggtggtaatggttgcataacaatgtgaatgtatctaataccactgaattgtacctttaaaaatggttaagatagtaaattttaccatcttcacagtttcccgagattgcaaggccagcagttaaagacaaaaacaaaactatttccaactgccctacagtgtgcagacctttcccttgtcctgccctgagtagaactacagttgtcattcgtgatcctccctttaaaaaattatgcttgtggctaggcgcggtggcttacacctgtaatcccagcattttgggaggccgaggcgggcggatcacctgaggtcaggagttcgagaccagcctagccaacatggtgaaaccctgtctctgctaaaaatacacattagctggatgtggtggtgcgcgcttgtagtcccagctgctcgggaggctgagagaggagaattgcttgaacccgggaggcagaggttgcagtgagccgagccgagatcgcgccactgcactccagcctgggcaacactgtgagactctgcctcaaaaaaaaaaaaatcatgcttgcgtttcatggcgaatgttacacattcaaacttatcaaatatattaatagtaagaaaataggtttcctatccgttgtatatatttgagttccaggcgagatttccttcgcagaaagagttccgcagatgaaaagtaaaagaaaatccgcggcgaaaataacccgcgcgcagaggccggtcccgctactagccccgcccaatcaacgaggccaatcagcggcccgcaacgggggagggacacgcagccgtcagccgaacaattcgatgacgaggcccaggaagcacgctgaaaccctgggcggcggcaagctgtgcgacctcttctgcggccggcctgggcaggtgtcttcctcgagaggcaggcaggggatcccggacgtgagtccgtgcagttgggtgtgttgtgcggcgggtggggcgggttacccgccgttacgccctggcgggtccagcggactcgcggcgcagacgctggggaggccgcaggcgcgacccggggcggggaccgtgctagctgcgtgcgtccgctgcggcctgtgggtgccccgggctcctacctcagctcccgcgccggcggctgcctgtccgccgcggttgcgcgcgttccggggaggtgcttggcccagagagcggcctacggagaaggcacagcgagggcaaagcgagacctgrgcgcacgttgaattctgttggctttggttatctctgaaaactttaagcataatttgaataaatgctgtcagcagaatagctcggatttagttgtagttaattttctaaaacttcaaatctgtgaattaacacagttaacaacaacaacaaaaacggacacaaaacaacctccaaawtggattttttttttttttttgagacggagtcttgctgtgtcacccaggctggagtgcggtggtgctatctccgctcacggcaacctccgccttccgggttccagcgattctcctgcctcagccacctgagtagatgggaccacaggtgcgcgccaccaggcccggctaatttgtaaattttatttgtagagaaggggtctccctgtgttgtccaggcttgtctctgactcctgggctcaaaggatcttcccatcttggcctcccaaagtgctrggattacaagcgtgagccattgcgcctggctccaaatctgatttgagtgtaaaaagttagacacaccataagctgtaggtttattactgggtggtgaaaaacaattcaggttttctttataatagtgattatgaagtgttcttcccagactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccaggttagtcttgcctttcccrttactcatgtgctttcgttgaaaccaaagactttttcttttgtgcccatttctactcactgcctggccgtctgcacgacgatctgtgtttcctggtagttctccagtctagtagctactataaactactctccctatttcccgctctgtggagatgtcgttccaacaggtcctctccactctaagaccctatcctctcagagaagcccctgagagccattagtacttttgccctggagaggcagtttaggtagagccagtctgggttctaccacttactagcytggtggtcttaggcaagttactttgtgtgatctgtaaaatgaagatgagtgaagataagagtactacttccagtagttttgtgaggattaaattaatgtaacagtgcttagcacatagtaacaaaatattagctacttttttttttttagacggagttttgctcttgttgcccaggctggagtgcaatggcgcgatctcggctcaccgcaacctgcactctctgggttcaagcaattctcctgccccagcctcccgagtagctgggattacaggcatgcgccaccacgccctgctacttttgtatttttagtagagacagggtttctccatggtggtcaggctgggctggagctcccaacytcaggtgatgcgcccgccttggcctcccaaggtgctgggattacaagcgtgagccaccgtgcccggcctttagctactattatacatattataatttaaaaattattagtaccgaagcctgagacaggagagaaatggtaaaaatagtagggactgcgggagagagaaagagtagtgtcccctgacaagtactagaatgacataggtgccaccattaaacgaaactagctaggatggttactttcgattaacactttgctactcaagagtgtggtctgcggcatcaccaggagcttgttagaagtggagatctcagacctacctcagatttactgaatcagaatcgtttttttttttttttaacaaactcttcagcaggtttagatgtagctttgtttggaggaagtgtgagattcgttttaggatttctcaaggagttccagccttcaatcagtgaccatggggatctggcaggagggcttgaatttctagctgattcttctattctgtcttaccctcctgtcttccatcatttctgcattgctaatctctatccctggagaaatctatggaactgctggttattactgtagaaagtaacatagttgccartagtacgactttgtggatgtcacagtcaaaactcaactgcctggctggcacagtggcwcacctgtaatcccagcactttgggaagacaaggcggcgggcagggggatcctttgagctcaggagttcgggactagcctgggcaacatagcaagaccctgtctctataaaaaagaaaaaaaaatctcaactgcttgacaggctttttattcacttccctttgtakaatgcctcctgtagtaccttttttcccctccaaatctccgtttcccccatcctaacctcctcacagtgttagaaatgcaaattactcttaatttctctgtccacttcatatcatattataatatgaaatctgtcagtttctctttttactttagaaattttgtcttcatccatcttcattcatttctatttatggagtatataacctcattgcctatgaagaacccttcccgtaaccttaatttcatgcactcccatcttggagcctctctccagtttacacactccctttgtcacctacttcttaaccacttagagaattaggcttctcactgtcattctctgaaaggtcataaatggccaactaattaaccaatccaatggcttttttccagactttgttcctctccacttctctgaagtattgaatacgcttgataccactttcttgaaattaagtccctccttagtttttgcccattgcatattttggcttgtcttctattgccctgattagccttcactctcctctctggtatttgcttcttccatggctttcttccttagttgaactcttaattttttccaataaagtatacagttattcagtatttctaagtatctccagagcataacagtgattttagtgttttttgtttgtttgtttgttttttaattgagtcagggtcttgctctgtcacccatgctggagagcagtggcgtgatctcggctcagtgcagcttcaacctccccggctcaagtgatcctcccacctcagcctctccaagtagctggaaatatagacgtatgccaccacacccagctaaattttgtttcaagttttgtagagatggaatctccctaagttgcccaggctggtgtcgaactcctgggctcaagtgttcctcctgccttggcttcccaaagtgctgggattacaggcgtgagtcgccacaaccggccagaaactattgttctatttattttgtgcagagctttggttgttcaggcaggagggtaaatctggtccctgttactccatcttggccaggagtaggagttggggaagtgctttgggagtatagagtcccccctttacccttggagtatacattctaagatcctagtaaatgcctgaaacttcagatagtactgaaccttgtatatattctatgttatttcctatacatctattcctctgctaaagtttaatttatcagttaggcacagtaagagattaacagcaataactaataaaatagaaaaattataacaatacacaataataacagttatgtastgtggctggaattttttcacttgaggtgcgacagcaaaactagcatgaatttctttctcctcctgtacaatttcatggatacaagttttgttcttaacatagatcttagcaacctcatcatatgagcttttttttctttaatttttttttttcttttgagttggattctcactttgtcacccaggctggagtacggtggtgtgctctcagctctctgcaacctctgtctcccaggctcaagcgattttcctgtctcagccattcaagtagctggcattacaagtgtgtgccaccatacctggctaattttcatatatttatttatttatttattttgagacggtgtttcactgttgttgcccaagctggagtgcaatggcgtgatctcggctcacctcaacctccgcctcccgggttcaagtgattctcctgcctcagcctcccgagtagctgggattacaggcatgtgccaccacgctcggctaattttgtatttttttgtagagatgggatttctccatgttggtcaggctgatctcaaactcccgatcttgggtgatccgcccacctcggcctcccaaagtgctgggattataggcatgagccactgtgcctggcctatttattttttgagatggagtctcgctctgtcgccctggctagagtgcagtggtgtaatcttggctcactacaacctccgcctcccgggtttaagcaattctcctgcctcagcctcctgagtagtcaggactacaggtgcttacaaccatgcctggctaattttttgtatttttagtagagacggggtttcgccatgttggccacgctggtcttgaactcctgggctcaagtgatccgcctgctgggcctcccaaagtgctgggattacaggcatgagccaccacgcccagccctttattaagttgagaactttcactttttcacttaaaggaagcactttatggcttctctttgacatatctgaattgccagcatcgttactactgtgctttagggccattattaagtaaagtatagattccttgaacacacgcactgagataccacagcagtcgtaacccagatggatactaagtgactggagtgtgacacctacagtgtggacatcgtcccatgtgggatggaacaggacaggaagagagttcctcacactatccagagctgtgcataattgaaaacttaggaactgtttacttctggaattttccatttaatattttcagactgcagttgactgtgggtaactgaaacctcagaaagcawaaccgtagatggggttaccactgtagagttactgtgttaccttgatccaaaacctttacctgaatgattcctttaaccattcccggtaggctttctctgttaaagctgctgtaccaaatccaggggtcagtttgctgccctctgatcgcctgacctcttagcggcattcaacatatttgtctgctctctcctttcttcacttggcttctgaaattccaacctctcttggttttcttcctgcctcatagcactcactagaattatctcttgctggttcctcctcttctttctgatccccgaatgttggcttgcccaggactcagtcttttgtcctcataataaatcttctggtgatcttacccagatcatctcttttaaaccccgtctacattctgatcgttctcaaatgyagtcccactgctctccttagcttcatcctgcatatttataatctctacttggacatcagtggacacttcagatttactatatccaaacaaaactcttgatctttcagaacttgcagtcttcttcagtcttttcccttctcccagttgccctggccacaaacatagaaatcgtcccaaatcttcacttgtccttaccgacatccaaattttcagcaatttctatagtgtatttctgtattagagtagcaagagatgttataagaaataaacccctatatctcagtatatgccataaatgaaattaatttttgctcacatgaaagtgaaaagctatattcccacttagtgggtggccttccaggtggtcatttaggggcccaggtgcctgcatagtttggctgccctcctccagggctcagtgtcctgggaattccctggttgggagagggcagctgggaggttttcatgggccagacttggatgtggtgcatatcccttctatccgttgggttggctagaacttaactattacgtggccatacttcacagagaggctgagacatacagtcatcatttgtccagaaggaagaagaaatatgcctagtgacctattagctggtcattttgccagatgtagtagggtctacctacagattttaaaagtctgaccatttgtcatcacctttgctgctgtctttagctcatgtcaccttcatctctgaagtggatgactacagatcttcctaacctcctgataatcttccattctaatctctacatagtagccatagtaatgtcttttagaatgtaaaccagattctatcacgcccctatttaaaagcctcaagtggcttcttgttacacatagagtaaaaaccacactctttactgtggtctaccactccctccccgcctccccgcctccccgcctcccwgcctcccagctcattcccaagacccagctgttctggcctcctttctgttccttgactgcttcagcttcttctccactcagggcttctatacttgctgtgtcttctctctggatgttctccaaatcttcctaagattatcttatttttctccttaaatgttcttgtggttatctgcttgcatgtaacaaaccactctaaagtgtaatgcttttttttttttttgagacggagtctcgctgtgtcacccaggctggagtgcagtggtgtgatctcgcctcactgcaacttccgcctcccaggttcaagtgattcttctgcctcagcctcccgagtagctgggactacaggcgcgtgccaccatgcccggctaattttttgtatttttagtagagacggggtttcactgtgttagccgggatggtctcgatctcctgaccttgtgatccgcctgcctcagcctcccaaagtgctgggattasaggtgtgagccaccatgcctggccaagtgtaatggctgtaaataacacttttattactgctggtgatgttgtggttttatggggtgtgatggggctcagctggatagttcttttattctacatgatgttggctgggtcaccaagtcagtcaccagaggttggactggaaccaccaagatggctcacccacatggctggccattgatattggctgcaggctgggagctcagtgtgcccctgcacccagcctcttcgtgtgacttggccttcttacaaggtggcagctggcttccaagaggggcgtgttcccacaaacatatgttctgtcttaggattctccagagagacagtgagggtgggaggatggatggatgagaggggatttattaggggaattagctcatatgattatgggtgccgagaagtaccatgataggctgtctacaggctggagatcctggaaggccagtagcctggctcagtccaggtgtgaaagccttaaaaccagggaagcctatggtgtaattttcagtctgaggctgaaggcctgagaacctaggggctgctggtttaagtctgggattccaaagcctggagagcctggagttctgatgtccagtgacaggagaagaagggtgtccctgctccaggagagaaaagaaattccttttctcttttttgttgtattagggtccccagctgactgaatggtgctggcccctacagagggtggatcttccacactcagtcarctgactcacaaaccagtcttccctggaaaccccttcagacacatcagaaggaatgctttgcagttctctaggttttccttagtccagtcaagttgacacttaaccatcacatgttccaaagtgaagtagaagcaggcgaccctcttgaaggctaggcctagaaccatcatagccccacttcaaccaaaggattttggttcagtagtcacagggccagcccagattcaggagagggggaaatacactccatctttccgtggggagagtaacaaagcatttgtgaccgtcttagatcttaggggcctaccctgaaatacccagcatcgcctaatccatatgtaccactgtcttgctttatcttcttaggatttatcactatcttgagttacatgtttttgtttttgtttttttgccaacttactgtccttccttcccccctagaatgtaaccttcctgaagaagacctttgtctgtgtagactcctggtatccctgtaacttaagacagtgcccagcatggtggctcatgcctgtaacctcagcactttgggaggccaaggcgggtggatcacctgaggtcgggagttcaagaccaacatggagaaatccctgaccaacatggagaaatcccttctctactaaaaatacaaaaaattagctgggtatggtggcacatgcctataatcccagctacttgggagggtgaggcaggagaatttttgaacccaggaggcagaggttgcagtgagccaagatcgygccattgcactccagcctgggcgacaagagcraaactccgtcacacacacacacacacacacacacacacacacacgcaaagacagtgcccagtatacagtaggtatttggtaaatgttgaacaaatgaatgctgaactcgttccacaaccatattctcattatgaatttctttttaaaattaacatcaccatttttgttgctggtaggccaaggtctgtagaattgatcttcagagtgtgccacatgtgttctttctggttttcttgccaccactcttttaggccaagtaccacatcttttttctgcttcagcctctttgttggataatgaatccaggttttcctcctcctgtgcgcttagtgctggtggtggtggtggttgttgttgtttttgagaccgagttttactctttcacctaggctggagtgaagtggcacgatctcggctcactgcagcctccgtcccccacccaggttcaagcgattctcctgcctcagcctcccaagtagctgggatttacaggtgtgtgccaccaygcctggctaatttttgttgttgttgttkttttattagagactgggtytcaccatgttagccaggatggtcttgatctcctgacctcattatctgcctgcctcggcctcccaaagtcctgggagttagtcgtaagcttttttcctcagcagtgtcatcaccacccacccacctctacctctcaccgtatccatcctcgcaattgcaattgctgaagcatacactttgccctctgcctctcccatcttgagcacttaagatgttacccatacctcggattcccattcctgtgcagtctttccactttctagtttctccagtcggatgtgttttttttttttttttttgagacggagtttcactctggttgcccaggctggagtgcaatggcatgatcttggctcactgcaacttctgcctcccaggttcgagttattctcctgcctcagcctgccgagtagctgggattacaggcatgcaccaccatacccagctaattttgtatttttagtagagatggggtttctccatgttggtcaggctggtctcgaactcctgacctcaggtgagctgcccgcctcggcctcccgaagtgctgggatcacaggcgtgagctactgcacctggccagatgtgctttctttatcctttgaacctctaaaatccttgagtccttgctatggctttatttgcatttgctgcttaacaaacatttactgaatgtctttcacgtgccaaccactgggctgggtgttgaggttggggagatggagggacaagatagagaggccagtgggaaggtgacttcagatctaggtaagatactatctttccctagagaagttcacattaacagtggttttctgtcttggctacacattagaatcacttggggagcttaaaaagatcgaagtgcctgggtcctaatcccagagattctgatttaatggttttgggatatggccaaaacattgggagtttyagaagctcctcgggtgattctaatatggagccaaggttgagagctattgtgctaatggaagagacagaccgataaatggctaatttcattgcttccaatgccagaagaatatacagggcacayggggaacaggagtatttaatttagcctagagtgatttttattgtacaactagaccgtaagctgtttatgggcagggcccagggctttgtcatcttggggttctcttgcctgattcttatatgtagtaggtataagataggctgcccaacagaactttcttcgatgataaaaatgttcaaatgttctgtatccaccctgtccaatatggtagccactacccatatgtgactattgagtgcttgaaatgtagctagggggaatgaggaactgaattttaaattttatttaattttaattaaatagctacatagaggagttactaagtgtttaaattatttgactgtttatgcaggggcttaggtaaggcaggttattttctctgaatggttttgaagtttagtcactgcatttgaatcgtaaattcccacctttctttctttttttttttttttaaaggcagagtctcactctgtcacccaggctggagtgcagtggcgcgatctcagctcactgcaacctctgcctcctgggttcaagccattctcctacctcagccttctgagtagctgggattacaggcacacaccaccatgcctggctgagtttttgtgtttttagtagagatggggtttcaacttgttggccaggctgctctcgaactcctggcctcaagtaatccgcccagcttggcctcccacagtgctgggattacaggcgtgaggcactgcacctggcagtttcccacttttcttatttctcatttgttaaaaaaaaacagggggggccaagcgctgtggctcatgcctataatcccagtactttgggaggccaaggtggggtggaggtcgggagttcgagaccagcctgaccaacatggagaaatcccatctctactaaaaatacaaaattagccaagtatggtggcccatgcctgtaattccagccacttgggaggctgagggaggagaatcgcttgaacctgggaggcagaggttgcagtgagccgagattgcgccattgcactctagcctgggcaaaaagagtgaaactctgtctcaaaaaaacaaaaaacccaaaaataggggggagattcgttaaaatacctgtttttaaattgactttattgagctataaatcacatactatataatccacccatttaaagtgtccagttccaccaggtgcagtggctcatgcctgtaatcccagcactttgggaggccgaggtgggaggatagcttgagcctaggagtttgagaccagcctgggcaatatagtgagaccctatctctacaaaaaagttaattaattttaaaaaattagccaggtgtggtgtaagcttgtagtcccagctactcaggaggctgaggtgggccgatcacttgagtctgggaggttgagtctgcaagtaagctggtattgtgccactgcactccagcctgggcaacagagggagagaccctgtctcaaaaaaaaaaaaaaaaaaagtatacaattcaacggttttgggtatatttgcatgtatttgcaaccattattataattttagaacatttttcattacctcaaaaggaaaccctgtaccctttagctactatactcccaaaccttcagccttaaccacctgttaatctactttctgtcttaatagatttgcctattctggacatttcatatatatgtactyatataatgtgtggtctttcatatctggtttctttcacataaygtagcattttcaaggttcatatgtgttgtagcatggtgtcagtatttcatccctttttatggctgaataatattccattgcatggctataccagttttatttatcagttaatggaaatttgtttgttgttgttgttttttctgtgatgggggtcccactctgtcacccaggttggggtgcagtggtgtgatcttggctcactgcaacctctgcctcccaggctcaagcgatccacctgcctcagcctyccaaggggctgggatcactggcttgcgctaccacgcctggctaattttttggttatttttttcattacctagcctggtcttgaactcctgagctcaagtgatccacctacccaaagtgctgggattacatgtgtcagccaccacacctggccctgttgatggaaatttgggtttttcccaccttttggctattacgaaaaatgtggctctgaacattcatgtacaagtttttgtgtggacatatattttcatttcttttgggtatatacctagcaatggaattgctgggccatatggaaaaatacctattttcttatatcagtgagcatattatgcatatatgcatttttttaatatatgaacaccaatttatttttattttgtgtaccttcttccttagatactgttcagaaagtgttatcttaactctagaaggaagtagttttcattacaaaacaatctggctgggtgcaatggctcatgcctataatcctagcactttgggaggccagggtgggaggatcagttgaggccaggagtttgagaccagcctggataacatagtgagaccctgtctctactaaaaattaaaaaaaaaaaattatccaggtgtggtggcacacacctgtagtcccagctagccaggaggacctcttgagcccaggagttggaggatgcactgagctgtgattgtatcactgtactccagcctgggcaatagagcaagaccctgtctctaaaaataataataataataataatawcccaaaacccaatttatttaaaaaaataattctatttcattatatatattaaaaattgttttagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggtattaaaaaaaattcgtgcatgtgtgtgagaccttatcagtcccatgatgsaaacagtctagctctgttgttttgcacagagctatgagggtcatggatccatgattagcaattatgcagaatattttcttgacactgttaatctaaaattatttcaaacctacctggtattgaatttgaatgtaaagcccttgaagtagcaaaataatatgattttagttcttagtgtgtacatttgaaactttttttttgtggttcagtacaatttaagaatataacatgcagagtcatgaaatgatgaagtcagaatcttagtcttcattaaccaaaggctatttttgtaactaaactataaagaaataaaatgtttctatactctgttttaggcaaaatatggtatttcaggggaaaaggatgtcagtcctgacttgtcatgtgctgatgaaatatcrgaatgttatcacaaacttgattctttaacttataaggttagtttttttattgataaattttatatttttatattatgttaaatcgctctatattcttgtctctgctgataaatttgtatttctagtgtttccgtgtaccgtatgatttttatatrtcaaatttttctttggatactctaaccttggtttcttattagttattctagccttggtttttctagtagtaccttgtattttcctgtaataacatwgacatctctgtgttgtaagtatttctttaccagactgcagacttcttggtgcaaggaatacgttttattgatcttaattctctgtcacctrtcacagggctgaggcatagtaaactctcaacaaatgtagcaaatgaagaaatgtgtctattaycagcttatacgaataagagttactcttaagaaggattattataatttagtgtgtaatagctattcattccttcatttatccaatcctcttaaaaaaatgtagctgaagagtttacacaaaaataaataagtcaagggatgtgaatgtagtcgttatgtgctgtgggagccaccctcggttggctgcgtaggcagggtgaactggtagcagtgtggaggtaaggaggtgaggcctggaatggagaaggggggtgtcagtgagatcagtggaggctgcagaggtccagcaatgctgaaggtctgaaatgaggcagtgatgggttgaagataagaggcagatattaaacttttatgaggtagaataggcaaatgttgatggcttagggaagtaggggggataagggatagggaagagctagagtgaatgagtcccagcttgagagactgggagagtttgttcactgagatccagatatagcccaataagatctatacccacctgcttgtgattcttattaagtacgaatactgtctcacctgagtggttgagaaggtgcgcttggataaaatttgcttcactcccatgatttgaggaagccacaagaaaaagaaaaggaaaaaaaaattgcttcactttgtgtattattattgtatagtgagctatacaaaagtttggctgcacagcaaaaatgcagaaatacctttttacagaatttttttattccattgtttgtgactggtttaaacattctaagaaacatgrttggcaaaatggagtcttgaattctttttttttttttcctaagttgtttctttaaggtttagaaaataaactggttttacaaaccttgcctgagagcaaaggaaactgctgtgttcttctatttccttctctgctcagtgtccttcttaagtctgtgtgctgctcaattattgtcatgtttatccactgatgtgcatttcagcgctcaactcatggtccacactccgttaaaaaatgcaagttgatgatcacaaagttattctaatgtttgraaartacccrctaccctcagcgacttgcctgctgggttggtggtggcagagctaagttcgtaggaagtctgctcccgtgtagaattgtgtgctgaagggttgccatgtgggtggtaccctggagaagctgcagttcctgccttcctgagcattccatacagcatgggatgattaattgctgattaaaacattaataaaaggccaaaagtcatatgcacattgaagaaatactctgttgtgtccttcatttcatcgtctggcttcatcttgtttctgtttctctgtccctttgtttctctctgtgtatttattctactcttccctcctgcccttccttccttctttctcttgttaaattgttgctttggaattagaaagaggcagattggtccagatgctctgcttgtggatctctgcctcctttagctttaaagttgctgaaagtcagcagaaaaactgccaggttagggctaagtattggatctgtgctccttatttgttgcctacttgccctttgcaaagagaacatggggaagcaggccagctctgcactgtaatgtattatagctgataaatgcaarcttgatcaaaacaactrgctccttaccttgattccgatgacagcactaggctagaaacttaacccttatattatactttgactctaactaatgttgaattgattttatggttacagattgatgagtgtgaaaagaaaaagagggaagactatgaaagtcaaagcaatcctgtttttaggagatacttaaataagattttaattgaagctggaaagcttggacttgtgagtatttgatggtgtgatactaatccgtatagtgtatatttttatttattaatttcaaataatatgaagaagtgaaagcatcatgatgctttttaacagagaccacctgactgactctttaaccagaagctattcattcaggattaaaggcactactatactgctttgcagtggtctggtggaagatgagcagtgcagaccgctctttctcctctagtttgtatggatttacttactcagctctgtgcactgctccaccagttaatggaggtgaggaggtggggtgataattctgttctgatcctactccttgttttctctcagtatatgctgagaaaaagaaaaatgtgttttctgtagtttttctccttgttgtttactgtggtgagtgctactttatagacatattgttcataattattgttaaaatttccttttttttttgagacagagtctcgctctgttgtccaggccggagtaccgtcgtgcaatcttggctcactacaacctctgcctccygggttccagcaattctccctgactcagcctcccgagtagctggattacaggcacctgccaccatgcctggctaatttttgtatttttagtagagatggggttttgccatattggccaagctggtcttaaactcctgacctcaggtgatccgcttgccttggcctcccaaagtgctgggattacaggtgtgagccaccgcacctggccaaaatttctatttttaagaagtcactgttttcacttkgggaagtgaaaacttcccagacttaatgcattaatttagttttaattcacttaccaaagtgaaaacatcaagaaaacataaatttaataacttataacatttagaaagctcatttaaaagctcatagactttttttttcctattgtgtgtgccaccagaattgacttagagagtcagagaccagcctttggtcttgatctggccattagccccacctgccagaagtggttacaggcagatccctgaaaatgaaaggcccttgcatcagcacagtgtaggctggcaaaacttgccatatactccatcttcctggtacagtaagaagtgaccaaaagaaaaaggagtgttagatgaataacgccaccttattctggaaatgtagaagcagatgcgttctcatacgtacactctgtaatttgagccttacagctacgtacagggtggaacagaacctagataaggaaacagatggaaccaaaaatacttaagatggaaatgctggaaaatatttagtttctgatttttttttttttttgagacagagtcttgctctgtcacccaggctggagtgcagtggcgcaatctccgctcactgcaagctccgcctcccaggtttacaccattctcctgcctcagcctcctgagtagytgggactacaggcacccgccaccatgcccggctaattttttgtattttcagtagagacagggtttcaccgtgttagccaggatggtcttgatctcctgacctcgtgatccgcctgcctcatgcctcccaaagtgctgggattataggcatgagccaccgcgcccggccacgtctggctaatatttttgtgttttcagtagagacaggatttcaccatgttagccaggctggtctcaaactcctgacctcaagtgatctgaccgcctcggcctcccaaagtgctgggattacaggtgtgagccaccatgtcccaccttgtatttactgtttataaaagaaaaaggaattttatttgtatcaactggctaattaatgcaaaatttgtttagtgattttgctaagctgaactcacactaataaaggtagttataaatatgtaatttatggaaacccattattttgttgctctttgagatccttcttgtttttcttgtttgcactaatacagattttaggctatctgaaaactgtcaggaaatgaaaagtcatgcagtgaatcataaaatgaagatgcacagttgatcctcattcttcacagattccgtatttatgaattgacctcattaagtctgtgtaaccccaaagtcaataatcgaggtgttctgtggttactctgggacacagtgaagagtggtaaaaaatttgggttgcctgttgcaggcattcccagctgagatggaacaaggcaatcaaaactgttttcttgtttcagctctcgtactgcaaacaagtgtctttttttgtggtctatttagtggtatattttttcgtgcttttttgaggggagaggggtgattttttttatttttattttgagaccaatcattaaacagcatcatttcgttgtttaaaacggccctctgatgtagtgctgagctgaggtctagtgtttctaagtgcaagaaggccacgatgtacttacagagaaaaggaaaaggtgtgtattagataggcttcagtcaagcgtaaggtataggacagttgtccatgtgttcagtgttagtgaatgaacaatatgtattttaartaaggtgtccttaaacaggaatgtacagaaacacacataaaacaaggttatatattgatcaattgataaaaatgttatgacaggtttgcacgaaccaaaccctgtatttattataggagtaatggttcagtacttgctaattggtgtttgaggtgactttatagaagataactactgtgaggccgggtgcagtggctcacgcctgtaatcccagcactttgggaggccatggcgggcggatcatgaggtcaggagatcgagaccatcctggctaatgcggtgaaaccccgtctctactaaaaatagaaaaaattagccaggcgtagtggcgggcacctgtagtcccagctacatgggaggctgaggcaggagaatggcgtgaacccaggaggtggagcttgcagtgagcagagattgcgtcactgcactccagcctgggcgacagagtgagactccatctaaaaaaaaaaaaagacgataactactgcgaatagcaagaatcaactgtattttagtgaaatttacagtatcttttttacatagagttctagaatttttaaatgtttttcatgtatattatctttggttttcatgttggcctgtgaagacaggtggatattattattattttttttttttagagacagggtcttactctgtctcccatgctggagtgcagtggtatgctcatagcttactgcagcctcgaatccggggcacagacaattcttctgcctcagcctgctgagtaggcaggagccaggtgcacaccactgcacacagctaatggttagaattttttgtagagatggggtctcgctttgttgcccaggctggtcttgaagtcctggcttcaagctatcctcccaccttggcctgtcaaagcactaggattataggtgtgagctacctygcccaggctattattcttatacatatgaaatactgcaaactaatatttagttccaaattggcttttgtcttaaaatggttcaccaagtagtaataaaattctctttctattgtttgttttttggtaaatttaatttagcctgatgaaaacaaaggcgatatgcattatgatgctgagattatccttaaaagagaaactttgttagaaatacagaagtttctcaatggagaagactggaaaccaggtgccttggatgatgcactargtgatattttaattaattttaagtttcatgattttgaaacatggaagtggcgattcgaagattcctttggagtggatccatataatgtgttaatggtaagatgggatgagggcaagggcaacgtcattaagtttcctttttaaaatactttccaaactccaccataattacgttaagaacctgtactaggtcacttatacygtattgatgaacaagccacaaaattgtagaaatgattttgtgcttttgagtccagttctttttagctgtcttaagtgtttttkgtggctgatttctgcttctctctgttttaaggtacttctttgtctgctctgcatcgtggttttagtggctacygagctgtggacatatgtacgttggtacactcagttgagacgtgttttaatcatcagctttctgttcagtttgggatggaattggatgtatttatataaggtattatatggatggagggttttacaattttaacacatttattcacaatgaaagaagactctaatccattgagagcaatcttgccttggatgtgggttggaggcaktgattagaggtggcccacgctggagaggaattaaatggacacttcttagctgacagttttttgattccttgaccagttagtgggtaaaaaagttcagtcctaattttcataacccagttaatgttaacatttgggcatctaagtcagaataaagccaggtgggttgggtgtggtggctcatgcctgtaatcccagcattttgggaggctgaggtgggcagatcacttggtcaggaggtcaagactagcctggccaacatggtgaaaccctgtctctactaaaaatacaaaaattagctgggcctggtgacgtgcacctgtagtcccagctactcagcaggctgaggcaggagaattgcttgaacctgagaggttgcagtgagccaagattgcgctgctgcactccagcctggaccacagagtgaggtctgtctcaaaaacaaggaagaaaaaaaaaagaataaagctatgtggatacatttaaaaattatcatgtaggtaatttagagtatgtcattctatgtctttgctagaaatgataccaaaatattattttttaaaaattaggttattttttgaataagtggtatattcatggcagagaatttagaaaaggcagatacaaggaaattaatttttaaaataacctataattttatcacctagagaaaatctgtcagtagtttaaggtatttctttctagatttttctagattttaattatctttcaaagttgggatcatactgtatatagaaattggaaaggaccactactgttcccatcaacatagcataaataataatcattgaaagaaaattttagatctttctagcagagtgagtcaagtagccaagtattttcaatgatttcatctggttaaagcattgtgacatttccttaaccttttgctgtaagtattatagtatttagaactaattatttacaaattaaacacagattctgtgtggaaggaaagttgcttgagtattgtcaccttaatgattgtatattggtcattgtactggaaattatccagtgcaaaataggatatcatcaactataaaagaaaataagaagtagtcatttaatttgtatggctagaactaattgttgttgttgttgctgttgtttttgagacagtctcactctgtcccccaggctggagtgcagtagtgaaatctcggctcaatgcaacctccacctcccgggttcaagcgattctcttgcctcagcctcctatctgggactacaggcccgtgctatcacgcctggctgaactaatttttaaaaacaatatttttagtaaagtttccctttttcattataattacttacagagaaggcaattgtagttagtactttatgcttacttgttgcattaaggctgtacttttccatgaactggaaatagctactctttacaaataatatgttttcctataatcctagcactttgggaggctgaggcgggcggatcacttgaggtcaggagttcaagaccagcctggccaacatgatgaaaccccgtctctactaaaaatacaaaaattagctgggcgtggtagsgggcacctttaatcccagctactcgggaagctgaggcaggagaatcgcttgaacccgggaggtggtggttgcagtgagccgagattgtgccaccgcacaccagcgtgggtgacagggcgagactccgtctcaggaaaaaaagagaaaaaatagtaataataatatgtttttttttaattaaaaatttataacagtctggtttggatgaatggtaaagacactctttgaatgaaggtcttttggatgtgtaggcctaaccttcataggtaayggcctctcctggttcccttttggtgttgggcagctagcttttgcacagcatcaggctgaagtcgccaagatggagccattaaacaatgtgtgtgccaaaaagatggactggactggaagtatctggggtaaggtgtttgtgcacttgtccttattttgaatagaaattctgagaatgaragaacatagaacaaagagaatgataaaataacaggaggctttccatgactgaatctttaatatcagaagaacatgcaagaagcattttaggtttaaaaccagtgactttttatgctcatctaaagtcacagggaaggaatagaagttgtatatatgttggctctgatattatctgtcttccttcakaagactgtgtgaaggatcctakgctcgcttttgttcatctcgttctttgcacagggtctggcatattctcaatagaagtttattaaacaagtgaatgaatgtatatatgaattaatatccatcttaaatttaatggccttatattgacttgtgaaattttatgttgtagctttacttttttttaactacgggaaaaattagtttttttattctttcacattttataaacattctcatgaatgttcactacctttggttgtatgtatctagcaatggggatggtttaataatgttccaaggcattttataaatgcaagtccatgactgacacggaattctgcagatggaatccaaaataaatgtttcttaaaaagttgtgggaactaaaccaattcagccttccttcctggcttcagtggacagtgaaatgcctcctctagctcaggctagtttcccaacgtatataagcctgatttggaaaaattagaactaatattccactttattttgtaaactccataaagaactgactttttaaattaaaaatttactgaggtaattgtggattcacacagtaagaaatactacagagagagcccgtgtaccctttccccattttcctccagtggtgacatcttgcacagctttaatagtacaatatcagagccaggatattgactttgatacaatccaccagtcttatttcgacttcccattttacctgtactcatttgtgtttgtgaagcattgcttttaaagtgtttaccttttagacatttttataaaatacaattttttatctgcataaaacatgtataatttgaatggatttttaaaacatgattttggacataagatgaaaaatttaaaaatcagcattacagggagtctacttaaaacttaagataatttaaaactcattggtgggtggtcagggagggtcaaaaccaaagtaatgtcttrtttgggaatgaaatgcaacattaaaagaaatgatcagtgttttgtctgtttctctaaacagaatggtttagaagttcatggacctataaggatgacccatgccaaaaatactatgagctcttactagtcaaccctatttggttggtcccaccaacaaaggtatagcatatattttgtaaaaattacttaaagtcagtcagaaatcccttgtattttaaagaactttagtgtttgagtcattttgctaataagcgtttgtccaagaaaaaatacttttgcacagtgattttcacattaaaaatggcacaacagcattttaatttatgtaacatactttcagcatcagtactcaatgaattttgatgcattctgtaccttagtcctgtgaggagaaaattaagttgcttttctctcgttttaggcacttgcagttacattcaccacatttgtaacggagccattgaagcatattggaaaaggaactggggaatttattaaagcactcatgaaggaaattccagygctgcttcatcttccagtgctgataattatggcattagccatcctggttagtattaatatattagcactgtcgggccaggcrcrgtggctcacgcctgtaatcccagcactttgggaggcctaggcgggcggatcacgaggtcaggagatcgagaccatcctggctaacacagtgaaaccctgtctctactaaaaaaaatacaaaaaattagccgggcgtggtggcgggcgcctgtagtcccagctactcgggaggctgagrcaggagaacggggtgaacctgggaggcggagcttgcagtgagccgagatcrcaccactgtactccagcctgggcgacagagcaagattccgtctcaaaaaaaaaaaaaaattatacatatatrtatatttatatatctatctatatatatttatatttatatatctgtctatatttatatatttattatatataatatatatttatatattatatatttatatttatatatatatatgcactgtcagtatttagcaagatttatattaaatcttagtattaatattagtaatactggttagtattaaatattagcactgtcaatatttagcaagatttacagaaaaaaaggcaatgctaaaattattgggcttctttgatgttgtaaatcaggctaagtcacgcttaatgagaaggcgatttttaagtgatacagatttttttcctcccctctgcccctctaaatgatacagacatattatacttacttgtatatttttataatcaagaaagtagttctctagtttgattgcatatgtcatagcagtgatttagaataataacctctttttaaatgtgttaaccttggtaaattaatacacaggaaataggaagttgatttctgtctcccagaaagggggacttcttatttctagtcagtttttgcagcagtgagaagggtagagcattgagtttgacacagaaccagaaagggatgtggaagaacatgggtatgctgagaaagagtttggggatccaggagcagacattaagaagaaatattactcgtcatccctccatggtctrttcagtgttttttgttatcgattttttagctattacccaagtaaagcagttgtcgcataaaacaaaaagaactcagatgtgccaagggaaattctcttccctaaggatacaagattcactatctctgttcactttgaaatcgtttcttttttggttttgttttttggcttgtgattacaggattatgtggttgacgggtatttttttgttaggtgacattagttctatagtcatagtttagtctctgaaactgaaattwtcagcagagtcttcaccatctgtttttgtttcatgtgctccctmaggaaagttatgctctttgacttttgctgcttttgtcttcaaatagtagtgtttgaaaaactagtacagaaattttcaaagtttctgttctcaggacctctttgcagtcttaaaaattgaagcccacaaacagctcttacttaaggtgattatatttattgatacttacatattaggagttaaaacaaatttaaaacayacgagtactgtacacgcaagcatgcatcccctgagtctgagtgaggctgtcactctagcatctggaaygctccgttgtatattcaggaggggacagtgaaaaagacaaataataatgtctttgtattatgaaaagttttgatctcatagatctcctgaaagtctcaggtatcccccgggggtccctgggccacactgtaaggaactgctgcctactttttcccatggaatgtgaatcaaaacctgttgaattttagctgtaacttaagcctagtttatatttgtaaaaagaaaatgtacagaagattgtttacataatgatatacaactttaaatattttcagcatttaccttatatgatgggcatgaatctagaaacatgaataattatcagactagaaccttctaatttaaatatctaggcttcagcctgccattgttatagttyaatcgaaatgtgtctagctgattaaaatgtctactgaaagatttattaagttttattggccactctggccttgtattaatctaaagaggtctctaatgaaaaaaagtcaaattaacatgtttatgtctataaatgccacaagtaagttaaattacataactttgttagcactctgaataaaatgcctcataacttttgtaagttagccattgagtcctcaggaaaatgtatttcttttccttacagagtttctgctatggtgctggaaaatcagttcatgtgctgagacatataggcggtcctgagagmgaacctccccaggcacttcggccacgggatagaagacggcaggaggaaattgattatagacctgatggtggagcaggtgatgccgatttccattataggggccaaatgggccccactgagcaaggcccttatgccaaaacgtatgaggrtagaagagagattttgagagagagagatgttgacttgagatttcagactggcaacaagagccctgaagtgctccgggcatttgatgtaccagacgcagaggcacgagagcatcccacggtggtacccagtgtaagtcagcaactcttttattctgctgtcccttcattactggttctaaatccttctggaagaggtctgattgtttttactcttttacccctcacccttaattatatcatgagtgatacagccactcactctctcccctttctggtcaaaagttagttcagcttcctcagaagaaataaaattagatttaacttttatgtaaaatacaatttaacagtagtttgttagagcagatggtaattcatatgaaccttcatgggaagccagcrtatgagcatgacagaaatttctatctttgaagagatcagagagaaggcatcactgaaggcccggagctctagggaaggtacagtagagccctaaaggattagctggatggaagagtgggctggggccagggatcaaaaacattgcttccccaaatcttcagtgtcattggctggctagactatactttttacctgtagaatggtaagaagaagtttttcaccattatcagtcttttaaagggacatttccatttctgtttgagagaggaatttgtattgtcatttgaaatgtttaaattgcagctgttaaacctttgaaacagttatgagcataatagaatctgggaaattatagaatcccttcccatagtttcatataaaaataaacatatctacatgtatctagaaagatggaccaggcgcggcggctcacgcctgtgatcccagcactgggaggccgaggcaggcggatcactggaggtctgcagttcaagaccagcctggccaacgtggcaaagccccatctctactgaaaatacaagaaaattagccaggcgtgatgtggtatgcacctgtaatcccagctacttgggaggctgagacaggagaattgcttgattccagggggcggaggttgcagtgagccgagatcgtgccattgcactccagcctgggtgacagagtgagacgtcgtctcaaaaaaaaaaaaaaaaaaaaaaaamamcttaagatggtccttccagcttttatagttagtaattacctgtcacctatctcaraagtcttccagkgacttcctatctcacttgaggggaaagccagtattacaatggcctgrragcctccttggtctccccttcccccacatccactacctctctggtcacctyttctccctccgkgcttactctactttagccataagggctcctgactgttccttgaacttgagagcctttgtacctgctgttcattctacagtcttcatttatatatcaatcatatggttactttcttcaggcctttactcatttttattatttttggagacaaggtctcactctgtggtcaaggctggggtgcagtgatcatagctcattgcagcctcaaaatcctgggctcaaccgattcttttgcctcagccttctgagtaactaggactataggcatatacgaccatgcctggctaatattttttattttttgtggatatggggtcttgctgttacccaggctggtctcaaactcctggcctcaagcagtcttctcaccttggcctcccaaagttatrggattacaggtgtgagccaccatgcctaaccatatcactttttcagaccaccctaatttaaactgtaatttgaccctgccagcccacccacattcagcactcatctcttctctgctttttttacatagcctctttaattcaacatatcacacttgtgtgattttcttctaacctaaatataagttccagtgagaacagttttatgtattttgttcctgctgtatccctaacacctagaacttaatatatgctcaagaaatatttgtcaaatgaattattctcaccaggcaagagaagttgacaatactgatgaccaattctcttgaccccttctaagctgggccactagaccacccagtatatgcgctaagcgttcccactcctctgtgggagtactgtggagtttggtgaggtataataacatttatataattataacccagcactggaccctggatttgaaagagtttggagcttgctacaayggatttgggtgggaactttttagatatgtttgattactaagacttcacattacattaaacagttaaaatgtaattttgtactttatagcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttyactctctytctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtrgctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagyctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagytcagttgttcaaggctatgtactaaaaataaaactagccaggcatggtggtacacgcctgtagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagarcagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccagrttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcytaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctrttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtyttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttartaagactattttatatacttttttacattgatcaagtacattatttttaccaaacaacattgtttcccactacatccatggttatgtataaaaaamcgccattgtcaattaagatgttaaaaaattatttccataagagtattaaattctaatctatgattcacttaacttcctactttataaacactaggtaaagtaatctcrcaagctgccaaagaacacatcccaagcagtaatcacagaygatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggrccgtaaaataaggctgaaaaagtcttcatctggtactgtcggaccctttgtggtagcaggtggtggagcacatctttgatcatctaatctgratccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctgaaactgcataaaatttttcctttaaaatggcttatataggtatagctgcttcattggtttagtacgtgcattatgttaagtcatactgttttaattataattggtcacaaggataaaagacaaggtcaactgtatctaagtatgacagttcaaggttataatctaacaggcatcaactgtgtaacttaacaaatctttagaaatatgtacaaaccccatgaggaactaccttaaaaaaatcacgtcttaggctaggggacagcaaactgtaacccagtgccggcttctgtaaatgaagtcattttcattttcccatcaatacatatgtttatatactatctatatggctgcttccctactaaatggcagagttgggcagttgcaatagataccatatgggcggcaaagcctaaaatattttctatctggccttttacagaaaaagtttgcctgcctctgtcttaggctgttaaatctgttaagaaatagcccagamtgaatttttttttttttttttttgagacggattctcgctctgtcatccaggcaggactgcagtggtgtgatcctggctcactgcaacctccatctttcaggttcaagtgattcttcagcctcagcctcccagtagctgagactayaggcatgcgtcaccacaccyggctaatttttgtatttttagtagagatgggggtttcaccatgttggccaggctggtctcgaactcttgacctcaagtgatccacccgccttggcctcccaaaatgctgggattacaggcatgagcctggtctctgaatttttctttcaagtttgagtattatgattcttatattagacatgctacttgtcaaaaaatacatgcacttacaagtatacaccatagtttctggcattgtagctcaagagtaagaatagaagtgtgatagctgatatttgaatatgcactacattgttagggactgtgataagacatagatccctgaacatttaagcccacaaccctcagagggtgcagttatttactgccctcctaagtgagtgccacctccacacatacctggctcattcatttctcctgtcataaattgataatttcaatgtcctccaattaacccaacacttgggcacttagttcctagacttcctcacttagttcctagacttcctctgattgaatgtcctcatccttcacttcggccttagccatttggctcccatggtcatattctagcctcttgttatctctatagaaatgcctcttccagttctttgcccatttttgaatcaggttggtttttgttgagttttaggagttttctatatattctgggtattaatcctttatcagatatgtgatttccaagtattttatgttgggttgcctttttactgttgataatgtcctttgatgcacaagtttttaattatgaagtccaatttgtctacgttgttgttgttgttccctgytcactcttttggttttataaccaagaaatcactgccaaacccaatgccatgaggctttccttttttttccctttagagacagggtctcactctgtggcctaagctggagcacagtgacgtgatcatggctcactgcagccttgaactcctaggctcaagtgatcctcccacctcagcctcctgtgtagctgggactacaggtgtgtgccattaatttaaaaaaawttttttatagagatggggtctcactatgctgcccagtctagtcttgaactcctgggctcaagcaatcctcccaccttggcctcccaaagtgctgggattacaggtataagccaccacatgctcctcttgagttttatagttttagttctgatgcttaggtctttgryccactttgagttttgcatatggtattaggtaagggtccaacttcattctttttgtatgtggctctctagtttacccagaaccrtttgttgataaaactgtcttttcccccactgaatggtcttggcacccctgttgcatatyatttgaccacacatgcaagggtttatttctgggatctgtattctattccattggtctatatgtctgtcttttatgccagtactgcactgctttgattaatgtagctttgtaataacctgaaataaaaaaatgtgagccctaaagctttattctcaagactatttcggatatttggggatcccttgaggttctatatgaattttaggctatattttctatttctgtaggaggaaaaagtcatttggatttttacagggattgcactgaatttgtaggtcactttggatagtatcgaaatgttaacattattaagtcttctaatccatgaacatgggatattgttccatttgttttctttcatctctttcagcaatgttttgtggttttcattatacaagtctttgcctcagtgattaatttctaagtattttattctttttgatgctattttaaatggaattttaaatttcttttccaattgttcattgttagtgtataaacacacaactgatttttgtgttgattttgtatcatgctactttgttgaacttgttgattacctctgtcaattttattgatactttgtcctttccaatgtgaatgcctttttttctttttttgcctaattgctccagctagaatttctagtactacattgaatagaagtggcaaaaacctgcattctgatctcgttcctgatcttggaggagagctttcagtctgtcaccattgagtatgatgtcagcggtacatgtttcatatatggcttttattatgttctggtagtttcctactgttgctaatttttaagkttttatcatgaaagagttttgaattgtcatttttttcctgtatgtgttttttccctttattctgtttatattatgtgttacactgattgattttcacatgttgaacaatcagtccttgcgtcctgggaataagtcccacttggtcatggtgtaaaatcctttacagcaggggcgctgctaaatttggattgtaggcttttgttgattttgcatctggattcatgaaggatattggtcagtacttttcttgtagtgtctgtctggctttggtattggcaatactggcctcacagaatgagttatgaagtgttcatttctttattttccttcttacagcctagattcttaagtccattattaaaatcacttcctggcacatgtcttcaactaccattctctcccctgaatcccattctcctggaaaaatagcagtcttgatttatctctgtgcctcaagcagctggccatgactggataaaatacacaattccactcactagttttacttccagtgactgaacctcaggtgggttcttagcacagcacagtgttcttaatactttccccctagtttcagtttctctaagtcaactatttcccacttcctttctcttcaaatttatagtgctccccaactccaatcttaactgatgactacttctttctttggtgagaaaataaaagcagcccgagagaattcctacttgctcccatctccaaatccgtactctgctttccctctctcacctacacaaaaactgtgttcttcagttaccccagacttacctacatcactgactcttctctacttgaccatttccatctgtagataaactacgttttcacccccaaaaagaaaaaaaaaaaccccacatttgccttgtatttattttctagctaatggtccatttaacccattaaagtttctatatttactatctcccctttcacacttcccattttctcaccccactcaatcctttgtccccaccatgccactggaacagtatctttcaaaattattcataatctccatgttatcaaatctagtagttccgtcatcatctgactcaggttcttagcaacatttgccacagttgagcactgcttaagatacactctttacttgatttccaccacaccacaccccacccctccccagcccacccttggggtatccttccaactctctgsctgttgcttctttgccagctcatcttcctccatctaaccagtagattttgaaatgctcagggcttagtcttcctgtcctattctttaggtactttcttcccagggctttaataccagctataagctgatgtctcccaaatttacttctcccttgggctccagattttacatcaaattgcctatttaacacctctacttcattgtctataccagtcacacttgccattccttgaactggctaacagtttaccaaatttaacatgtctaaaacagaactcttgctttttctctccaaacttgcttttcttctagtcatctccatttcagtgaatagaaccattcatttcccagttattcaaggtataagtcatccttgattctctttccctgaaaccctctactcaatttattaagaggtcctgccaactaaccataatatataactgatataatagctaataatgtagccctatgctaactacttctcactgttaccactctagtccayatcaccaatattttttgcctgcatcaccatacaatctttctagctggttttcatactaacacccttgccactctacgttcttccatcagtagccaggatcctctttgaggacactcccagtaccttcctaatacatctaaaacacgactttatcatggcctccaaaagcctagatgatctaggccctgattacttctccatcctcattttgtacaactcttcccttcccctactcatcccatgccagtcacatctgccactccttgaactggctaagcttttatatccaagaggggacttgctgtctctgcatggaatactctttctctagatactcacatggctgactgcttcactgcattcaggtctctgttcaaatgacaatccagaaaggtcttctctaaccaccctacctaaaacagacactccccctaccaccaacacctttgcttacccactacccctttatcctcctttaaagttcttcatagcaagcataattacctaatacaacacacatatactctctctctatatatatayacacacacacacgtctctcctaaaatgtaagatcctttaaaaatcaagtgtgtcctcgatgcctagaatagcagctgaaacataatyggtgttcaataattttttactgaatgatggacaataataactctctaatacaaaataagcccttcctgaatgagaattataacactaccaatgttttcagtggtatctgagctgtatgcagaaygaaaaaaatatacagacatacttgacattttacaaggatgtcaaagaaatcttcatcagcctctttgttgtcattagtcatcaggtggctaagtaccgactggctgttttgtgttagacgaagccctggcaaattactgaaactagccctctggtcatccagacggcgactctgtgagctggcaagaagatctaaaaactcatccgtgttgggggataccacaggaacagatgatgctaagaacagaagaagaaagccaaagattaaaaaaaaacaaaaaacaaaaaacaaaaaaacctaggcacatttattatatacctagatcttttcggccttgccagtcccaagacccgccctgccctcctgctatagcgctgacactgatgggctttggctagatgggtgtggtttttattggctggagggaagaatgagccccagagtacttcagatgacccacttggacgttattcagatttgactatatttctctatttaatgctcactcaaaatgtaactataagatatgtgactagatttcagaaattgaacaaactgtttttcttacataatttctcagaccaggttgtgtaggacagtgttttttattccaagccctggatacaaatcatttagtaaactaacagttaagtgctgctggcaagtcttggtctatggtacaagaagtcttttggtagctgaaatagaaaaatataagtaacctatt

SEQ ID NO: 12588 - DNA, 163708 bp, Homo sapiens
  misc_feature (1)...(163708): n = A,T,C or G, or insertion/deletion polymorphism (see Tables 1-2)
tttcttgtacttttttttttttttttttagacagagttttgctcttgctgcccaagctgtagtgcaatggcatgatctcggctcactgcaacctccacctcccgagttcaagcgattcttttgcctcagcctcccaagtagctgggattacaggcatgcaccaccacgcccagctaattttctgtaattttggtagagacagggtttctccatgttggtcaggctggtctcaaactcctgacctcaggtgatctgcccgcctcggcctcccaaagtgctgggattacaggcgtgagccaccgcaccccacacctggcctctcttaccttttttatatattccatagggttttgtatgcacacaatcatattgtctgtgaatataattttacaatagtctccccttacctgcagtttcggtttctgtggtttcagttacctgtggtcaaccttggtccaaaaatactaaatggaaaattctagaaataattcatgttttaaattgcgggctgtcctgagtagcatgatgaaatctcatgctactctgttccatcgtgcctggaatcatctctttgtctagtatatccatgctgtatatgctacccacctgttagtcacttagtagccaacttggttataagatcatcattattatgatgctggtgttcaaggtccatagtagcctaaaactatgtcacaatgcctacctcattcactttacttcctcttgtcatgtaggtattttatcacctcacattattgcaagaatagtacagtatcttgggagaccagtcacataccttttattacagcatattgttataactgttctatttcattattgttgttagtctcttactgggcctaatttataaattaaactttatcataggtatgtatacatagaaaaaaaatagagtgtatatagggtttggcacaatccattgtttcaggtttccactgggggtcttggaatgtatccccagcagataagggggaacaactgtacttattccttcccattttaaaaattgagatttgattcacatgccataaaattcacttttaaggcatataatttggtgatttttagcatattcagaaagttgtacaaccatcaccactattttacttcaggatatcttcatcattccaaatataaactccatacttactagcagtcaatctccactgtcccagtccccagcccctattaatctattttctttccctatggatttgcccattattgacatttcatataaatggaattatataaaatgtggctttcacttagcatataatgtgtttaaggttcatcaatttgtagcatgaatcagtagttcattccttttaatggctgaatagtattccattgtatggatacaccatagtctgttcattcattcaccagttgatgggcatttgtgttgtttctacttttggtcattatgaataatgttgctatgaacgtttgtgcacaagtttttgagtgaatgtattttccaatttacataggtatatatctaagagtgaaattgctgggtcatatggtaaacttatgtttaacctcttgaggaactgccaaactattcccaaagtagtggcaacatttttaattcccatcaccagagtatgagggttccaatttctccatgtcctaacacttgttcttgtccattcgttaaaaaaattacagccatcctagtgaagtggtatcacctggttttgatgtgtatttccctaatgactaattacattgagcatcttttcatgtgcttatggccatttgtatatcttctttgatgtttattgaaatcctttgtccatttttaaattggatttttattgttgaattatgagttctttatattctgaacagtgcacccttaccagatatatgattttcagaatattttctcccattctgtgggttgtctgttcactttcttgatactgttctttgaagcatttttttttttttttgagatggagtcttgctctgtcacccaggctggaggacagtggcacaatcttggctcactgcaacttctgcctcctgggttcaagcaattctcctgcctcagcctcccgagtagctgggatcacaggtgcacgccattatacctggctaatttttgtatttttagtagagacggggtttcgccatgttgaccaggctggtcttgaactcctgacttcaggtgatccacctgccttgacctcccaaagtgctgggattacaggcatgagccatggcgcccagcctgaagcataaaggttttgattttgatgttttaattttaatgcattcatttttcccttggttgtgctttttgtcacatcaaagaagccactgcctaattcaaggtgataaggatttagttatatttttttctaagagttttataattttagctcttgtgttcggatctttggttcatcttaatagtcataaatggtgtgaggtagagttccaatttaatttttttcctcatgtggctatccagttttaccagttccatttgttgaaaagactactctttctccaattgagttgtattggtgttttgctgaaagtcatctgaccataaatataaggctttatttctggactcaattatattccattgatctgtactcctatctttataagagtatagtactatcttgattactgtagcttcatagcaagttctgaaatcaggatatctgagtcttcccagtctttacgctttttcttattgcttttttgcattgattagggcctccaatttcctaaatagaagcggtgagagcagaaaattcttgtcttacatttgttattcctgatcttaggagaaaatgatttaatatttcaccattaactttttcaaatcattgaggaaattcccttctattcctaggctgcttagagttggtttttttttttttttctaaaacattaatgggctttgaattttgtcaaatcctttttctgcatttattgaaacaattttttttctcttttgttctgttaatgtgatgaattacactgatttttcaatgttaagttcactctccttggtcatggtatgtaatcctctatattgcaagttcaatctgctaatacttaagaatttatatatatatatatattcatgaggactatcagtctataattttcttgcaaaatgtcaaattttggtatcaggaaaaataatttggcatgattatgcttgcctcataaaatgagtatagaagtatttctccctgctctgtttcctgaaatggtgtaggattggtactttgtcccccttaaatgtctgataaaattcactggtgcagtcatctgcccggagttttctttgtggcaagtgttttgcttataaattcaatttttttaacagacactgaaacatttagattttcttttccttcttttgtgtcatttttggtaatttatttatttatttttttaggaatttgtccattttgcttaagttactgaatttattggcataaagttgttccaagtatccctttaatatctatgtgatttcattagcattttggctaatgaaaattaaaacttctgtatacaaatgtagatgacaaataataaatcaaaagaaatgtgtaacatatagcagaaaaagtatgtatgtgcatgtgtatatgtatggcaggagcaaacaatctactggcacagagggaattacagtacagtgtgacaaataccatgacaggcacacagagaacacatagaatggatacccagtccaatttggggagtcaaaactatgatgtccaggtggtaggttagcttgtccaactataggtaaatgaatataatcaaatttatagacacaaaaaagctgagactcagatccccagacatagttacttcatcatggttacctacttgtgaaggtcaagagtcaactggctcccttttcactggcacagctttaattaaaacataaaacacaactttgtttttgtaaaataataaattacaaaaaacaccaaccagataaaaagtccaaaagacaaaatgtaaaacacttgtattttgactgaccttcttccagatatttttgtacacttatattaacatatgtacacacatatattcacattaggacagcactgtacttgctaaactacattctgctttttttttcctgaggggaaactatattttttggacatactttaatgcaaataaagaactttccatcagtttttaatgggtcaagagtattccattgcatgtaccaatcataattttcttaactagtgtcctagtgatggacacttgtttctagaagcattatttttaaaaaaggtggcaaatagtatccttatgaatcccttattttccttagggtatatgcctcggaaatgagacagctgtggggcaaaggctaatgcatatgttaaattttggtaaatagggttgtaccaatttcaccttcacaccaaaaatgcctgacagtaattgtatcccacacccctatcaacaatgatagacaaaaaacaactgtttggaagtgggacaactttccgtttgttaattgaatatttgtttttcttggctttttgtatttttaatagatgggatttcaccatgttggccagggtcgtctcgaactcctgacctcaggtgatccacctgccttggcctcccagcgtgctgggattacaggcgtgagccaccgccatttcccgaatgatctttttcctactgaccaataatttgtcatgtatagtttactggctaccacagagatttctggagttgtctggctccagcgtttaaaagtaatggttttgggcaactctgtgaaatggagataacaattgcacctaccttacagaaatgttagagttaaataagataacctgaaaaagtactccagtacttgccacacaaatgctcagcaaatgtgagctactgttattatactaaacacgcacacatacatgagaatttctggattctctattctatctcccatgtctcatctatgtaatccatccagcaacattccattaccaactcgctgtcctttttttccctcctcttaagagacacggtcctttctaatggcccgttttccctcatttcaacaacaacaaaatcacctctcagttgtccaataataactacagcctgaaaatcataatcttgggggtaaaaataagctgtacttcacaaagcagtgagaatcaaagcccaaccaaggcactgaacaaacgctggggatgggaaggtgtctgtttcttccaacacgtattttgaaaggctgaccgcctactttgtttcagactttggatgatcatggaagttctcaaaagctagcaactcctcttccaactattgtttacagccttaagacaagtagttccccatgtgaccccaggtgggccctgaacttgggataaccaggacaggagacttggagcaggaggtgcgggggcgaggagggctctctcccgggcgattggtcctaacccgaggttccctcgtggcaagctgagccgactccccactcgtgggctgatgcccgaggcagacgcggcaggcaggcggcttcgggagcgcatatctgcacccatggggacgatggcaggctggcgaagggagagaggtggcggcaggactaccatttgaggctctcaaatggtgtggggaagagggaaggagaggcgcgaaaaggaggaaaacccctggagacgctgtgtcgggcggaggctagggagaccggcttcgcgctccaacgacgcgcatcactcagactccaaggcaagtgcccggggctagattttccgtcccctggggctctggggatctctgagtccatcccagggccctccaggaacgccttcgggagcgcagcccggccccgccgctgccgctgtcacccgtggccgctcccgcctcggttcgtttgtctcctccctctaacggctccggcagcaaccggcgtcggtggcgtgggtgacgtcggcgtggggggtgggacttcctgcttcgcgtgccgctgggccaagggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatgtaacctctctttctggggacggtgtcttgtttgtattttggaatactcattttgtccctccacaaactgcccttgaatcctttttttattttcctgttaaagtagtggaagctcgtgctagaaaagtaggcagagagacgcacgtgaaactcttcatggagcttttggatgcactctggcttggtggttgtgtagccagtttggtaattggccagacgtttaagtacctccagcttaatttacgatgaaaaagctatgctaccattttccttggctttgaagacaatttgaatgaacagtgatgtcgactgtcattactgagataaacacctaaaatatgttagcatatgctgggtttaaatactttggttaatcctcagtgtccaacttttgaccataatcaatgggcattttgctcttaagaatatccactgctaagtatttgtaaagcctttagttagctgaaatgaggaagctctttcaaatcttacagatctctaggataaggaaagacttgtctgaatttcgtgtatatgatatatacttcataatctgttcagactttaagcagctctaaaacagagtgggttgttaaagcagtgcttctgttaccaagcaacatgtctgtaaacaagtctgacatttaactaaaacacaattaaaggtatctatcctacagttacctggatttagaattttccatatttatgaatttagcctgtaagtggttagaattaatactcaccttttgtattgaggtttgatttcaaactcagtttgttcagaattgttagaatgctttatttatttatttatgactgagtctcactctgtcgcccaggctggagtgcagtagcgcgatctcggctcactgcaacctccgcctcctgggttcaagcgattctcctgcctcagcctcccgagtagctgggattacaggtgcgtgccaccatgcccggctaatttttttattttagtagagatggggtttcaccatgttggccaggctggtctcaaactcccgacctcaggtgatccgcccacctcggcctcccaaagtgctgggattacaggtgtgagccaccgcaccaggccagaatgctttaaattataagtgtcacacaggactctcctgagagttgcaaatggttttgagttgtcctttggttatttaggacagagtatgctgggtattccccttactttgagtgttttctttccagatcagatgaagtgcgcggactgtatttagaacattctcaaataatagtgaaatacaatttagaattccatgcagcactgggagaatgaaacactgattattcacaggtagtttttttttttttctttttttgagacagagtttcattcttgtcgctcaggctggagtgcagtggtgggatctcagctcactgcaacttccgcctcccagtttcaagtgattctctcctctcagcctcccgagtagctggggttacaggtgcatgccaccatgccctgctaatttttgtatttttagtagagatggggtttcaccatattgcccaggctggtcacgaactcctgacttcaggcgatctgcccaccttgacctcccaaagtgctgggattacaggtgtgagccagcgtgcctggcctattcacaggtagtttttaatccttggtttaccagtcacctcactgtctcctcttattgaacccttaatgataaaatttttatggcaagttgttagtttttagagcactttttgaatgatcttttcaatcaataacctttcaagtaagcaagtatgtgagaaaatttgagacatgatgagactaaatgacttctttgaaatctattaataatgggaattggaacttgaagtttaatgttctttatgtcagatacccttatgtattgctaaaatccatggacttaattttagttctctcctccttttttctatatgctgatgttgaagtaatgaaatattcaaaagttgggcaagatggaggagacaaatcaagaatgactcgtataatccttagtaatcagaaatcagcattatgtcatgggatgttctaattcaagaagcttagagtgaaatcttaacagaaagattagtgaattttagtgaattgtcagaatttccccacccccaggtactgtctctttgcctaaaagtagatgagcttgcttttaattttgtcatacatattaggttccataagtaaattgcccacattgtttaacctatgtgcttttagggaatgtgtgtaaatctgtgtaaaaaacttccttttaacccaagttcatgtttcttgacttaaggtgaattatttgaaatcctctcaccttgccttttcaagtgtatgttctttatggaaaaggtgtctctgcccagattggtttcttcactatcccctaaacctgctctgtactttatcctttccatattagtctgcatatctttctatcccccgtgacctgatcttattcccttctttcttaaaatctaaattgtaccttttctataaggttcaactccaccatgacctcatacatacatacataggaatagtatgtatttgtgagttaaatttatttgatacttatactttttattgtattattttagctttcttgacttcctaactagattgtaagcttattaagggcaggacttcagatctcgatgagctgtatccttagtcttttccaaatacaagttgctgaataaatgtttcttaaagatgactgatatgattaggctttgtgtccccacccaaatctcaccttgaattataatccccataatccccatgtgtcagggaagagaccaggtggagggaattggatcatggcggcggtttcccccatactgttcctcgtgacagtgagttctcatgagatctggtggttttataagtgtttggtagttcctcctgcattcattctccttcctgctaccttgtgaagaaggtgccttgcttccccttcaccttctgccatgattgtaagttttctgacgcctctccagccatgtggaactgtgaatcaattaaacctctttcctttataaattacccaatctcaggcagttctttatagcaatatgaaaatggactaatacaatgacagataggcatttctactttcccccacttttgtaagtatcatgaaagtaaggttgttgagagaagagagtaagtgaaggggaaatggcaacagtaaactataaaaaagattgaagagtgggaattcacggaatcagaaataaagattctgttcctagaaagtgagtatttgagaatttcccatggcaataccagcagtaaggactctcaggaatgctggcactattcttcagtgggcttggggagtttggtcaatttcctggttcctagtagaatatcagtttattaattatatttttttcatcaggactgccctctctaggtcatggagagatcactgactgtcaagtctagtactatttcttttttcttttttttttttttgagatggagttttgctctgtcgcccaggctggagcgtagtggtgcaatctttgttcactgcaaccttgaactcgtgggttcacgtgattctcctgcctcagcctcccaagtggctggggctaacaggtgcatgccaccacacctggctttttttttgtattttgaatagagacagggtttcaccacattggccaggctggtctcggaactcctggcctcaagtgattcacccaccttggcctcccaaagtgctgggattgtaggtgtgagccaatgcgcccggcctactatttcttttaactgagctataatccaggatggaagaaattaaggaaatgcccagttatttgccttctgtatattgtgacttcagattgcttttggattaaaattcagagttagtaggaacctaaacctggccattcccttttggaaagcacctatcttctgtctcaaaatatgtctataaaatgtccatgtagtttttacagtctcaccaaaaatcctgtatctaatgcttataacaaagagttacttcagttgaagatatagaaagtgaagttgagtctcagaatgctttcataaatattcgtttgattcagttacttcttgagtgaatttgccattctagcttctgagttgttgcccagtaacacaattgcagtataatatagcaacccttgaaaacagtagcattggactatagggattttcctgatgaagttgcattgcctatctctgatgttcatattcagcctctctcaagtgtgattgcattttgttttaaggcagctatttcagatattgttaaacttaaggggcatgcaatatatgctcttaaggatattttttagagtactgatgaattataacttctttcacattgttttccacatagagatgcatgataatgtgtccggaattggttcattctggtgggttcttggtctcgctgacttcaagaatgaagctgcggaccctcgtggtgaatgttgcagttcttaaagatggtgtgtccggagtttgttccttcagatgttcagatgtgtccggagtttcttccttctggtgggttcatggtcttgctgacttcaggagtgaggctgcagacttttgcagtgagtgctacagctcttaaaggtggcgcgtccggagttgttcattcctcccggtgggttcgtggtattgctggcttcaggagtgaagctgcagactttcgcagtgagtgttacagctcttaaaggtggcgcgtccggcattgttcattcctcccggtgggttcgtggtctcgctggcttcaggagtgaagctgcggaccttcgtggtgagtgttacagctcataaaggcagtgtggacccaaagagtgagcagcagcaagatttattgcgaagagcaaaagaacagagcttccacggcatggaaggggacccgtgtgggttgctgctgctggctcaggtgcctagctcttcttcccttatttggccccacccacatcctgctaattggtccattttacagagagctgattggtccattttacagagtgctgattggtccgtttttacagagtgctgattggtgcgtttacaaacctttagttagacacagagcgctgattggtgcatttgcaatcctttagctagacagaaaagttctccaagtccacaccggacccagaatcccagctggcttcatgtctcaataagtatgtattgaattattttttgtgtgaaggacacgtgaaaatactggttcaattaaagattattctgggcagaaaaagtattatgtaataacagacttctctacaactgatatagccagccagagctggagtggatgaagttgaaatggttctttataacatttttgtattacttctagagcttcatagaaagctgagatcactaagcacaatttaataggtactctaatttttttttttttttttgagacatagtcttactctgtcagcaggctagagtgcagtggtgtgatctcagctcactgcaacctctgcctcctgggttcaagcgattctcctgccttagcctcccaagtagctgggactacaggcacatgcaaccatgcccagctaattttttgatttttaagagagacggaatttcactatgttagccaggatggtcttgatctcctgaccttatgacccacctgccttggcctcccaaagtgctgggattacaggtgtgagccactgcgcccggcctaggcactgtaattttgtgggaagagaattgtgattcaggagaccaaggcttgactgggtgagtcacttcacctttcatggcctattttctcatttgaaaacataaatctctgaaagtttccttcagaaatggtatgcttccaatttaaagcaaattttatttctcttatatatgggtttaatcaatatttgagtgcctattatgtgtctcatgctatgctaggcactggggagattgtgaataagacatagtgctaagtctcaagcaccttattctctgatgggagaaatggacaaagtaattagtaatttgtaataaagcatgttaaatgctataaggatagataagaatgtgttttggggcatgtaggaagaatacctggcctagaactagaaagaatacacaaaaattgaggaatgtctctttagaatcttgtaagtgtagttgtagggtgtacagagcagtattcaacttggcccggaggaagttagtcaaagaaaactaggaaaacaattcttgaagttggagagagagaagagtcatcaacgttagtggtagttgaaataccaggtatagatgaggttcctagtgagagttgtgtagaatcagaagagagcttgtgaacaccagcatgtaataggaagggggagaaagaaggtaggaaaaccagagtagggtaacgttttggaaaccaaagaaagaatgcacatcacatttagtttattgattaaatggaaattgttgctcaagaaacattgagtgtgtagtcctataaatgtaaacctatctaaataaagatgccctctacaaagatctgaacttgcaaatgggggtagtttaagtccttgtttagcagcgtaacagaggaaagagtatgtactttggagcctggatcctgagagtgaaggttagattactagctgcgtaactttttgaaccagttacttaattttttggtccttaatgtatggattaaaataaggtaagctgtaaacttgacttttagtgggcattgttgatttttatccttgccattattaatgactcttctgaactacatacccttcttttccttccccatcccccgtcatattctttcatccttcaagatccaccaaaattcctgccttttctttgatatcttcctctatggatgatattacaaattttctgtaatggaatgaacatgtcctgtgtcccttagaattagcaacgttattcttttttctttttcttttttaaagccttaagaaggaaattgtattatctcacatgtaagaagtctggagataggtggttctaagattgtcaattaagtggcttagtgataatctttaagaacctggattctttttgcttggtcatcctttgaactcagccttgattactacaactatcaacaaattttccaaagtttggaagagataacttctttcttctacctagccctttttaaacagctttattgagatatattttacctaccataaaaaccactcattgtaagtgtacaatttaatggtttttagcaactttatagagttgtgcgactgtcatcacaaggcaatttctgacattttatcagtctcctagattctctcaagcttatttgcatttaaggtaactccttcccacagccccagagaaccactgatctactttctatcactataaatttgtcttttctacatatttcatataaatggaatcaatacagtagtcttttgcatctggcttctttaacttcatgcttttgaggtttatttaatgtatgtatatcaatgttttgttctttttaattgttgcatagtattcgtgtgtattttccattcaccagttgaatagtattggtgaatagtatttcccatttactggtaaccagtgaatagtatttcccattcactaggtgatagacattggatggtttccagtttttggctgttatgaataatgctgctatgaagatttgtctgtaattccttgtgtgagcatatgtattcatttgttttgggtaaattcctaggagtggaattgttgaattatatggtaagcttatttttaacttttaaagaaactgtcaaaatgttttccaaagtagctgtaccaattacatcctaccagcaatgtatgatgattccagtttctccacatcctcaccaacagttggtattatctttttaattatagccattctagttagtatctagtagtatcccattgtaattttaatttgcatttccctgcacagtaatgttggacacctttttctgtggttattggccatttggtggaatatctgtttaaggcatttgcccattttttagctgggtttttttttttttttttttggtcttactgagttgtaagagttctttatatatgctggatgaaagtttgtattgtttttaatatcagagataagatttgcaaatatttctcccagttggtgtcttggcttttcatatttttactgttgtcttttgaagtgcaaaagtttttaatgaagtcatttcttttgtgtgtgtggcacgtactttcatgttatgtatacgaactttttgcctaatccaaggtcccaaagatttttctttgagctcccaaaggtcttctttgagctctttcctttaaatataagattcatattgaattaaccgtgcatttgatgtaagaagaggatctaagttcattttttaaaaatgtgaatgccaaattatccagtaccatttgttaaaaagactgttcttttcccttcaattgtattggcatctttgtaaaatatcagttgactataatgtaagaatttattccaagactcatgtctataaacctatccttactccaacactattctgtcttgattactgcagttttatagtaagtttcaaaataagtagtgtaacattttcttctttttcaaaattggttctatgctctttccatttccatatacaatttaggatcagcttgttaatttctacaaaaacacatctgatgtttgtaggatttgcattgaatctatccatcaatatgggaagaatcactaacttaaccatcttgagtcttccaatccatgaacatgtaatatctctccatttacttagatctttcatttctcttaataatgttttttacttttcagtgtacaaatcgtgcacttatttggttaaatttattcctaagactgttataattttgatgctcttggaaatggagttttcatgatttgatttcaaattgttcattgttagcacaaaaaaatgcaatcgtccaggcttggtggctcacgcctgtaatcccagcactttgggatccaaggcaggtggatcacgaggtcaggagatcgagaccatcttggctaacacggtgaaaccccgtctctactaaaaatacaaaaaagttagctgggagtggtggcgggcacctgtagtcccagctactcgggaggctgaggcaggagaatggcgtgaacccgggaggcggagcttgcagtgagctgagattgtgccactgcactccagcctagaagacagagcgagaatctgtctaaaaaaaaatgcaaccaatttttgcatattgtttgtacatagatgatcatgtctcaaaacgatactttttctttccaatctcaatgttatttatttcttcatttttgctttaattcttgggttagaccctccagtaagatgttgaagagaagtgttgaatgtgcattgcattactcccagtcttagggggaaaacatgcagatttttgccatcaggtataatgttagctgtagattttctatagatgccctttgaagaaggttaaggaagctcccttatgttcctagtttgttgcaagtttttaatcatgagtgggtgttagattttgtcatgttttttcctgcatctgatgatatggttatatgatttttattgttagtatgctatatattaattgattgttggagattaaacccaccctgtattcctgggacagatcacacttggtcatgctgtaaaatctttttttttttttttttttttttttttttattgtttgagacagactcttgctctgtgacccaggctgaagtgcagtggtgtgattttggctcactgcagcctcaaactcctgggctcatgcgattctccggcttccgcctcccaagtggctggggctacaggctcatgccaccacacctggctatttttctttttttttttttttcggtattttttgtagagacagggttttgccatgttgcctgggctgttcttgaactccttggctcaagcgatttacctgcgtggcctcccaaagtgctgggactacaggcttaagccaccatgcccagtccgtgctgtataatctctgttatatgttgttgaatatggtttgtctgattattattaaggaattttgggtatatgttcctgagggatattagtctgttggttgctcgtgatcttgctcttactgctttaaatgtttgatagcattcattagtgcagttgtgggggcctggccatttctttgtgggaatatttaaaattattggttcagtttcttcacttcttgttataggtctattcagattttctctttcttctagagttttggtaatttgtatgttctaggaagtgtagtccatttcatataaattatctaatttgttgatacgaagtttgtattaagaaatcctttaataatttaaggttggcaataattttccctctttcattcttgattttggtaatttgtatctcttattttcttggtcagtatagtgaagtttttttttttttttcgattttgttgatctttccaaagaaccaaccttttatttcactgattatttttcatatctatattttctatttcactgatttccacactacaaaattattatttttctgcttgttttgggtttaatatcccctctgctccttatttttctagtttcctaagatggaagcttagattattggtttgagaccttttttcttttctcatataaatgtttaaaactatacatttccttctaagcactgctttagttgcattctgtacattttggtttgctgtgttttgttttcattcaattcgaaatatattttaaaatttttccttgcaatttcttctttgatcaatgggttatttagaggtatgttttaaaatttaccaataattgaggtgttcctagatttatttttgttcggatgactaattccattgtgatcagatcacacattttttatgagttcaatcttttaaattttattgagacttgtcttgtgccccagtatgtggtgtatcctggaaaattttccttgtgtttgtaaaaaggttgtatattctgcaatcattgggtggtattttctgtcagttatgtcaagtttattgatgaggttagtcaagacttctatatccttgcagattttctgtctttttctatcagtcattgcagtcttcagctgtttctgttgaattacctatttctctttttaattatctctttttttgcttcatgtattttggggttctttggttagatggacagttattgttatatcttcctgatatagtgaccctgttttcattatgaaatggcctcctttgtctgtaatatttcttatcttaaaatctatttttcttggtactatagccactctagttttttttgtggttactgtttctatggtgtatttttttaaaaaaatccttttaattttaacctgtttatgtctttgaattgaagatttatctcttgttgacagcctatagttaggttttgtaatccattgtaatataatcccccctttgaatagagtgtttagttcattcacatgtaatgtaattgttgatattattggatttacatctgcatttttcatatttgttttctatttgtctcatttgttttttgctttttcctcttttctttaccatctttctgtgttaaatattctttagtgtatctttttatttctgttgatttcttttgctatattgttagggattacaatatgccttttaacttaattacagtctccttcagaataatactaaattctgataaattatagaaactttcctccagtgttatctgttttttctctttttggtgctattattattatatatattacagctgtatgtattacaaactcagcgacacagtactataattattcctttatgtagtcttatgtctttaaacgagatgaagtgaaaataattatatttttagagtctttaatatttactgatgtaattacagtttccaatgagcttcattctcctgtagagtattatttttcttttttttccagacaggttctcctgttttccaggctggagtgcaatagtgcgatcttggctcactgcagccaccgcttacccagttcaagcaatcctcctgcctcagcctctcaagtagctggaactacaggcacgtgccaccacacctggctattttttgtagagatggggttttgccatgttgcccaggctggtctcgaacttctgggctcaagtgagccacccaccttggcctctcaaagtgctgggattacaggcatgagccactgtgcccagcctagattaaactttatggtgtgacttccttttatcctgagggacttccattgttatttctcataaggcatgtctcacagcagcgacttgtcttcgtctttggttatctatctgaaaatgtctttatttcatcttcatttttgaagggcagttttgctgaatatagaatttttagtggtgagttttttgtgtttctttaaaaaaatttgttttttccatgtcatttctgatgagaaatcaacgttaataatattgttgttgccctgtatgtgaagtcatttttctctcgctcctttttaaagatttcctctttgtgtttcagcatttgcaggtttctttggatttgttgggctgtttagatgtgtcaattaatgtttttcattaaattagggaagtttttggcgattatttcttcaaaacttcttttctgcctctttctctctttactgaccttctagaactcccactgcatatttcgtgtacagtatgtcgtcacttaacattattttttatttttctttttctttgaggtggggtcttgctctcttgccagggtggagtgcagtggcatgatctcagcttagtgcagcttccacctctcaggttcaagcgattctcttgcctcagccttccaagtagctgggactataggtgcgcaccaccacacccggctaatttttgtaattttagtagagatggggtttcaccctgttggccaggatggtctcgatctcctgacctcatgatctgcctgccttgccctcccaaagtgctgggattacaggcatgagccaccacgcccggccgtcacttaacattattgataggttcttggaaactgactttaagtgaaatgatgtatcatgaaaccaactttaccctagactaattgataaaaacaatagttaaattcctatggcatatctctggtcaaaaaacatcatcaaacttctaaataaagacccaagacacttccaacattaaacgttgaaataaatgtgagctataatgtttaagaaagattagtaaaaaaaacaagtaagatagttacttacctaatttttggtgaaccagtgagtgacaatggtcatagtggtggtgggttaacccaagaaataaatgtttgcaaagcaaaaaatataagggacacctcttactatcatgcagttcaaaaataatcacaaatatggcaggcttgataagagtgcttttgtactacatagtattgtcatgcatttacatgattatatactttatttgaaatttcattttacaataatttgtattcattcattcattcattttccagcctgctctagggttcaggctttctggtggctagagcctatcctggcacagaaccaaccctggacaggatgacattccattgcrtggtgcacttaaatacacacccatactcattcctactgggacaatttcaatctcccagtgaatctaatgtgcacatctttaggatatgagaagaggaaactggagtacttggaaaatacaaacaaatgtttacttaatcttttttggtgaagtgtccatttgaatgttttgcccattaaaaaaattttgattgtttattttcctatcatttagttttgagagttctttattctggatgcaagtgctttataagatttatgatttgcagtttttcccctgagtctggtatatcttgtcatttatgtaacagtggattttgaagagtagtggattttgaagttcttcattttgatgaaatccagtttgtcagttttttcttttatggactgtgcttttggtgttatatctgagaagtcttaacccaagatcaaaatgattttctcctgtatttttttttaggaggtttatagtttaggtttttaattcaggcctctgatttattttgatcctatttttgtatatggcgtggggagcaacttgaagttctttktgtgtgtgtgtgtgtgtgtatggaaaaggcaattgttccaggaccatttgttgaaaagactatcctttcttcactgaattgactgcatttttgtcagaaatcaattgactgtttctatttgactctatttctggacagtcttttttgtttaatggatttttgtgactgatttaatactacatagttttcatttctatggcactttaataagtgaagtcaggtaatgcaagtcttctaactttgttctttttcaaagttttttttttggctcttctgggtcccttgtgtttccatatgaattttagaatcagcttgttaatttctatgaaaacttggtattttgaatgacactgcattgaatttgggagaaattaacatcttaacaatattgaattttctgatccacaaatatggcatttcttgctattgtaacctgctttttaaaaacaattataaaatagatatagagtctcactatgttgcccaggctgatcttgaactcctggggtgaagtgagcctcccacctcgacctcccaaaatgctgagattacgggcatgagccaccacacctggccatgacctgcttttttaatagtctctttttccattgtaaacaccactattaagttagtaccatgaggataagaactgattctatcctccattcctacctggaatttaggatgcactcagtaaacatttactgaatgacaaataaaagaagattcttgaacataaatgtttgtgcatctctaattagtttctcaggattaattcctaaaattagaattactaaatgaaaagatatattcattttgaaagcttttgcttagtagactgtcctccagaatttttaacttttgaggtagaaatttcttttcttttcttttcggagttggagttttgttcttgttgcccaggctggagtacaatggcctgatctcggctcactggaacctctgcatcccacgttcaagtgattatcctctctcagcctcctgagtactgggattacaggtgcttgccaccatgcctggctaatttttgtatctttagttgagaaagggtttcaccacgttggccaggctgatcttgaatttctgacctcaggtgatctgcccacctcggtctcccaaagtactggaattacgggcgtgagccaccacgcccggcctgaggtagaaatttcttgataactaactataacgcatgcataattggttagcaaacagtgttcttggtgacatccttccccaaggtttctctgaaattacattacaagcctatgggagagtaggattcacatcatagaaattttgtggatcactttactgtcattaacagtttactggaattgggaactatgaagatgaacaaaacagtagaagattatatgtagtttttcctttgaggaatttatagtttctttggaaaacgtagtttatatagttataaagcatctggaggggaaaagtgcagacattatagaatatagaataaattaggccgggcacagtggctcatgcctgtaatcccagcactttgcgaggccaaggtgggtggatcacttgaagtcaggagttcgagaccagccttgccaacatggtgaaaccctatctctaaaaatacaaaaaatagccgggcgtggtgcatgcctgtaatcccagccactcgggaggctgaggcaggagaatcacttgaacccgcgggacggaggttgcagtgagctgagattgcgccattgtactctagcctgggtgacagggtgaggttctgtctcaaaaaaatatatgtttatatagaataaatatcctggggcaagcacaaggaaggcaggaacctataaagcacatggacaaaagctactctttctgttcacttttagagcaactaaaactccgaaaatagttttgtgattttgcagactgtagggtttcaggtttgactctgtgatttgtggattaatagacaaggtttaagaaggtattttaatttggcataactgtatgaacaaagttgtgaaggcaaagagaaatgtgtttgagggtctgtaaacttaattgactctagcaaaggggtcctgggggtctgtaaacttaattgactctagcaaaggggtcctgtggggcagcaaaatgtttgaatttgtatagggagctggctaatacggggctgtgagtttagctgggaaatttagatttgagtcaggaaagmataaggattatcataggagttatagtgacgaaggcaatgtatgagaaagattgttttggtgatatttgtaggctatgtaagaatgagaaaatactaaagtctgggacactgtctaggaggcttctgttaagtgtaaaatatttaagattcggcactggagtgtgatggctctagaaatggggaagaatgattaaattcaacaaacagatgaagaagaatcagtaggattaatttgttataaatagaggatagaggatgggtagtggttaggaaatgagaggaggatagtggtaactgacttttttaaggagacaagtagaaaatttgaacctaatgaactgaatttttgttaagttgatgtagcggataaaatgtgataacttttcctcacctattactagattcatgactgagacccctataacaaaagacagattatcaagaggaaagcatacacatttatttaatgaaacctttactttatatgagtcttcagaagtgaagactgaaagaaacagggaaacctttctttccgtgttttttctaaaaaaaaaatcattatttcaatagttttgggggaacaggtggtgtttggttacatggataacttatttagtggtgatttctgagattttcctgcacccatcacttgagcagtgtacactgcacccggtgtgtagtcttttaaccctcacccccctccctccttccccccaggtccccagagtccattatatcagtcttatgcctttgcattctcatagcttagcttccacttgtgagaagatacggtgtttggttttccattcctgagttacttcagttagaataatggcctccaattccatctcggttgctgtgaataatggcctccaatgccatctcagttgctgtgaatgccattatttcattcctttttatggctgagtagtattgcattatatatatatatacctaccacattttctttatctactcattggttgatgggcatttagtctggttccatatttttgcagttgcaaatgtgctgctataaacatgcatgttcaagtgtctttttcatataatgacttcttttcctctgggtagatacccaatagtgagattgctggatcaaatggtagttctacttttagtttttttttttttttttttttttgagacggagtctcgctctgtcgcccaggctggagtgcagtggtgcgatctcggctcactgcaagctctgcctcctgggttcacaccattctcctgcctcagcctcccgagtagctggggctacaggtgcccaccaccacacccagctaattttttgtatttttagtagagacggggttttaccatgttagtcaagatggtcttgatctcctggccttgtgatccacccgcctcggcctcccaaagtgctgggattacaggcgtgagccacaacgcccagcctacttttcattcgttaaggaatctccacactgttttctatagtggttgtactagtttaccttcccaccagcastgtaaaagtgttcccttttcactacatccttgtcaccatctattattttttgatttttaaattatggccattcttgcaggagtaaggtggtagtgcattgtggttttgatttgcatttccctgatagtgatgttgaacattttttcatatgtctgttggccatttgtatatcttttgagaattgtctattcatgtcctttccctaatttttgatgggaatatttggtttttttcttgcagatttgtttgagttcctcgtarattctggatattagtcctttgtgggatgcatagtttgtgaatattttctcccactctgtgggttgcctgttcactctgctgattatttcttttgctgtgcagaagctttttagtttcattaagtcccatccatttatttcatttttgttgcatttggttcttggtcgtgaactctttgcctaagccaatgtctagaagagtttttctgatattattttctagaatttttatggtttcaggtcttagatttaagtctttaatccatcttgagttgatttttgtgtaaggtgagagttgagattccactttcattcttttacatgtggcttgtcaattgtcccagcaccatttgttgaataggttgtcgtttctctactttatgtttttgtttgctttgtcaaatatcagttggctgtaagtacttggctttgtttctgggttctctgttctgttccattgatctatgtgcctgtttttatgccagtaccatgctgttttggtaactatagccttggtatagtttgaagttgggtaatgtgatacctccagatctgttctttgtgcttagtattgctttgcaggcccttttttggtttcatatgaattttaggattttttttctagatctgtgaagaacgatggtggtattttgatgggaattgcattgaatttgtagattgctcttggcagtatggtcattttcacaatattgattctacccatccatgcgcatgggatatatttccatttgtgtcatctgtgatttctttcagctttttttttttgtagttttccttgtagaggtcttttcgcctccttggttaggtatattcctaagtattttattttattttttgcagctattgtaaaaggggttgagttcttgatttggttctcagcttggtggctgttggtatacagcagagctactcatctgtgtacatcaattttgtatcctaaaactttgccgaattcatttaccagttataggagctttttggatgagtttttagggttttctaggtatatgatcatatcatcagcaaactgcaacactttgacttcatctttaccactttggatgctcttgatttctttctcttgtctgattgttctggctaggacttccagtagtgtgttgaatagaagtggtgaaagtggacatccttgtcttgttctagttctcagggggaatgctttaaacttttctctgttcagtgtaatgttggctgtgggtttgtcatagagggcttttattatcttaaggtatgtcccttctatgccgatgttgcagacggttttaatcataaagggatctgaattttgtcatgctttttctgcgtctgttgagatgatgtggtttttgtttttaattctgtttatatggtgtattacatttattgacttccatttgttaagccaaccctgcatccctggtataaaacccacttgttcatggtgtattttctttttgacatgctgttggacttggttagctagtattttgttgaggatttttgcatctatgttcatcagggatattggtgtgtggttttctttttttgttatgtcctttcctggttttgctattaggataatactggcttcatagaatgatttagggaggattccctctttttctgtgttttggaatagcttcagtaggattcataccaattcttctttgaatgtctgatagaattcagctgtgaatccatcaggtcctggactttttttttttttgttggcattttttttgtttattactgtttcaatcttgctacttgttattgacctgttcagtttgtttctatttcttcctagtttaatctaggagggttgtatcttttcaggaatttatccatctcctctaggttttctagtttgtgtgcataaagatgttcatagtagccatacaaaagcacaatcttttgtatttctgtggtatcacttttgatatctcctattttgtttctaattgagctgtttggatctactctcttctcttgataatctcgctaatggtctgtcgattttgtcttttcaaagagccagctttttgtctaatttatcttttgtattttgttgttgttcttgttgttgtgtttcaatttcatttagttctgatctttgttatttcttttcttctgctgggttttggtttggtctgttcttgtttctctaattctgtgagttgtgaggttagataatctatttgtgctttttcagaatttttgttgtagacagtgattgctatgaactttcctcttagcaccactgtttttgctgtattgcagagggttgataggttgtgtcactgttatcgttcagttcaaagaattttaaaatttccatcttgatttcattgttgacccagaggtcattcaggagcaggtttaaatttccatatatttgtatagttttgaagcttcctttggagttaatttctagttttattctgctgtgatcttagagaatatttgatataattttgattttcttaaatttattgagacttgttttgtggtctatcttggagaatgttccatgtgttgatgaaaagaatatattctgcaattgttgggtagaatgttctgtaaatatctgttaagtccatttgttttagggtatagtctgttgtttccttgttgactttctgtcttaatgacttgtctagtgctgttagtggagtattgaagtctctcactgttttgttgccatgtatctcatttcttaggtctagtagtaattgttttataaatttcggagctccagtgttaggtgcatatgtttttgggattgtgatattttcctgttggactaatccttttatcattatataatgtctatctttgcctttttaaactgatgttgctttaaagtttgttttgtctgatataagaatagctgttcctgctcacgtttggtttccatttgcgtggaatatctttttccacccctttaccttataagtttatatgagtccttatgtattaggtgagtctcttgaaggcagcagatacttggtagatttttatccattctgctgttctgcatcttttttttttttcttttttttaattgggacagtctcactcagtcacccaggctagagtgcaatgacatgatctcggctcactgcaacctctgctccctgggttcaagcgattctcgtgcctctgcctcccgagtagctgggtttacaggcacctgccaccatgcctgggtaatttttttgtatttttagtagagatgggcttttgccgtgttggccaggctggtcttgaactcctgacctcaggtgatctgcccaccttggcctcccaaagtgctgggattacaggtgtgagccactgtgctggcctctgtatcttttcagtggaacatttaggcaatttacattcaacatcagtattgagatgtgagatactattttattcatcatactagttgctgcctaattacctttttttgtttgcattgtgttattgttctgtaggtcttgtgagatttatgctttaagaaaggttctattttgatgttttgagattgtttcaagagtcagaactccttttagcagttcttgtagtgctggcttggcagtggtgaattctctgagcattcgtttgtatgaaaaagactctattgctctttcattataaaatttagttttgctagatatggaattattggctgataattttttgtttaaagagactgaagataggacccaattccttctagcttgtagggtttctgctgagaaatctgctgttaatctgttaggttttcctttgtaggttacctaatgcttttgcctcacagctgttaagattcttttctttgtcttgactttagataacctgatgactgtgtgcctaggtgatctttttgtgatgaatttcctgggtgttctttgagcttcttgtatttgtttgtgtgtgtgtatgtgttttagaccaagtcttgccctgttgcccaggctggagtgcagtggcacgatcttggctcattgcagcctccacctgccaggttcaggtgattgtcctgcctcagcctcctagtagctgggactacaggcccacaccaccatgcctaggtaatttttttttttttttagtttagttggggtttcaccattttggccaggctggtctcaaactcctgaccttgagtgatcctcctgccttggcctcccgaagtgctggattacaggcatgagccaccacgcctggccaagctgcttgtatttggatgtctagatatctatcaaaaccggggaagttttcctcaattattccctcaaatagtttcctaaacttttggatttctcttcttccttagggacagcaattattcttatgttgggtcttttaacgtcccaagtttcttggaggctttattcattttctaaaataattttttcttctcttttcttttctttttctttccttctttcttttttttttttttgagatggagtctccccctgttgcccaggctggagtgcaatggcgtgatcttggctcactgcaacctcctccgggttcaagtgattctcctgcctcagcctcccgagtagctgggactacaggtgcacgccactgtgcctggctaatttttgtatttttagtggagatgggatttcaccatgttagccaggatggtcttgatctcctgaccttgtggtccacctgcctcagcctcctgaggtgctgggattataagctgagccactgctcccagccaaaattattttttctttgtctttgtcagattgggttaattcgagagccctgtctttgggctctaaaattcttctacttgttcagttctgttgttggaacttttcagtgcattttgcatttctctaagtgtgtatttaatttccagaagttgtggttgtcttttttttatgatgtatatttctctggagactttttcatccatatcctgttttttatttttttttttatttgttcaagttgtttttcacttttctctagtgcccccttgagtagcttaataatcaaccttccaaattctttatctggcaattcagagatttgttcttgttttggatccattgctggagagctagtgtgatcttttgggggtgttatcaaacttcgttttgccatattaccagaattactttcctggttcctttttatttgtatgtttcagtggaaagatctagaactgaaggactgctgttcagattttttttttttgtcccacagggtgattccttgatgtggagtcacccccttcccctagggatggggcttcctaggagccagactgaggtgattgttattaccgttctgggtctagccacccagcagggttactgggctccaggctggtgctggcgaatgtctgcaagttgtcttgtgatataatctgtcttcaggtctcccagctgtggataccagcacctgctgtagtggaggtggcaggagagtgaatgctggttaggctagcggttgaagttgtcatgtggacagactcaggacctctgattagccagggagttgcaggcagttgaattagctgctgttttctccgttggaacagagttgttctgttaggagttgctgaaatggcttgagttggttggcctccagtcaggaagtggcaatttcaagagaggagcagctgcggtagtagaagggggatataatcttgccctgcattggcaggataagtactggggtttctcagatgatggacaggcccatagagctcccgagagttcatgtcttttgtctttggagttttttggctgtcttgtggcatttgcagcagtaaactgcttttttcaaagggtctgtctctctgtttttttgtggacagtcatgcagaagtatcgttagaggacaaatgggtatgctctagcagtaacaaactgggggaaacttagtaagtcctgtttgttcagattcctctttgtgtcttctctcctacaggtatagggaggacacctctggattgaggatcttatgacctactttagaggaaggtgagataaaccttcttgcttctgcttttttctcaaatgccaaggtgccatattttgggtagtctgtcttaaatcccatctttgagcttctgttatagagagaacatgtaagtagagggggattcataagcagagagaggttaggaactagggtgcaaatttcagtgtcattcagataaagtaatagatgaagctttgagaggtgcagcttgacttttcttacaagatgggaataagggaccagagaataaggaagagtatttaataatttcagttcaagtgaagggactagtataatgctttatacaggttgaggatccctaatcccataatccagaatgctctgaaatctgaaactttttgaacaccaacatgacaccgtgtggaaaatttcaaacctgacctcatgtgatgggttgcagtcaaaatgcaggcatacaacacgcagtttattaagcaccttcaagggaaaaataaaattaccttcaggctatgtgtatgtataaggtatatatggaacataaatgaattttatgtttagacttgcgtcccatccccaagatactcattatgtacatgcaaatattctaaaatctgaaaaaattcaaaatctgaaatccttctggtcccaggcattttacataagggatattcaacttgtatttacagttagtaaagtgcttttgcctacctaatattgtgacatttttaaaagtttgatttttcaaccttaacttttcaaatgtattattatacttgtacacattaactcattactatggttttgagctttcctattttctaaaccggttttcttacgtctctgctgtaaaaaatattttctaagataatttgtataacttgaaaagtcttaccacaaggtgtcattgtaacctataaaaagaatttccatgtaaacatttgcgttatcatttgtacaatttttacatttttttgtgtataaacatttttttgtttcatatctcttattttttagttgtatcctaatagattgtgtatctcttgtattaaaggaaaaaataaaatagctcatgttcttgagttctcatatttttgcacaaacatatgctttccacccacaaattctttaagagtgtgttgctatagagatgatttgtttgaaggaaagaatgaggaggagtagcagcaggtggacatttaaggaacaaaatccttattttatgtctttgttcccgacagagccagctttagagtttgcccctctgcttatgaaatccctatggaaaaaaggtagttattctgagtgttttacagtgatggtatttgcagtttactaagattcatttgccaaaggtcagtgtacaggattcctcattcttatgtaggattagtgcttgaagtaattgtaatctttgaaacaacctttctttcactttaactggattccattttagtgtttattctttgctttcctatcttggtttcctgataggccttttaactagtgacattaaaatactttttgctgggggatgggtataggtatctaattattaactcctgctcttgctgcccccaaattaattttcttttcttttcttttttttttttgagacagggtctcacctcgtcacccaggctggagtgcagtggtgcgatcttggctcactgcagcctcgaccctcctgggctcaagcgatcttcccacctcagccacctgagtagctgggaccataggcacatgctaccacaccgggctaatttttgtatttttcttagaaacaggctttcaccatgttgcccaggctgttcttgaactcctgagctcaaggcatctgcctgccttgacctcctaaagtgctaggattataggtatgagccactgcgcctggcttcaaattaattttcaagattattgactacctgctgctactgtcttagttaaggccctcattattactttcctggacctttgatctccttttctttttctctttcttctattcttcctcctcaaatctatcctctgcaaataaacgacttatttttctgaaatgtaaatgtgagtctacccygtaatgtcttctatccatctaaaagtttaaaatctttcactggctctccaagaccatggaataaattccagtcttctgcatgtggccttctaggccctaccttacctccccagggtgttctcctctcctctgccctccaccactaatgttcttctccttaatctccattattttgcacttgatgtttcttccttgcatccctttgttaattttagctgctgctttgtgaagttttccctggcagcttcactagcagaattagggttctctcccttgtccattcatactactggtaaatatgttataatattttataatttttttgaagttcctctctttttaaattggcacatagtttacatatttatgaggtacatgtgtatttgttacatgcatagaatgtgtaatgatcaagtcagggtacttggggtattcatcaccttgagtatttatcatttatgttgggaacatttaaagtcctctcttgtagctactttgaaatatatatgattcaaattaattattaactgtactctgctctgcgacattagaacttgtattgtctatctaactggatatctgtattcattaagcaacctccctttatcccaccttcccccacacacatacttcctggcctttgatatcattttattctctacctccatgagatcaactttttttaagctcccacatgagtacatgtgatatttgtctttttgtgcctggcttatttcacttattgtaatgatctccatctttatccatattgctacaaatgacatgatttcattctttctcatagctgaatagtatttcaccatgtatatataccacatttaaaaaaaacagttcaggccaggggtggtggctgatgcctgtaatcccagtactttgggaggccgaggtgggcggatcacgaggccaggaggttgagactgtcctggctaaaacggtgaaaccctgtctctactaaaaatacaaaaaaaaaaaaaattagctgggcgtggtggtgggtgcctgtagtcccagctactcaggaggctgaggcaggagaatggtgtgaacctgggaggcagagcttgcagtgagctgagatcgcgccactgcactccagcctgggctacagagcgagactccgtctcaaaaaaaaaaaaaagaaaaagttaatccattaatggacacttatgtcgattctgtatctttgctattgtgaatagtgctgcaataacctgagtccaggtatccctttgacatgctgatatcttttcctttgaataaataccccattgtgggattactagattgtatactagttctatttttagttttttgagaaatcttcgtgctgtttttcatagtagctgtactaatttacattcctaccagcagcatataagagttccctttttctccacatccttgccagcatctgttgttatttttttatagtagccattctaattgggataagatgatatgttgctgtggttttgatttgcatttccctggtaattaatgatgttgagaattttttcatatacccattggtcgtttgtatgtattcttttgagaaatgtttgtggcctttacccactttttaatgaggcttttttttttttaccgttaagttttgattttcttgtatattctaggtattagtcccttgtcaggtgaatggtttgcaaatattttctcccattcagtgggttttttcttcactctgttgattgtttcctttgctgtgttgaagctttttagtttaatatagtcccacttgtctatttttgttcttgttttctgtgcttttgaagtgttagccatactatttttgctgagaccaatgtcctgaagtgttttccctatgttttcttctagtaattttatagtcttgggtcttacgtttgtatctttgatccatcttgagttgatttttgtatatgtgagaggtagggatccaatttaatttttctgcatatggatattcagttttcccagcaccatttattgaaggggacattctttcccaaatgtatgtccttagtgcctttgtcaaaattagatggctatttgtggatttctttctgggtgtaataatgtttcctttgtatatctgggtgctcttgtgttgggtgcatatatgtttagaattgttatcctcttgctgaattgatcctcttactattatatcatgacctttgtctctttttactgtttttgacttaaagcctgttttaacagatatatgtatagctactcctactcctgctcccttttagtttctgtttgcatagaatgtctttttccatccctttactttcagtctatgtgttgttataggtgaaatgaatttcgctgtttttggaattctctttttgtctttgattgttgacagtttgactataacgtgctttgtggaagacctttctgcactgtatttgggaatctctgagcctcttgtatctggatgtttaaatcccttgctagacttcggaagtttttatctgttatttcattaagtaggttttctatgcattttattttctctttgccttatgagactctgaaaatgagaatatttagttgccttgtggtgcccatatgtcacaaaggctttgctcactgttttttattctttaccttttgtctgattgggttatttgaaagacctatcttcaggttctgagattctttcttctgcttgatctagtctgttgttgaagctttcaaatgtattttgtatttcactcagtgaagtcttcagttccagaatttgattctttttttttaatgatacctatctttttcataaatttctcattcatattctaggaattgtttttctgatttctttatgttatttttcagtattctcttgtatctcactgagcttctttaaaatcaatattttaaattctttttccagaattttgtgaatttatttttgattgggatttgttgctggagaattattatgttcctttggaggtatgatattttcttgctgtgatgttagtagctgggtgggtgagcccaatctcaggttcctgggaagagtccttagttgccaatggtggctgagttgtgtgatctccaggcctctggattgtgtgctctggcatggggggtgggtgaggccaggtgggcttgtctttagactccccagtggtgcgtataggtgctggctgtgttaggaaggggtggggtgatccttaggcccccagcacaatgttcatgttgtgagaggcagtgtctgtgctgcagccctactgctggggagggcagagttgctttcagtgataccagctatatgcaggcaagtattaggaacatgcatttcacttgcattttagccctggtggtggcagaccatacttggcttgtgtttcagtcctggtggtgcagcctgtgtttcactcacattttagtcctggtggtggcagctcatgcttggcttgtgctttagcctgggcagtggaagctcatgctttgcttattccttagtcctggtagcacagtgatggcagctgtgggtgagggactctgggcacatgaaaatgagtggtggctccactgctggaagcagtggctgagattggagccagaggcgtgcactttggccccagcatcaggaaccaggcatggtggtagctgtgggctgggtatgtcagtgggactccagggatgtgaagagacaggtgctgttaagcccaagcacaaggtgcagtctgttgggactgagttctcaaaatggtgtcttactatagctgcaggactgggatggggagtggagaggttggtgtgccccagcgtgagctccctctctggagcaatgctgttgtgcactcttcatgcagttccctttgttagtttcagggcctgtgagggtccagggcctctactgtggctaggattgcaagtatccatggtgggaatgtggacccctgggcatctctcatttaccctttcccctgactgggaattctctccaggctcttagctaatctcggataagcaggctgcctcacttctctctctttccttgatttaggtgtttcctgtcacctctttgttgaattccttaatgttttacaatttaaaaacttcctgaatttatgactttgtataggtaatatgtgcacatggtaaaaaaattttaagtccagaaagtttaaatagtccattttctctcatccttattcagtcagcaattgttggttaacaagtatattccactgaccatcataaactccttgaggacaaggattttcttttatttatttctgtattcctgtatccaacaaagtgtctagcatattaaaggtacttagaaaatatccatggagtactctgaatatgggcaggctcttctttcctcatgagaagtgtgcttgacttgatggtctgtatattttttatatctctcaaaacccttttactgtaagtagaccattcagtaaatgtggtatagcagtcacttaataaatattggttgtttaatcagttttttaaagtatatggttttaacattaacctgtgtgtcttgaggatggcttttatttatctcctttttctggctgtgaaaaattttatacttgctttgtgacagattcaaaataatgaagagaatgtttgtgttaactgcagtaaaatatcagttaaactcagttttaagtatcaatttctctttaacttttcagattacggcataaatctcatagaartaaaattaaatcaggatttatttaaaaaacaattttcaggatatgctgttgcatcagtagataatctttattgtgtattagcagccatattatgggtagccttttctatttcagaagaaaggtgggactgtgagcaaagaagaatatacaactcacacagaggtgctaagtgctcataaatcttctggaaagtccccatgttattgtaacagaccttacattaagaaatgttaaaatgaatttggacaagaatcatctttgcctttcagatcacaactttcagagactttggtaatttacactaagcatttgaggttgagtcattactatgtcctactttctagattcttttgtgtgaattaagctgtgcagaggcagacagtacaatcgtaaaaatagaataacattttaatttagagtgcttggtggttgattgctaaccacttgaatacatatcttcttccttttctcattccttgctctcccttgtttctttctaaatcacaattacagagcctggcaccttaccagggctttgaagggtctgctcccagctgcacttcaggttctggcagggcgtcaagttgtgactttttttttgtacgcaagacatcctggatggctatccaaaggctgtttgggtgactagtgcaggattatctctggattttgaagaaattcatttctaatgttttgtttataagtaaagtaaatgcctggtgtaggtcctccctagacttttaatgttgttttttaaaaaacatcattcactttgagggcatgtagtatttaaaacattgttttgaaatattcaaaggcatagcatgtgcttttaatggaatgtgttttggaagctttccatgagcatcagcagctgtgcttttttgaatattttgaattaccatactttggggcagacattgtactactcactgcttaaaaaatacagtgcctatgcaaaataaaatgtcatatggaggtctgtaaagctgggactagtcaaaagaagtggtaggaaggacacgtggatgtgattatgtatttgtaatggttgcaaagagaagatgaagaatttggaaaaaggttgtactagtcttttaaaaactgcctttcactgagactagcccaacaagtgctcactgattaacaggccaatcgagataatgtttcactttttttcacttattgctgtttgaactctgtactttactttaaaaaattttcaatatgaatttctgtatttagtaaactgcacagtaggagacgttttattgtgtatttcaagcatctaatgtatgtgtaagtgtcttgcagataattgatagctgtgtattgactgattgaaatcaaagaagtctaaccatggtaggaatttaaaattgtgttagaaattttgagtttgataaacctttttataagtaaatataaatacaagagaaagccattgtattagttacttgtggctgctgttacaaattaccatataataggtgtctcaaaacaacaaaaaaattattctttcaacattttagagattagaagtcagaaatcaagttgttggccaagccacgttccctctgaaggctctgggttagaatcttttccttgccttttccagctttttgtggctgtaggttttccttggcttatggctacatctttccagtctctgtctccgtggtcacattgcctcttcctcttcagtctcaaactccctctccttctctcttagaaggatacatgtgattgttttggatacataatccagcataagcctctcctcttaagatccttaatttaatcaccccaccctttttttaaaagtatataaggtaatattcatagcatccagagattaggaaatgacatattttgagggctagcattcagcccactattgtttggaagactgtttctgaatttggaggagaaaagtgaatcgaggctaaagtagcattagaatggtgagcacattatttgttcatttgttatttttgagctcttaatatgtgcctgtggttttttaggtgttgggattatgaacatgagtaagacatgtttcttgtcatggacaaagttacattccatgtgttgtatatactaaaatgcaagataaaacacagaataatgaactatttgggagggtctttacttcatggaggaagtaatgcattcctgagctgggttttgaaggctgaataggaattcactagatcagaatacaaagagatggaaaaagccttctgagcaaggaaattagcatttacaaagccatggcggtagaaaacagcagtatgtgctcaggaagctaaatggtaattagtgcaatgagacaaattttagatttgttttcatttcttttttttttttttgagacggagtttcgctctgtcacccaggctggagtgcagtggtgtgatcttggctcactgcaagctccacctcccaggttcacaccattctcctgcctcagcctcccgagtagctgggactacaggcgcctgtcaccacgcccagctaattttttttgtatttttagtagagatggggtttcactgtgttagccaggatggtctcaagctcctgacctcgtgatccgcccaccttggcctcccaaagtgctgggattacaggcgtgagccaccgcactggcctgttttcatttcttatatacacattagctattaaaatctcccattttgccagctacagcataaatattctttgctgtgatggttcttaaagcaaaaatcttttcatagattaagacggtctgtgaacagccattaaatacatgaaaaagtgcttcaggaaaacgtaaattaaaatcataaggagataccactttatgcctcctagaagggctacaattaaagggactcacaacatcacattattacccacacgacagatgggtttggttgcttggcaggtatcatcaactcagtgctcacaaccaaagaggatttagcatgaggattttattacttgcaacaagtaaggagaacatggggatagttcctaaagcaggggcctgagtcaggttttataagtgtaggataacaaggcatgatctgattggatcttgcaatgaggtggtactggaggcatgatctgacaggatccctccatgggatgatgccagagcttgatctgattggatcctggatcctgccatgcaatgtctgcttcttaattcagtccccatttcttggtccaagcacttaggttcctcctgagattgcagtcttggctcatctgagcatgctcaggttatgtgagctgagggtccatggcagctgaaaaataactcacaatttattacataaaagttgaaccagaggcagccccccttcatctctctcctcctgctccttttctcctcctttctcctccccctcccttttttcctccctccctctccccctttccctcgatcccctcctccctccctccccgtctttcttaccccctccctttctctctctctctctctctcactcgttccctaacattaaagagaaaatgctgctatccgtgacttccaggcccgggatttctacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccgtactggacaagaccacaaacaaatgtaaaggctatggctttgtagattttgacagcccttcagcagcacagaaagctgtaacagcactgaaggccagtggtgtacaggcacagatggtaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccratcccttgctttgcaaatttgctgatggcgggccaaagaaacgacagaaccaaggaatatttgtgcaaaatggacgggcttggccaaggaatggagacatgggcatcatggccttgacctatgaccccaccacagctcttcagaatgggttttaccyagccccttataacatcacccccaacaggatgcttgctcggtctgcactctccccatacctttcctctcctgtgtcttcgtatcagagagtgactcagacatctcctctayaagtacctaacccatcctggatgcaccaccattcatacytcatgcagccttcaggttcagttctgacaccagggatggaccatcccatttctctccagcctgcctccatgatgggaccccttacccagyaactgggccatctctgcctcagcagcacaggcatgtatatgctgacggctgcagctatgcaaggagcttacatctcccagtacacccctgtgccttccttccagtgtttcagtcgaggagagcagcggccaacagaaccaagtggcagtggacacaccctcagagcatggggtctattctttccagttcaacaagtaacagtgggattcccctccccatctttactgagtagaaatgaattcttggagatactcatgctcccaaattccagagggttaaccaggaatggagaccatcygtyggccctgctaaggactaacacttagccatcgtttttcacaggcctgggcctggaaaaagaaatctctatgttcctgccctttactgttgctgatggagcctgggggagccatcactttttttgtgtgctacattcaaggagatcaaaaaaactttttttcttttgcaaaaaaaaaaaaaaaaagttgaaccagattggtctggtgcagctacaaggtattgggaaaaatgtggcgcaaacagaattctcaatatgttggctggacatggtggctcacacctgtaatcccagtactttgggaggctgagatgggcggatcacttgatgtcgggaattcaagaccagcctgaccaacatggagaaaccccatctctactaaaaatacaaaatcagccgggtgtgctggcacatgcctgtaatcccagctacttgggaggtggaggcaggagaatcacttgaacctaggaggcagaggctgtgatgaactgagattgcgccattgcactccagcctgggcaacaagagtgaaactccatctcagaaaaaaaaaaaaattctcatatgtttttggttggaatagaaaatggtacaaccacgttggaaaaagatttggcagtttcttacacaaagttaaatataaacctgctccatgacccagcaattccactcttaaatgtttaccaccacccacccccaaactgaaaatgtgtccacagaaagtcttgtacaagaatattcatagcagctatattcattgtaaccagaaacaaccaaatgcgcatcagcaggagaatggataaacaatatgtgttatatttaaatgatgaaatgctatttagccttaaaaaggaacagactactgagatacacaaaaacataggtgaatctcacagctatttgggtgaaacaaggcaaatacatgagagtacgtactgtatgatttcactttaatatgttctggatcaggtggagctatggtgagaataaccacaaaagtggttgcctcttgtgggtggggtgatggggaaggagtatgaaggaactttctggagtgatgggactgttttatatcttgatgaaattgaggctttcttgaattcttccttttgtgaactcatgaaattgtgtgcattcatgtgctgcatataaccacatacacaacagtggtaccataagattataatggagctaaaaaatttctattgcctagtgatttgtgttacagttgctgttggaaatgggtattcagtgtcgcggaaatcaacactatgataaaggatctcccagcaaggctaatttactttctgcagaaagggtgccactcactagcagtcttgccatgagagcacatacaaacaaaggagacagggtcatttataatctaatgcgtccatgctatggctktgtccagtttccattggctggaacgggacttcacattctgttcttgtcctgattggctagcaacttagaacctcccaaaagaggtaaaggtaggggagaacaaaggaaaggaggaagtaacttgtggaatgctgagaaaggccaaaacacctccaaataaggaagagaaacaggctataacctaatgcttgcttgggcctatataggcatgccagggcaaatatctaggccaaaaggtgggggctaagcacacaaagcatattggtttctttattatggctagcagatatttaagaatattaccacaggtctttgagtaaattttgcttctaagagaggctactatttattctcaattagactggaaggaaagtccctttgaagaggaacctctacttcattttgtacagttgcctccaatatttagtacagtaacatgttgtacaggtttgtagcctacaagcaataggctatataccatatatcttaggtgtataataggcgatatcatctaggtttgtgtaagtaccgtacattctttgatgttcacacaacaatgaaattacttaacaatgagtttatcagagcatatccttgttaagtgatgcatggagataatatttgtgcatttcattatrtgtaaattttacttaaaggactataaacaagcacatgaataaaggagaaatagtagaataaatttttaaaaaatgaatattacatatccatgtggtagcctcacaaccatgaggagaattaagccaacaggatttgttggaagaaaaatgaaaaggactacagtccttgacatgatgctgagcccaatttttgaattactctcccttctaagtccctttttaaaaaattgtgaattataaggttggttgcagtggctcattcctgtaatcctaacattttagcaggtcaaggtgggaggatggcttgagtgtgggagttcaagccaagcctgggcaacatagtgggaccttgtctctacaaaataaaaataaaaattaaaataaataaaaaaaatttaaaaagccaggcctaatgacatgtgcctgtagtaccagctacttgggagactgaggtgacttgagcttgggagattgatggtgcagtaagctgtgatcatgccattgcactccagcgtggatgacagaatgagaatgtctcaaaaaaaattatgaattataatatacatatagaaaagtacacaacaatgtacagctgagtgatttacaaagcaagttacaaagcaaacctccatatatccacaaaaatcaagaagtagaacgttactagcctcatcaagtaatattttcctgactttaatgataatatagttcctttctttatacatgcttatacctaagcatgtatcccctatatactatagtgcttgtatttaatttttaaactttatatatttgtaataatctatttgtaataatttagtgtatattcttttatgtttggcttcttctggacaatatgtctgtaatattcaccctatatatatagagtatctatagcaggggtgtccagtctttcggcttccctgggccacactggaagaagaattatcttgggccacacataaaatacactaacagtaacgaaagctgatgaactaaaaaacaaaacaaaacaaaaaaaaccatgcaaaacaaactctcataaggttttaagaaagtttatgaatttgtattgggctgcgttcaaagccatcataggctgtatgtggcccatgggctacaggttggacaaacttgatctatagcttatttttattgcagtatagtgctagttccattataccactattcgtttcttcaactgttgatggtcattggatttgtttctaggtttcagttgttaggaataatactgctatgaacagtatcatataaatctttttgtggacctgtgtataccacatttcaagtggatatatgcccaggagaggaattactgagtcatagtatatgtatttttttttaaccttagtagataatgctagtttttttcccaaagtgaatatgccagtttacactacaacctttgcttcctctcctctccagacttatcgtcagtctttttggttttctcattgagatttaaatattatgaataatttttacaaattagtaattgaaaagacaattcaatagaaaaaattgggcaaaagatgcaaatggatattttataaaagaagatatctaaatggccagtaaacaaagaaaaggtgctcggtctcattatttatctgggaatcaccttttagattttagacgtgctatttttcctgccttgagttactgaatattttttcctatattgtggcaactttgtgcttctgcttttcacatttagatcttcagtccaactagaattaattttagtgtgtaataaaaagaaaggcgcaagtttctttttttctacaaggttatctagttgtcccagtggcctttattgaagactctcttctccttacggttcagcaaaaccacctttgttctaaattatcttatatgggtaggtcagtttatgggctgtgtcctgttttattggtctctttgtctataattaagccaatggcatactataccatcttaattactgtatatttgtagtaagtactgatatatagtaaagtcttctcatttttttctttaaaatcatttccactgttgttggcctgtcttttgtatttccacataaatttttgaatcagcatgttaagtttctcacacatagagacacactcatttggatattaattgatatcacatcatctgtagattggggagaatttgtctctttagaatgttttctaatccatacacctagtccatatctctattaggtcttttttagtttgtttcagtagctagccacagttttcctataataaatagtttgcacatctttttacctaggtttttgatattttttatattattaagaatgtctttaaacatacattgttgttaaagaatatcactattgaaaaaaataaaaaatattttgttgctggcatatggaatgcaattaatttttgtatattgctctatctgccaatcttgctaacttgctttttctaattatttttctgtaaatttgtttagattttctacatacacaatcagaacatgtgtatataaagattttttttttttagtttttataccttctattcctttgttttgttctagttcttcaatacaatattgaataaaagtagcaataatggactttcttgttttgatcacactctcagaaaaagatgttttaagattttaaagtcaggtgtggtgttttaaaatactctttttatatacacctttgatgagattgatgcacttttaagtttctagtttgctaggtttatttttctctttttttattgaggtgaaattaatatagcataacattaactattttaaagtatataatttagtggcatttattacattcacagcattgcgtaacaactaccattatctagttccaaaacattttaccacatcaaagaaaaccttgtaaccattaagcagtcaactcccatttccccattcccttagtccctggaaatcatcagcctaccttctatgtatttatctattctggatatttcatataaatggaatcatacaccaagcacaggaatggtaggtattttttgttagttctgacagtccctgagctgcttatttattttgtatgtctattttctgtctattgttcagccgagtaatttctgtagttgtatcttcccagtgcattaattcttttcctcttcctctctatttctgctgatgagctcatctaatatttttattttggtcattgtatttttttcttttctttttaaagacagagtctcagtctgtcacccaggctggagtgcagtgacacaatcttggctcactgcagcctctgcctcccagattcaagcagttctcctgcctcagcctcctgagtagctggactacaggcgcatgccacatcacctggctaatttttgtgtttttagtagagacagggtttcaccatgttggccaggctgatctcgaactcctggcctcaagtaacccacctgcctcagcctcccaaagtgctaggattacaggcatgagccaccaggcttagccgtatttttcagttttaaaatttccacttggttcttctttttaccttcttttctgagacttgtatttctttgctgtgaccctcttttcatttatttcaagcttgtttgtcattgtttgtttaagcatttttatcatcagtgctttaaagtctttgtcagataaccataacattcctgtcatcatagtgttggcttgttatcttttttcattcagtttgaaatcttcattcttgatatgatcagtggatttctttttttaatgtatgtatgtatgtatgtatgtatgtatttttgagatggagtcttcctctgttgcccaggcgggagtgctgtggtgtgatcacagctcactgcaacccctgcctcctgggttcaagcgttctcctgcctcagcctcctgagtagctgagatgacagacgtgcaccaccacaccctgctaatttttgtatttttagtagagatggggttttgccatgttggccaggctggtctcgaactcctgacctcaggtgatccacctgcctcggcctcccaaagtgctgggattacaggtgtaagccactgtgcctggccgaccagtggttctctatcgaaacttggacatttgggatattataatattgtggattctatctaaactttttgttttagctggctttttctgacacttttctggtagaggaaagagggcatactaccttgtttttgccaggtggagatggaagtacaaggtttttttgtttgtgtttttgtttttttttaagaggtgggaatcttgctttgttgcctgggctagagtgtggtggcataatcatagctcactgcagccttgaactgggcttaagcaatcctcctaccttagcctcccaagtacctgggcatataggcacatgccaccatgcctagctaatgacttttttttgtttgtttttgagacaaggtctcactgtgttgcccaggctggtctcgaactcctggtctcaaccaatcctcccacctcactttctgagtggctgggatttgcagtcacaagccatagtgcctagcaagtcgaggtttctaagatggcctctgttgacaccttagttttttttgggaggggggttgcgggaggggtctttgttattgccaggtagctgtagttctggctccccatgtgatcttccctgataccctggagagggtagcctcattactgttggtggttctgcctgtcataagtctccactaggccttctgtgccagcatttcagtggggtgagggaggtcctctttgttactcttggtggggggtgaaagtttaggttttccatgtggtctcctctgacattgcaggatcattgagctttattacggttcaggaagcaatggaagtttctgttttctggtgagccttcttgtgcaccatcttggcccagtattagggtattttattacagcctagcttggcttccacctaatctttgcttgtgtggatgggggtggaactacagttttktkttgtgtgtgtgtgtgtgtgtgtgtgtgtatggtatttggatagagtagattgtaattgtctacatattatcttgctaggctccctcttttttgttcctttggctagagagtaggcttttttgttcaagacttatttgtctgaattaattggtgtttcctggttgccagtttcttcagctctgtgtctgagatatatgaaaaagaaaacccagggaaataaactcaccactgtatttgtccttacattctcaggtccatagctagtcagccttctagtctccattattcagagtcttacgtttgtcatatacctaaatccaggactcttagttatattaatgagtataaaaggaaaatgtatatctgttccatcttcctcaaagtagaaacctttattccataagttttaaaatggagtatcaattttcatttagtactacatattttctaatttctattttgaccttttctttgattcataagttatttagaaatgtatttcttactttgtaagcatatgtggcttttctgattattttttgtattgagtttagtttaatagcattgtggtcagagaaggtatcttgtatgatcttggtcttttaaaatgtttgaaattttttttaaatacctggcatgtggtcaacatttataaatgttatgtgtatacttgtgaggagtgtgtattctgtagttacagggtatagtcttccatatgtcagttaggtcagcatggttaattgtgttgtttaaattatctgtgttcttactgattatttttttaaatcttcttgtcccattagttaccaagaatagtggtgaaattctcctcctatcattgtgaatttgtctatttctccttatagttttgacaacttctgccttactatttagtggccatagtaagtgcatgtaaatttaaaattgtcacatctttctggtgtatttaacctttatcattattaatttctctctccattttaaatagtgggggttttttgccttttaaaatctacttttattattttttcattgagagcaatcaataagaaaatcttgttttaaaagagaagatcaaattttagtgttgtatcagtgtacttttgatatgaggactcaattttaagacaaacctataaacaatttacttttcattttagccaatttgttcacaaataaaatttctttcataagattcatctctcacaaacctttcataatttgcccagaccttctacagcttgctcagtcctttagttttgtcttatatttctcttgtttatactgaaacaatcattttaccttaggacaaaaatttacttccctttttttctatcatttcaaccacataagtttttttatacaaaaattactgtcattctcttttcttaccaaaaatacattctcatagttttttgtgtctgtttttcacttgttcctttctgccttgttttcatgtttttccaaattcatattttgaaataatctttcaataacttctgaattagacaaattactttttaaataaaaacacatttttatgccatttaaaacacttttttcaccaaaaacaaattttgtttttttcttgtaccctttgcatacagaattctatgtattaactagaattttaactcttagcaatcttaatttttagttaaatcttagtaatcttaacttttagtgaaaacctaggaagtaagcaattttgagctgtcacatatcaacattttataaagacacattttataatctttaaaaatgtattttttccacagaataatttttaatgtggaaccaaacatatttattaacccccaaatattttttcttcctgtaaagctttagaagtcaagagtaaatctaaacttacatttaggaattagtgtttccttattttaacttatttggattgctactgcaataaaacaagtcacaagaattttctggtttctcagtgcatggaaaagttatgtttacagtatactgtagtctgttaagtttacaatataattatgtctttaaaatgtagataccttaattggaaagtactttgttgctaaaaaatgctattgatcacctgagccttcagtgagtaatcatctattagcaggtgaagggtctggcctttctgctgatggctgctaactatttagatggttgctgaaggttgggatggctgtagcagtttcttaaaatgagacaacagtgaagtttgccacatcagttgactcttcctttcatgaaagatttctttggagcatgagattctatttgatagcattttacccacagtagagtaaaaattgaatgccagttttatgatgcaattcattaattccttggcaaatgtgtacttttggcaggataattttgtggtagctgctacagatagcgcattctgtatttacaaagattgaatcccagtgcgtgttaaatctaagagtaaggagtatagtgttcttgagggacttttccctctgtattaaaatataatttcagaggaaaccaaaacaactgcaattatagtttaaagattgtcttaagtaatacgtagatatcacactaatttatcagagatggtataattcaagcaaggctgaataatttaatggtcggtttgcataggacaaagatttttttttgttataagaagtgatttgtaataacccatggctaaggaagattctatcaggaaaaaaatatgtatgtatgtgtgtgtgtgtgtgtgtgtgtgtgtgtgtgtgtgtgtgtatgtattatgggactagagaaagaaattaaaggagacaactattttaattaaaatttttgttcttagttataagaacactttgaaacatcattttttatttctagatgaaataaacagtgacgtttgtaatactgagtcagtgcttttggagataggtgagatttagttttcttaacacagtgtataacacataggagttgatcaatatttatgtgttgacaaatttctcatgtgaatctgtagtctgggtgcagcttgccttgtgtcaagtaaaagacccttcaaagcattaatcataggcatagttacttgctgaaggtcaccttttgaagaccttgattctccctagccagttaccaagttccaaatagcttttcctctgatttgggagtatggattttataccaggatctatacttgaagcttactgtggtagcttcaggaaacatgactctggtttgtgaatttaagactacctaaactgggaaagtctgcttctagtggagctaggttaatacttgaagatgtgattttgatggtcatagaagcatagaagctgcatggaggtaaagaaaattgttcaaggtgtgattcagctttatatttgcattttgttttatgaacaaattaaaatctgagaattgggctttgtaataaaaatgataaggagaggctgagcgtggtggctcacgcctgtaatcccagcactttgggaggccgaggcaggcagaatgcctgatgtcaggagttcgagaccagcttagccagcatggtgaaaccctgtctctactaaaaatacaaaaaattagccgagcgtggtggcgggctcctgtagtcccagctactcgggaggctgaggcaggagaatggcgtgaacccgggaggcggaggttgcagtgagtcgagatagcgccactgtactccagcctgggcgaacgagcgagactccgtctcaaaaaaaaaaaaaaattagccgggtatggtggcaggcgcctgtaatcccagctattcaggaagctgaggcaggagaattgcttgaacttgggagtggaggttgcagtgagccgagatcacaccattgcactctagcctgggcaacagagcagactcctctcaaaaaaaaaaaaaaaagaaaaaaaaaagaataataaaagtgataaaaatatgtaacattaaaggaggcttacgtttactgatcgcaaattatgtaattatgtttatttctctgtgcaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggtaaattacttaaatctagaagtggggtttggttttaaaaagttattggcattatcttggctgaatgtttgctatagaatatagtataattttgttattttgcaatgtatacatttaaaacttttttaatatagtaaaatttttactttaaaattactttgttccaaactaagtatgatatcaagtgggttatgaatttataagccttattttgaaagtagcaggacgtataagattaaatgtatccagatggctaaatgtgttccccatctcccaccaaagtaaaattgcattccaaaactacagtgttaataattaaatgaaactctgtaaataaaagatacttgtgggtttaaaggaatgtgtgatattggtcttgtttttctgtggtgttgattgactttacataaagtaatgcaattagaaagaaaggatttactcaaaattgaattctctttaaaaaaaaccaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcaggtgagaaaatatatttgagttttgagttagtataaaagcagtcagatacgtagtggaagtaagtagttttggtgaatatggcaatttctgtctatatccttaatgattactttgctgtatctccaagtggtacaatttaatcttctttcatatattttagaatgttagctaccatgtaagggagccatgaaactgttattttatgtaaattggtattatattgcctattctgatataaataatatttaaccattaagaataattagggaaaaagtgagtttgaattgataaaaattcagaattaaagaatttttttaaaagagttactagtatttgtatatgcattataactgaaagctaaaaaaggacagctattcttaaagagcttcttaaaagagactgtaaaaacagtatgtgaacataatttatgtgtacattgtaacacaaatgggtttgtaaagcaaaagatagttgtctccaaagtgctgaagtacagtttctttagatcattttcacgctattcattttttcatttgtctggaaaattgagcaaagccagactttaaactccagtcaaatttcctgtaaatttcagattagtaggttctcacgaataatattttcccatatttatttaatctctgaagagcaccagctatttatttctgcctaacaatctgattggtacaaataataaggtattattaatattagagtcagaagttcatagagtaagaaggcatctttcaagtcacctagtctggcatatcacccaactcttagatatcctttgacagaagccttgtaagtttgtcattcaataactttttcaaatctaccattgctgggaacaccactaagcctggcttggagcctccactatgctcactgtttcattcctaggtatatttaggacatttaaatatacaaatataaacctcagaaatgtaaatcgaagagggaaatgtaatttaagcctgtagaatcaatgcattaatttgttttgcaaaaatttagagccctgtatgagtggaagytgtgaatgctgaacccaagatatttgagagattcttcaggtattgcaaatttaattattctgtttcatgagagtgacatctaaatgtgattatttgtaccaagcacatccagaaagtaagtaaagcacatccagaaggctggagtagttatattaattcagataaaagagacttccagacaaagagtatcactaaagataaaaaggatgtttataatgaaaaaaaagggacagttcttccagaagatgataacttcaacaagtaactatgtctctatgcctagttttctcatgtggtaaagcggataaaagtttctgcttaacaagagttgtgaggactaatgagataacatctacatttttactgccatactttccacatagtaaatattcatagattatgacatgtttatttgaattcaggctccatgaaggcaggaactttttttcagtgtgtcttcagtgtttaggataatgcctagtaaacatctatttgttgaatgaatgacgtgaaaaattgaaataaatgaatgaattgggattgttgttcatatattgcactgtctgtgtcaaacatacctacagcctcagcatcttagagttggtaatcatctagtttttctttgaatctattatgggttgagttgtatccccaaccaggatatgttgaagtcctaactcctagtacctcagaaggtgaccttatttggatgtaggttcattacagatgtaattagttaagctgatgaggtcatattggagtatgatgagcctttaactcaatattactggtgtccttaaaaaaagaggagaagagagatggagacagatggggtagagaggagcactatgtgatggtggaggcagagatttaagtgctccagaagctagaaagaggcaaggaaagtttcttccctgcagattttagggggagcaaggcctgtcaacacaccttgatttcagactaatagcctccaaaactgtgaaagaacaaacttctgttatttaaagctgcgtcgtttctggtattttattatggcaacctaggaaacgaatacactgtccaaagcagaatcctttttagaacatctttcagacaggactctcttcattttctgcttcagtgctttcagtgctagagaacctggtgaactttttaaagtgatccaattgtatttatagattaaagtatgttaaacattttctctctcctattaaaatgaagtcatctaccctatagcctccctgttggtaactttggatgttcctccatgtgaaaacttcccaaatgtttgctcacaaatataatttatctagtaaggcttctgttttttaagataaacatatctagtaaggcttctgttttttaagataaacatatctagtttctgtgtgatatttatttggcaaaaataagctaaagaaacatcatgtatacatataaacacacattttgaagcaatttagctatttgtttaatggatgcttgcaatttgcgcaaattgtaagtttagaaaagtaaattcaacaaagatcaagaaatatttcaatgaaggtttatgaaagatgattatttttaaaatatacgtgcattatctagtctgcctacaaaaatgctttttctaagatttaatgtcatctctttggcttttataggaaaaagatataagagatattcatttaaagaacatttctgcatcagtagtgaatggtaatgataatagtgcctagctcataggatgactgtaaggatgaaatgagacagtgcatagaaagtgttagttcaggctgagcatggtggctcccaccttgagaacttcaggaggcaggaggatcacttgaggctaggagtttgaaaccagcctgggtaacgtaactgggtaactctgtctctaaaaagtaaagtaaaataagttagcctgacatagtggcatgcacctgtagtcccagctactagagaggctgagtcaggagacttgtttgagcctaggagtttgaggcttcagggagccatggttacaccaccacactttaccctgggcaacagcgcgagaccctgactcaaaaaaaagtattagtatggtactttgatctagtaagtggtcagtacatgttgttattgtgttactatgtaccatgttagcaaaacctttttaaatatggggatcatttgatatattctaataaaacggaaattactttaccaatgattaatatactctttttgtgctaatgaaaactgtataacctagtatacaggttcccattttgttttggctgctgggaagctcagatcaaagtataatactcagtttcagtcattaatttattaagaatttttggcatagcagtatttgccgccttaaagtattctttgtaaaagattggcctattttagattattaaatggcaagtactgcagtgttaaagatttgtttttatagatttaaaataggtaatgacacctagactgttgtatgataaagcattcttatgtttctttggagacaagtagtggcaatattccattagaagtctaagacactgctgggtgcagtggctcatgactaatcccagatctttgggaggccgagttgtgtggatcacctgaggtcaggagttcgagaccagcctggccaacatggtgaaaccctgtctccattgaaaatacaaatattagctgggtgtagtggtacatgcttgtcttcccagctgctcaggagggtgaggcatgagaattgtttgaacctggaggcggaggttgcagtgagccaagatcgtgccactgcaccccagcctgggcgacagagcgagactctttctctctccaaaacaaacaaacaaacaaaaagtagcctaagagagaatattttttcctaaaatgggatgggaaaaatcctctaattcagtcggtgtcttggtttatgtgtgctttggaggtataggggataggagagggagagatggggagagacagaggaagagagaatttattatgtgtgtatttgtttttaataagattcctaggaggtaagaaaaagttagagatgctttgtcagagacctcagatcagaagacccctaaactgttgtatgctattagattgcacaggccartggtgaggtgcacaccattacaggatttaaagcactgttgtttccaagaggcatctgtgatgtaattgaacatataatgctagaagctgcatggatattgtgcagctacatcactctacagggtagtgagcacaggttatctttgttctttgcagtgcactttgtctggttttttggctgctgttctctttattgctggttttaagcaatttgattgacatactttgcagttttttttatatctgtagtgcttggggtttattgagttccataggtctatgggtttacagtttttatcaaactgaaaatttttggagattacttctaaaaatattttctttctcctctttcacctcctttggagactcttaattacattctaatattagaccacttaaagttctgccatagcttgctgatgttgtttattaatttatttttartattttttgtctctgtgcttcattttggttagtttctgttgccatgttttcagattgattgattttttcttctgcagtatctaacctgccattaattccatgcagtgtaattttcatctcagaaattgtagttttcgtctctggaagctcaattttgtttttttttttttgttttgagacagagtctctctgtgtcgcccaggctggagtgcagtggcgcgatcttggctcactgcaagctccgcctcctgtgttcataccattctactgccttagcctcctgagtagctgggactataggtgcccgccaccacgcctggttaatttttwaattttttattgttagtagacatggggtttcaccatgttagccaggatggtctcaatctcctgagctcgtgatctgcctgcctcggcctcccaaagtgctgggattacaggcgtgagccaccttgcccggccttggtctttttatctctatccaacatgttcagtcttttctctagttctttgaacatatggaattcagttacaataactgtacaataaagttttaatgacatctgtgtcatttctgggcctgttttaagtttatcccccctgcccccaccacacacacacacactcactctcactctctctctctctctcatgcttctctgcatgcctggtaaatttttattggatgttagatactgtgaactttgtttttaaaatgctggatttttgttgttgttgttgttgttgttgtttttgttttgttttgttttgtttttgagacggagttttactcttgttgcacaggctggagtgcaatggagtgatctcagctcactgcaatctccacctcccaatatttttatattctgatacatgttcttgagctttattttgggacacagttaaattatttggaaacagttttatctttctgggtcttgcttttaagatttaagtgggagcagagtagtatttagtgtagtgctaattatttcccaccactgaggcaagactcttctgagtagtataacaatttctttatgaaacaaaggattttaatctgtttttggggaacagaaactattcttaggtctttgtgagctctgcgtattcatccttctaatcctttcaggtgtgtatttgcctagccttaggtagtttccttgcacacatgtgttaatcagtactctactgaatgagtcaagactttttgtaggtcttcatagttgtctttctgtgccctcttttctctgctaccctgtcttaggactctaaccaccccactgtccttggatgctcagtttcatctcctcaactcagggagtccctcatgactgcataggtatcctttccggtgccaggtcctgaaaactctcaaagcttatcttctatgttttgtgtctctcagggatctgccttttgctttcttatgtctagtgtcttgcaaactgtttaatttttgtctgttcttttgtttgtttcaggcaagagagcgaatctgggctcttattctatcttggctgaaagtggaaggctttttactttcagtttaacttttggttttggaaatctcaaacatgtaatgcattcccatgtacccatcatccagcattaataattattcattctgagccaggcttgttttatctactactttctcccacccacttccacttttttcctcaatgtttctggattattttgaatcaaataatattctttcaacaaataattgagtatatatctctataacaaatcagtgcagtctgtcttaaaagcataatcacaatacctttgccatatttaaaatacttattcattaataccttttaatatcccacctttgttcagattttcttaattttcccatggttttgcttgcctagttttgaagttagatcatttgaaacaggagccatgtaagctttacctattaatctcttccttttaattgctacctcatcttagtttggactcttgatgttgtcacccagacttgatacttgataccgtaaaccagattatgacatgagctttctgtctggtttctttggctccatttactgcctcttcttcccacagctacagctactctcccactaaagcttttgattcatcttgcttcttcgtaaaatatagatatggtagtgtcactcttaagcttaaaaaccttcaataaataaggtacagaaaaatatatgtacaatatcctttttgtatagaaatcaaaagtgatatacatgcttgtgtatctgtagattgttttaggaagggtacataagttattgacaatgattgcttcaataaaaggaaattggattactgaagtgagaagactttttagtcttttgtttgaattattttatttatgtaattgtatatattcattttaaataaaataaatttttaaagtaaatactattgaatactgaataaataataagagtctaaacctggtattcaggaacctttcactctttggctgcaacctaattttccttttgtttccagccagagtgcagccctccaaggtggcatttggaaatgttacagtgtttagatatttctaccagtgtgcatatagggtcccacaattttaaattttctgtagtacttaatgtggtcccattcaaaatggctttaactcacctttgagaatcacttttctcccatacagtctctgacacccaggcaaattaaaatgttacctggcttgagtttgggttctataagctttctatataagggttctatataagctttagttttcccattcctttgacgtgtcatgccttctatcctaaatgtgttttctcttttttacytgtctggtaagcctgtattgcctacttttatagttatttgtgtgtatgagttatttttaacaccagagtttgaagtttttatggggagatatgtgcttcatgtgagtttttgtgatctttataaagttatttagataccttgtgtgcctcagcatagctatactgtggcattgttgtaggaattaaataaagtaatgcatataatgtgcttagaacaggatggtatgtaggttacagtgcattgtacaatgctttatatatagtaagctctccattcagtaaaatgtaatattttgaatacaatatttggactmttcataaaaaaggaaactgaacattatcatttttatagaaattaatatacatgcaaactttagattttttttttttttttttacaactagtatttgttcctccttcattcatgaaatagttgagtggttcctatgtgccagacattggtgggaggtattgggaatacaacggtgaataaagactgtgttttcccacatgggacttacataaatatttaattacttattaaaatacgagttctataaaagagtgtgacaaggagaagcctaaattaggtacagtgtgagagtaaaaatgagccttttctaattgaaaataagtctgaaaggttctctttggtataacaaattgttacacctttattttgcctgctttggaaaataactagactattagccattgtatacaacatgatagtcttagctgccaacatagttattcctaacaatagcaataataatcagtaattgtctttacttcatgttaatggaatttttgacatctccaagagcctgaaattgagattcttaaagtattatttcaaatgatgattctatttgtatagtgatcactgtaaaaaaactatattgcaaaaactttcatgaattccattgtcataattaggagagaggctttgaaatatggagaattcttgattttaatgtgattttatattgtttgcatttctctacatattagatattaactccacaaaaattggaattgctaagagcccaaatacaacaagaattagaaactccaatgagagaacgttttaggaatctagatgaagtaagtaacttatgttgtttactatgcatttatcctcatgggatcaaagtcttgatgaaaagcatcattcccctaccccaaaaccctgcagtagttcccccttttactcagtcattgcagtggcctctaaggcttcacaggattgaactcccattacctctctgatctcctttcctttttccacattggcctactgatgtttctttggcattccagaattggtgcgtttctttatttttatttttaattttatttcttttttaatttttttgcgacagagtctggctctgttgcccagcctggagtgcagtggcgtgatctcggctcacttcaacctccgcctctcgggttcaagcgattctcttgcttcagcctcccaagtagctgggattacaggcacgcaccaccgtacctggctaatttttgtatttttagtagaaacggggtttcaccatattggccagctggttttgaactcctgatctcaagtgatctgcccgcctcggcctcccaaagtgttgggattacaggcctgagccaccatgcccagcctaattggcacatctcttttgccttgaatactctccctccagatacgtcgtggcaaacttcatctcttgtaagtctgctaaaatgtcactttctcaatggggcctactttgactgctcccatctacctatttaatactgcaacctgcctttcccattactgcttagacctttagacccccttaccttgctctgttttttatttttttttctggtatacataccttctactgtgctgtataatttgcttatttattgtgtttattttctgttttaccacctctagaatggaagttgcatgagaggaggaacctttacctgttttgttcattgttatattccaagttcctagaacagattttggtatacagtaggtgctcaattaatatttgttgaaagagagaatgagtttcatgccacttcataaaagtaaaaatctgttacagttttacttcaggttgagactagtctcctttggtgaagtgttgatataatatgactaaatgcttaataaaggggacaggataagactgcagataacaagtatattagatacttggtagacattttatatatgttaccttatttaacaaatatacctggccttatacatacaaatgattattgtccccttcaaaatgggcccctttggagagctgtagtctagtgatgcggtaattgcccaaaacagttgtagaatcgtcttttataatggcttactggcttgataatatgatctttctaatacagtcctaatggcaagccattatggtttgggagtaggtttaatttttgtaaataaacaagatcagacccaagataagtgaccaagttcaataaaaacttttttttttaaatcaaagcaaagtatatctgcagtaaaataatgaaacccattttsttggtttacaaactggcttagaaatctttgaactaaagatttatggtgagctgggtattttaggagacatgctttccttgttatcgaatttcctgttagtgtctcctgtatctttctgctttgtggcctgagtttcttgttgggtattcagaatgccagcagctttcatagagtactgttaggaagcaggatgagaacactccagggaattgcatgtgttcctggttagtcagtagagatgatgctgcacgtattcttcaggttggtctgttgagttaaactatcattgtaatatttaattagatgttaaaatgctgtactaaatattacaataaccttacatctcttttgaatttgttttacttatactaaattatacatttaaaaaatctatattttgaaaggtgtgctacattcttacatgttattttatttaagtccagagatcaacactttcctcatactatacactttatcataatgagaaccagtgaagaaataagattaattgaatggtaatttactttttggatatcttttcaggaatgtactacttctgtatgtaggatacttgttatgaagacctttccaaattcatttgtatttctgttaaatttattttttacttttagagtggctatcattataatgtaatttaaaattatatttgtaaaagtgactattggagtgagtacgaattttgtttataaatctatgataaatgcattctccctttaggaggtagaaaagtatagagctgtatataataagcttcgctatgaacatacatttctcaagtcagaatttgaacaccagaaggaagagtatgcacgtattttagatgaaggaaaaataaaatatgaatcagaggtaagtgattgattatacgagtttctttgttattgttctggtcaacacaattttataattatatatttttaaaaatttcaaattagagtcgattgtatagttttattcattaatggtggagtattcatcatgattttcatcagcttcgtatcaacagtttttttgtgaaagttctgttttgggtgtagatcttttaaattctatttatcctttattttgtccagccaatggagatagacaactttggggagtttcattgtacaaagtcttttgtcttatgtagccacagagatggacttctctctgcaaatatagttagtgtgattccttacttagcattgttctttctgcttcttggaaccaaaccacatatgggaaagcactagctgtcagcctgtgcactttgatataaacaaggggtttataccttaaagtgtacccatcaacttcaagaaatagactttgtttttttctgccatttgcaactggaatgttctctttatgctgcctacagcatacattcccacttcatctccattgcttttggcagcctttctactcgttttgtggtttgtctcctagttttgcccaaaatggggtttctgtttttcattggtcgtgttgcttttggaatatttttcaaattgaaagagaggaatactaattttatcctgccatattcataaaaaataggttggtatctatagttatgtgaaatattctgtttacaaacatatctacattttaaatttattgcattgtctttatttagaattaagagttaaaatatacttaccttcctttaccaattactaaatatttacagtgttctaggcatctaataaaaactaaaactgttctatttggatcggactgatttattcttattagtgagcaaagtgccatgagtgtttcatctgtaagaagctatatgaaccttggaacatttgtgtccattgacagtgtagtaccagaacactataaatatttataatagtttttcacattaaaaaaaactctttatagctttaaggctttaagtgctttattcacatattatctcacttctattacaatagtcagtgagatggggctagactgtcttattttctttgattgattgatcaagaggaggtcttgctctgtggcccaggctggaatgcagtggcgcaataataactcactataacttcagctcaagtgatcctcctgcctcaggtacccaagtagctaggaccacaggcatgtactacctcacctggctaataaaacaaacaaataaacaaaaaatacaaaaactcttgtagagatggggccttgctatgttgccccagctgatctcggactactggcctcaagtgatcctcctgcctcagcctctcaaagtgctggaattagaggcatagactatcgtgcccagcccttattttcttcattttaaatgaataaactaaggcacaagataagtgaatttattgggggaacccacccccaatatttcaatgtaggttctttctattttctgtaagtgttggccggctgagaaataaagagtacaaagagaggaattttacagctcggcccctgggggtgccgtcacatattggtaggactgtgatgcccacctgagcctcaaagccagcaagatttattaaggatttcaaaaggggagggggcataagaacagggagtaggtcacaaaaagatcacatgcttcaaagggcaaaaaggagaacaaagatcaaaaggcaaagggcagaaacaaagatcacaaggcaaagggcaaaagcagaattactgataaggctctatgttcagtggtgcatgtattgtcttgataaacatcttaaacaacagaaaacagagttcgagagcagagaactggtctgaccccaaatttaccagggtggggtttcccaatcttaataagcctgagggtactgcaggagaccagggtgtatttcagtccttatctcaaccgcataagacagacactcccagagcagccgtttatagacctccccccaggaatgcattccttccccagggtattaattattaatattccttgccaggaaaagaatttagcgatatcttccttattgcatgtctgtttataggctctctgcaagaagaaaaatatggctctattttgtctgaccccgcaggcagtcagaccttatggttgtcttcccttgttccctgaaaatcgctgttattctattctttttcaaggtgcactgatttcatattgttcaaacacacgttttacaatcaaatttgtacagttaacacagttatagtggtcctgaggtgatgtacatcctcagcttatgaagataacaggattaagagattgaagtaagacaggcataagaaatgataaaagtattaatttgggaactgataaatgtccatattaaaatgaaatcttcataatttatgttcctctgccatgactccagccggtccctccatttggggtccctgacttcccacaacatgaattgttcaaagtctcagagaatgtcagcagccaggttatagtagaactcagatataccaactcccagcccacagcctgttttgttttagtcagttcccttattgtttttatttaatgccattatattatatttgcatatgccataacatttrcaaaatgcccattctctccagcttcggcttaagaaggagtgggggagaccatacatatgctaagtccatgttcaatgttgtactcctacactttgcacaaagaagaatttgtaatcttccacccagaccctcaaacccacaaaccagtccaccactcgtattctatatgccctatacctgagtctcgacagtgtgtggtcaacacaaaacctggaccttacccattcgaaggtgaccggcagtttgaagttgccactctgattatgggccatccagcaactgcaattttgttaaatagctggtaatatatacactacatgtggtatgaagggttttgaatccataattatgatagacttaaaggaattgcatgtaaaaatttgtggaaaataggaatgataaagatttctagcctaaaacgaagatttagtatattgaagagaaaaccctaaggtttcatatagtggtgctttattttgtactttccttttaaaatctaatgatgatacttatctggtaaggattatttgtattctctagtttcttagttttgttgtttttgaaatagtgaaacctgcattcgaaatctgatgactaatctatttttcacttatgaaggactaagtgattctcattaaaatttttaaggggttggtatagtcattaatttatcattattattattattatttttgagatggagtcttgctctgtcgcccaggctggggtgcagtgatgcaatctcggcttactgcagcctctgcctcccaggttcaagtgattctcctgcctcagtttcccgagtagctgggattcaggcaggtgccaccatgcctggctaattattgtatttttagtagagatggggtttcaccatgttggccaggctggtctcaaattcctgacctcaagtgatcctcccacctcaacctctcaaagttcagggattacaggtggtgagctaccacatctggccatcattaattttcatatgtgatgttttatgatagtcttaagaatctgaagataaactgcaagttaagaagccataattagtagagggtggaaaaataagactgaagtttctttcattttacttcccaattgattatgtaggagcagtattactgagtgtataattgtggatttacttttgttcaatcaccttcatacttcattttctatatacaaaaacagtaaaacctggtgagatgattgtggatcatgaaacagcaaatagtttcaaatatactttatagaaacaacaaatttagtttgaaaacttcaaagtagagctgaatcttgtcatcttccaattttacaatttaaactagtgtaaaagggattcatgtaataaaaataattggattttcttgtgttaattaggacttacacagtacttgcacatttttacttacacagatgaaagtaacaatattatttagtgtgttggttcttaggggaatactttaggaagatttttaaagtttttcctgagagggactccaggaatacacatgtccctgatgatattataaactaaaaagaatatatgaaataatatgtgaaagaacatatctcatcttacgaataaatacagtgttggccaggtgtggtgcctcatatttgtaatcccagcacttggggaggctgaggcgggtggatcacggggtcaggagatcgagaccatcctggctaacacagtgaaaccccgtctctactaaaaatacaaaaaattagcctggtgtggtggcacgcacctgtagtcccagctactctggaggctgaggcaggagaatcgcttgaacccaggaggtggaggttgcagtgagccaagattgtgccaccgcactccagcctgggtgacagaatgaggctctgtctcaaaaaaaaaaaaaaaaaaaaaaaaaagtcatgctttttcatgtgactgtaagaacatattaagtctgggacttcatacaggtgaaatgctgaagttgcatatatagtcattattcaaaagtgggactattttgtttttattatattaggactcatattttctggaaatagtaatgacaatacagagttgtaggcgcaggtaattataatggtagactgagtgaaataatcaatggtaattcagtggagacaaaatactaagatctcaggagagagggagggacgaggagcactacatcctgtgaaaaaccatcaaagtgacagtccataatgacaggtcactgagtttcttccatcatgcttcgcaaactggttgtgctcttccttggctttatgtgtcaggtgaggagccaaagttcctatggcaaaaagagaactcccctggttccctggaaatgctggggtttatttcttctttttttttcttgagacagaatctcactctgtcctccaggctggagcgcagcggcgccatcttggctcactgcaagctctgccttctgggttcatgccattctcctgcctcagcctcccgagtagctgggactacaggcacccaccatgcctggctaatttttttgtgtttttagtagagacggggtttcactgtgttaggcaggatggtcttgatctcctgacctcatgatctgcccaccttggcctcccamagtgttgggattacaggcgtcccgagtcaccacacccagccaaaatatgaactttaagtatgtaagtaatttaagtgatattttcttcatgtaaggaatgacaaaatatttttgtataaaacatgccatcattaatttaggaaaaataaattatagtacataaaagggaaaaagaggaaactcatcataatagtgattatttttttttttaatttgttactttttcatatgtctgatttttttttattatactttaagttctagggtacatgtgcacaacgtgtaggtttgatacataggtatacatgtgccatgtcgggttgctgcacccatcaactcatcatttacattaggtatttctcctaatgctatccctcccccaggcccccaccccctgacaggccccagtgtgtgatgtgtctttatagtagcataatttataatcctttgggtatgtacccaataatgggattgctggrtcaaatggtatttctagttctagatccttgagggattgccacactgtcttccacagtggttgaactaatttacactcccaccaacagtgtaaagcattcctatttctctacatcctctccagcatctgttgtttcctgactttttaatgattgctattctaactggcgtgagatggtatctcattgtggttttgatttgcatttctctgatgaccagtgatgatgagcatttttacatgtggctgttgtctgcatagatgtcttcttttgagaagtgtctgttcatatcctttgcccactttttgatggagttgtttgtttttttcttgtaactttgagttctttgtagattctggatattagccctttgtcagatgagtagattgtaaaaattttcttccattctgtaggttgcgtgttcactctgatggtaatttcttttgccatgcagaagctctttagttaaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttttacaaggtgtaaggaagggatccagtttcagctttctacatatggctagccagttttcccagcaccatttattaaatagggaatcctttctccattgcttgtttttatcaggtgtatcaaatatcagatggttgtagatgtgtggtattatttctgaggcctctgttctgttccattggtctatatctctgttttggtaccagtaccaaaagctgttttagttgctgtagccttgtagtatagttagaagtcaggtagcgtgatgcctccagctttgttcttttggcttaggattgtcttggcaatgcaggctcttttttggttccatatgaactttaaagtagttttttccaattctgtgaagaaagtcattggtagcttgatggggatggcattgaatctaaattaccttgggcagtatggccattttcacgatattgattcttcctatccataagcatggaatgtttttccatttgtttgtgtcctcttttatttcgttgagcagtggtttgtagttctccttgaagaggtccttcacatcccttgtaagttggattcctaagtattttattctctttgtagcaattgtgaatgggagttcactcatgatttggctctctgtttgtccgttaatggtgtataggaatgcttgtgatttttgcccattgattttgtatcctgagactttgctgaagttgcttatcagcttaaggagatttggggctgagatgatggagttttctaaatatacaatcatatcatctgcaaacagggacaatttgacttcctcatttcctaattgaataccctttatttctttctcttgtctggttgccctggccagaacgtccaacactgytgaatatgagtggtgagaaagggcatccttgtcttgtgctggtttttaaaggaaatgcttccagtttttgcccatkcagtatgatattggctgtgggtttgtcataaatagcttttattattttgagatacgttccatcaatacctagtttattgagagcttttagcatgaagttctgttgaattttgtcaaaggtcttttctgcatctattgagataatcatgtggtttttgtctttggttctgtttatatgctggattatgtttattgatttgcatatgttgaaccagccttgcatcccagggatgaagcccgcttgatcatggtggataagctttttgatgtgctgctggatttggtttgccagtattttattgaggattttcrcatcaatgttcatcagggatattggtctaaaattctcttttttgttgtgtctcttccaggctttggtatcaggatgatgctggcctcataaaatgagttagggaggattccctctttttctattgattggaatagtttcagaaggaatggtaccagttcctctttgtacctctggtagaattcagctgtgaatccatctggtcctggactttttttggttggtaggctattaattattgcctcaatttcagaacctgttattggtctattcagagattcaacttcttcctggtttagtcttgggagggtgtatttgtccaggaatttatccatttctcctagattttgcagtttatttgcatagagctgtctatagtattctctgatggtagtttgtatttctgtgggatcggtggcgatatcccctttatcattttttattgtatctatttgattctttattagtcttgctagcagtttatcaattttgttgatcttttcaaaaaaccagctcctggattcattgatttttttgaagggttctttgtgtctctatctctttcaattctgctctgatcttagttatttcttgccttctgctagcttttgaatgtgtttgctcttgcttctctagttcttttaattgtgatgttagggtgtcaattttagatctttcctgctttgtcttgtgggcatttagtgctataaatttccctttacacactgctgtaaatgtgtcccagagattctggtacattgtgtctttcttctcattggtttcaaagaacatctttatttctgccttcatttcgttatttacccagtagtcattcaggagcaagttgttcagtttccatgtagttgcgtggttttgagtgagtttgttaatcatgaggtctaattttattgcactgtggtctgagagacaatttgttgtgatttctgttcttttgcatttgctgaggagtgctttagttcaattatatggtcaattttagaataagtgcaatgtggtgctgagaagaatgtatgttctgttgatgtggggtggacagttctgtagatgtctattaggtctgcttgttgcagagctgagttcaagtcctgtatatctttgttaaccttctgtctcgttgatctgtctaatattgacagtggagtgttaaagtctcccatcattattgtgtgggagtctaagtctctttgtaggtctctaaggacttactttatgaatctgggtgctcctatattgggtgcatatgtatttaggttagttaggtcttcttgttgaattgatccctttgccattgatccatttaccatggccttctttgtctcctttgatctttgttttaaagtttgttttatcagagactaggatttcaacccctgctttttttttttgcttgatctacctttgcttggtagatcttcctccttctgtttattttgagcctatgtgcgtctttgcacgtgagatgggtctcctgaatacagcacactgatgggtcttgactctttatccaatttgccagtctgtgtcttttaattggtgcatttagctcatttacatttaaggttaatattgttgtgtgtgaatttgatcctgtcattacgatgttcgctggttattttgcctgttaattgatgcagtgtcttcatagcatcgatggtctttacaatttggcctgtttttgcagtggctgataccggttgtttctttccatgtttagtgcttccttcaggagctcttgtaagggaggcttggtggtgacaaaaatctctgagcatttgcttgtctgtaaaggattttatttctccttcacttacgaagcttagtttggctggatatgaaattctggatggaaaattcttttctataagaatgttgaatattggccccctctctcttctggcttgtagggtttctgccgagagatccgctgttagtttgatgggcttccctttgtgggtaactcaacctttctctctgcctgcccttaacactttttccttcatttcaaccttggtgcatctgaaaattatgtgtcttggagttgctcttctcgaggagtgtctttgtggcattctctgtatttcctgaatttgaatgttggcctgccttgctaagttggggaagttcttctggataatatcctgaagaatgttttcctgcttggttccattctccctgtcactttcagatacaccagtcagacgtagatttggtcttttcacatagtcccatatttcttagaggctttgttcgtttctttttgctcttttttctctaactttgtcttctcggtttatttcattcatttgatcttcaatcactgatgccctttcttccacttgattgaatcagctattgaagcttctgcatgcatcacgaagttctcgtgccatggtttgcactccatcaggtcattgaaggtcttctctacactgtttattctagttagccattcatctaatcttttttcaaggttcttagcttccttgcgatgggttcgaacatcatcccttagcttggagaagtttgttattactgaccttctgaagcctacttctgtcaacttgtcagagtcattcactgtccagctttattccattgctggcgaggagctgccatcctttggaggagaagaggcgctttgatttttagagttttcagcttttctgctctggtttctccccatctttttggttttatctacctttggtctttgatgttgttgacctaaagatggggttttggtgtaggtgacctttttgttgatcctgctgctatttctttctgtttgttagttttcctcctaacagtcagttccctcagctgcaggtctgttggagcttgcgggagttccactccagaccctgtttgcctgggtatcaccagcagacgtcacagaacagcaaatgttgttgcctaatccttcctctggaggcttcgtcccagagggtcagcttgcctatgtgaggtgtctgttggcccctactgagaggtgtctcccagttatgctacacgggtgccagggacccacttgaggaggcagtctgtccattctcagagctcaaatgctatgctgggagaaccactgctctcttcagagctgtcagacagggatgtttaagtttgcggaagttgtctgctgccttttgttcagctatgccccacccacagaggtggtgtctagaggcagtaggtcctgttgagctgcagtgggctccgcccagttcgagcttcctggccgttttgtttacctactcaagcctcagcaatgggggacacccctccccctgccagggtgccgcctcgcagttcgatctcagactgctgtgctagcagtgagcaaggctccgtgggcgtgggacccaccgagccaggcatgggagagaatctccttgtttgctggttgctaagaccttgggaaaatgcagtatttgggcaggagtgtcctgtttttccaggtagtctgttacagcttcccttggccaggaaagggaaataccccgaccccttgcacttcccgggtgaggtgatgccccgccctgcttcagctcaccctctgtgggctgcactcactgtccaccagtcccagtgagatgaaccaggtacctcagttggaaatgcagaaatcacccatcttctgcgtccatcacactgggagctgcagaccggagctgttcctagttggccatcttggaccaaccgtctcctattgttttcttaagtaatataaaaagttaatgtaataatttaaaaactaagatctgggaacttgaaacttaatgtgcaaaatacttaccataatgcctgacacatagtagatacttaattaatggtattagtatcattcatacctcacagttattatcatggtaccaattaacataataaatatacagatacttttaagttgatttcagatttgtaaatcagaatttacagaagttgaagaagtgaaagaaagaaatagagacaggagacccatttacctttaatttattcagtgaaacactttatatatagtttaaagattattacatatttatttcatggcattttctttctttcttttttaagacaaagtcttactctgttccccaggctggagtgcagtggcgcgatcttggctcactgcaacctctgcctcctyggtttaagcaattctcctgcctcagcctcctgaatagctgggagtataggtgtgcatcaccacacccagctaatttttctatttttagtagaggtggggtttcgtcatgtgggctaggctgatcttgaactcctgacctcaagtgatctacctacctcagactcccaaagtactgggattacaggcatgagccactgcacccagccacattttttttcaatttagcaaaatcactatactcttgtaaagaagctttttacatgtttgttttccattaataataacacacagaattaaaatgcaattgtattcaaaatgtaaaaagtgaaatgtattttcatcaaaagcacaaattaaagtcagtgtaaaaaaaagtttccaaattattttctcttttcactacttgtaatactttattctacttaacttttctttttttaaaaaataatttcaagttttattttagattcaggggttacatgtgtagatttgttacacaggtgtattgcatgatgctgaggcagaactttggggtaataaagattccgtcacctagatactgagcatagtgcctaataggaagtttttgagccctttccccctcatcctctcccctctctggtagtccccagttctattgttcccatctttatgtccatatgtagtcagtgtttagctcccacttacaagtgagaacatgtggtattggtatttggttttctgttcctttgttaatttgctttggatgatagtctccagctgtatctgtgttgctgcaaaggacaagatttcattcatttttatggctgtatagtattccgtggtgtatatgtaccatattttctttatccarttcaccattgatgggaacccaggttgattccatgtttttgctattgtgaatagtgctgtgatgaacatatgagtgtgtgtgtcaatttaatagaatgatttactctcctttcagtatatacccagtaatgggattgctggaatggtagttctatttttagttatttgagaaatctccaaactgttttccacagtggctgaactaatttacgtagccatcaatagtgtataatgttcccttttttctgcagccttgctagcatctgttattttttttttccttttagtaatagctattctgactggtgtgagatggtatctcattgtgttttttaatttgcatttctctgatgattagtgatgttaagcatttttttcatgtttgttggctgcttatatgtcttcttttgagaagtgtctgtttatgtactttgcctactttattatggggttgttttttccttgttgagttatgtaaattccttatagattctagatattagaactttgtcagatgcatagtttgcaggtattttctcccattctgtgggttgtctgtttactctgttgatagtttcttttgccaaaccaaagctcattagtttaattaggtcccagttatcactttttgtctttgttgtaattgctttagagcagtggtccccaaagtccctggtgccatttgacactggggactggtttcgtggaagacaattactccatgaaccaaggctctgggaggaatggtttcaggatgaaattgttccaccttagatcatcaggcattagggcattaaattctcataaggagcatgcaacctagatccctcagatgtgcagttcgcaatagggttcacaccactatgagaatctaatgctcccactgatctgacaggaggtagagctcaggcagtaatggtcgctcacctgctgctcacttcctgctgtgtggccccattcctgacaggccatggactggtaatggtccatggcctagggtttggggacccttgctttagagggtcataaatttagtcataaattttttgccaaggctaatgtccagaatggtatttcctaatttatcttgagttatcttttgggtgtggttaaaagtagagatccagtttcattcctttgcatatggctagccagttttcccaacaccagttattaaatagggagtcctttccccattgtttgtttttgtcaactttgttgagcatcagattgttgtagatatgcagctttatttctggttactgtattctgttccatttggctgtgtgtctgtttttgtaccagtatctttatatatacttttaaaaaatcatctcaacaatgctaggagttagataatcatcttcattttataaatgagaagataaaaacactgagagactggcccaaggttgcacaactagtatatggtcaggattcaaatctaagtagtctggggatttctgcttctggctaggatggaatagggatggaatttactttaaggcgtttactgaaaactgggacaaaaataggaaaccacagttttcagacattggaaaataggcagcacagggcagatctgagggaaggaaaacaaatgataagagctctatgattgccccatcttaggttctggagagtttccaggccactgtgcagagataaaaaacctaaattgagctacatgatctttgagctgaggagttggagttcagaatttgagaggccaaggaaactagaatttgaaaagcagagtattgcagagctccagagttctgcagagggtaactttgcagtattgattagcgcatgtgtggaggaaactatacaaggccagagaaagaaaattatttaggtgggacagtctctagagttcacatgggactgggaaaatttatttttccgttagacagagtggaaagatactcttaatgcatagtactttgagtagaaatctcagaaggattttgcctcagtagcagggccaaattagccatagactaaaggctattctggttctggttaacaagaataaaagtaagatttgaaaagatcagactgtttctaagtacagtaacgtgtagcttaatgacagggatatgttctgagaaatgtgtcattaggcgattttgtcatgtgcaaacatcatggactatacatatatgcacctagatggcacagtatactacatacctatcctatatggtacagcctattactcctaggctacaaacctgtaaagcatatcactgtactgaatactgtaggcattgtaacataatggttaatatttgtgtacctaaacatatctaaacatagaaaaggtttaaacagtaaaaatacaatattatactcatgggacccctgtcatatgtatgtggactgttgttgactgaaacttcattatgtggctcattactatatcttagctgcattccagaatgaagattcagaaataagtaaaggaaaacaaagaatccagctctgaaaaaaacattaaattcacaatgtctgacatccaatcagaaatgactgggcagcccaggtgggttcattggtgaactctatcagccatttaagggagaatttatgttaattctctataatctcttccagaagacagaatcagaggaaatgcctcctaactcattctacaaggccagcattatcctaataccaaaaccagacaaagacatcttcacctgggtaataacaagggctcccatcctctgccatgctgtcactagagacagtatgaggagcttggacatccactctcaactggcagtaatgaggtaccctgccctcatcctgctctgacatgacatcctgggtcatgtcagaggaggcctagtacagggtcaggactttaaccactacccagctgcgtgttatcaatggaggccacatctggccctgtggtatcgatggaggtaacatgaggagcaataataaattactcctacgcttcccatccagggaggtgtcagttgaggcctaatggggaaccagaactcccacccctgttcattatgggtatcatgagaagccctcccaccttgggtatcaacagaagtagagtggagaatcgggactactacctcctcgtggtagtaatgaggtggcaacaccacccatcccctaccatagcaatatcacaaaaagccagctaatacaaactttgtttaagatctggagtctcataacttaattccccaaatgtccaagtttccattgaaaattgcttgtcacaccacraactaggaaggtctgaaactgaatgtaaaacacactaatagatgccaacactgagatgcagaggtgttagaattatttgacaaacatttcaaagcagccatggtaagaatgattcaatgaggaattataaacstggttgaaacaaacaaacaaacaaaacccaaaagacttagcaaagaaacagagaataaagagaagaaaattggaaattttagaactgaaagagtgactaagaaagcctgagttgccaggctcaactgcagaatggaagggatagaggaaaaaactactgagcttaaaggtagaacattagaaattacccaatctgaacagactagagaaaatagatttaaaaagcaaataaacagattctcagtatcctgtaggactataacaaaagatctaagatttctgtccctgaaaggagaaaagagggcagggtgagaaggtaatggaagaaataatgactaaaaactttccaagtttggtaaaggcacaaacatgtagcttcaagaagctgaacacattcacagcaagagataccatagtcaggtttaaaaaaaaactataggaaaatcttgaaagcagcccaagaaattatatcttacccattggggaaaacaattagaaaactagctcatttctcatcagaaatcagaggccagaaggaagtggcacattatcaagtgctgaaagataaggactgtcaactcataattctatatccagcaaaaatatccttcaggaatgtaggggaaatcaagacattctcaaatgaaggaaaatgaaggaactttttgccagtagacctatccaaaagagaagtttgtctaaataggaagaaaacagtaaaaagaaggaatctcaaagtattaggaaggataaatgtacatggtaaacagaactgtgggtatatgtaatagacttccttttgcttcatgaattttctaaattttgtttggtggttgaagtaaaaattttaactctgatgtggttctaaatatatagagaaaatattttaggtaattatattataaatgagcaaggacaaagggatataaaaggaggtgaagtttctacatatcactcaaactgacaaaatgaattcagtagaccatgataagttacataaatataataactagaacaaccactaagaaagctatacaaggagatacatttaaaacattatagataaaatggaatcctgaaatatgttcatgtaacaggcaagaaaaagaaaacagagaaactaagagaagaaacagaccaaaatggcttaacgtatcaatcataataaatgtaaatggtctgaatacatgaattaaaatacagatatttacagtgtagatttttaaaaatgacctaactgtactgacagtccccagattacagtgtttgaacttggatgatttttcaacttaacaatgggtttattgggatgtaactccattgtaagtcagggtgctccttatgacatatggtttctactgaatgcatgtcattttataccattgtaaagttgaaaagttgtaacttgaaccatcataagtcagggtccatatgctgtgttgccggcataaactgcatttttcacttttcatgagtttattgggatgtaattgcatcataagtcaaggggtaactgtatgatgtctataagaaactccaagtataacagtataggcagtttgtaaataaaaggatatacaaagctatatcatggaatcattaattaaaagcaggagcatcagtattaatatcagatagagcagacttcagggcaaaggaaaataacaaagaaaaataccagatttatatagaaagagattatatagtgacaaaagaggtcaacccagcaagaagacacaggaatactaaatgtatgtgcaccagaggtgcaaaatgtttgaagcaaaaattgaaagaactaaaaggtgaaatagacaaatctataattatagttggtgacttcatacccctctctcaacaagtgatagaacaattaaaaatcagcaaggataaataagaacgcaataacaccatcaaccatcagaacctaaataacatttataaaacatgccacccaaggagaacacccagacatgttcttttgaagtattcgctgaatgtatataaatgctcactgaacatatacaagatagaccatatcctgggctatgaaataaacctcaacaaacttatacaacttgaaatcataatgagtgagttttctgaccacaatagaatcaaactagaaattaataacagaaaataacagggaaatcttcaaacacttggaaatgaaatgacatacttaaaaaaatttatgggtcaaggtggaaatttcaaagaaaaacatttcaatgagattacatttcaaaaaatacattggatgaaaatgaaaatgcagcatatcaaaaattttaggacacagctaaagcagtgccaagaaacatttatagcactaaatacatgcattagaaatgagggaacaagtcagtaatgtaagctcccacctcaagaacctagaaaaagagtatcaaaataaaagtaaagcaagcagaaggagggaaataataaacatagcagaaattgaaaacaaaaataatagagaaaatcagtgaaacaaagagctggttctttgaaaagacaataaaattgaccaacttttagcaaaactaacaaaaaagatggaagataaaaattttacctatctcaggaatgaaagagtatcactcatgaccttgcagacattagaagggaaatcagataatcctttgaacarctctactctaataaatttgacaatgcagatgaaatgaatcaatttcttaaaaggcacaaacgaccacaactcatttaatgtgaaattggcagtttgtatagacctattactgttagggaaattcaatctgtaattttaaaactcccaaaatgaatagttaactagagaattttaccaggtgtttaaagaagtatcagtaccaattctacataatgtcttccccaaaaagggaagaggaatgttaccaataggggaatcttggttaaaggatatacaggatcccgctatattaatccttataataattccttgtgaacctgccattatctgaaaaagtttaattttaaaagaagtaactgaagaaagaaaagacatcttatacagaggaacagataatgacgacagacttatttttacaagtaataaaagccagaagacagtaaagcaatatctttaaaataccaaaagaaaaaagaaacctaggcagtttgattccagagccttttctcttacccatatccctatgttatatcgtaaaggtaataacaacaaagaaggatggagtaattaggtaacactacctttccctcttgtgtgccttggggaattgaagtgctatcattttttgaaaaggaaatcagtcactattcctagtccctattgtttctgtttagtttcctttacttcaataactttttaaaaagtaatattagttaacacattgtcttatctgtcaagtaagtttgtatttagaatagaatagagtaaatgtagaggtagctgcaatacaggcagatttaaataaagttcataaaagagaaatttaaacaaagccctttggaaatttagaggaaagattgagagcacaagaaattgaggacatcaaggaagatgacatgtaagtctgattgagaatggcggaaaaagaaagagctgaggctgtatccaagatctgtgccaaatgtctgggacacaagtggtgttatggcagtgattgaatgtaataagctctgcatcagcagaggttttgtgtttgcttatctgctgggttgtatccttactacctaaaacagttttgggtacttagtaagtactcagtaaatatttgttgcctgaataaataaatgaatagcaaaattagatggcagttttgtaagaatgatttgatatgtctggtttaggagttataaacatggaatctaattttcagtcatcagctagctgtcatccagtctcatagcttcaactatcacttcagctatcacacagatgcctcccaaaacgtggaaagaaagcaataatatgggaagtatgcaggtcaagaacattgtgaactgtgtgaccctatgtgtaaaatggggactacaagagaaattattgttaatgttgattttacatgtagagcacttagctcagtatttgatccatagtaagtactcagtaaagggcaccattgtctgaacttgagttacacattgactcctgaccttagatgagccatcacacctctaatatagcacattaaaaccatatcaggttacctcatgtaaaaggtaaacagtatcttaaagatcagctagcccaagttcttcatttaaactgaggacagaatacagtggataaaaaagtaatccgggaccaaaccaggaagtaatagttatttgtaaagcgtgggaggaaaaataggagagaaatactaattagttgggcttttgaggacttaactctaaatgccacagctgccttcaaggataaattttattctctgcaaaataatatttgtctgctggatagctctacctatatttctcattggcatttaaattcagcatgtccaaaaacaaactggaatcactatgtgttaaaactaaaaaggttgttagagtgcatgtaattcagtttcccattttacaggtgtggagaacagatcctgccctggggtggaggtcttaaactttttagattcattgatagtgctgtgatcaaacagttgtttcttggaccacttttgcctaaggttttggagcatttctttagttttttctgtttttgttttttgtttttttttttttttttttgcagggccggggagcttacagtgagtctttgatgttcatcctggctacaaacaacctcttgtcctgttttgagcagtggttttcaacttcttcttaacaaacaaaaaacccagctgaatcatttacttaagttgaatcatttgaagaaaccccagaaagagactaaaaatagaagcgtatggttaatgccagaaatttggtgggggtggtggtaggggatagatagttggggagatcaggaaagggaaagaatgagttctagaccctgattgcttgcccctggtctccagaggtgaggagcttctgaaatgcctnagaggttaggaaacagtttgaaacccactgatttggaggcccacgaagtccagcagtgataattggcatgaatgacaagaccactggtgtctctgctctgcaagttccccagtgactttaacacctgccctggagtaatgatttttcaattcttcttgaatctaagaactaagaactaggccatcattacaattaggactttaataaactctcagctatcatttaaaaactctcatcaatcacatttgcttttatgtacacagacaggcagtttttgtgtgaattaagttgccctgacatagataattttattagtatagactagctcaagaattacagtcatgtgaggaaaagctttggagtagtcagagttttggtcatgaacccctataatgttatgatgaattttaaaatacttgatgtatgtttagtacttacagtattataattttaaattttagtcagcaactgattaagccctgttctagacaccacgtggagatacagggaaaacaggacacagtccttgacctcacatttgagtcccactaagaacaaaaagatagtgatacttaaaattttttcctttgtactttgtttcagcacctgagctttgattttgtgcattttttaattttactgacttgtaaagcatgttcatgactgaaaatttaataatttaaccttgtatgctttctttaaaattattattagattgcaagactggaggaagataaagaagaactacgtaaccagctgcttaatgttgatctcacaaaagacagcaaacragtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggtaagattctaattacttcccagtagagtatggcatacttttttaaagtgcagttgacaagcctttgatttttagagcataaatgtatgccccccaagctaatgctgatgcatttgtgtaatcccaagagtatttattcttttagtaaagaagaaagctattgattcataagcaatacgtatgctaccacatttacaaaggggtatttattctttgggagtcaagtcacctatctgaaatgtcttaactcttaaaatgccacataatagaatatgcaaaataaaaatatatgtatttgagtttcygagcgtaaagtcatctcaaaccagaaagaataatttctttcaagatagtacattccttacactgggatttgaggtcttaaagtcacaaatcctgtttgaacagaaataccatactgatgtatcttacgacagcttcttgccagagtagtaaaatccaactgtaaaggtatacatgcctttacagaattatttccctgggttcattagagaaagataagtgttggcagacctgactggtactcctacgggtattgccttatgaaaattcttggtttccattttattcagatacacttattcttcttagttcttagtgcctaacttgtagcaaacatacctgtttaattgtttttatttattttgtatagttcaaagtgtttctttttcctttggaatagttataaaatgatttgggtgggggggacattagcgggcatttaatttgtagttaaaatcaatatccaaatccaagatggtgattttttttttccccagccagtggtacaggagtacaatggtatgttttgaagagtagaagttactttttattttgttacatgaygctctgtcagtatttactggttttctgaattaaaagttgtcagtatcattgtaccttaaacatgaagcagttcattgtgagactatttatgttgccatccttccatccttaatgtattttacacagtgacagaataagtgagatgattgcagttgaatatagcatacagtcctgatgtgaaacttyccattgaggtcctttagagtgattattttcagggcaagttgaatgatgacaraagatttatttgtgacattttcagaagagcctatatttaattttattatttgtcagatgaaatgaaaataagcgtatgacagcaagcatttctttcttctttaactttcttggctatcattgtgcccagagagtattatttcatatatgaagaaaatagtttttttccctaattgtttgtcgaatatagtccttaccacatttaagctagatgttccccaacttaaggtggtttgacttactattttttgactgtccgatggtgtgaaagccatatatgcatttatgtactttgaattttgatcttttcctgggttactgatatgtggtgtgatactcttaatgctgggtagctgcactgagccacagttcccagtcagtcatgtggtcatgagggtaaataacctctttacagagtactgtgtcgccaaatgattttttccaactgtaggctaatgcacgtgtgttgaggatgcttaagttaggctagtctaagttatggacttaggtattttcaatttgtgatgggtttatcaggatgtaaccccatcataagtcgaacagcatctatatgtacgaaatgagatgttataaaactgaaatttatcctttaaatgccaaaatgtcttcattttaattatgttgaggtcaggtgtggtcgcttatgcctgtaatcccagcagtttgggaggctgaggtagctggatcacctgagctcaggagtttgagatgagcctgaacaacacgggtgaaaccctgtctctacaaaaagtacaaaaattagccaggtgccatggtgtgcacctgaagtcctagctactcgggaggctgaggcaggagaattgtttgagcttgggaggcggaggttgtggtgagccaagatcgtgccattgcactgcagcctgggagacagagcaagaccttgtctcaaaaaaaaaatatatatatatatatgtgtgtgtgtgtgtgtgtgtgtgtgtgtgtgtgtgtgtgtgtatatatgtatatatattatgttgaatagacatgttttttcaaaaaagattttagtttccctcccctcatgaaagagtactatcgatattaccatccagaaacttttttgacaacctgcagacttcattaacaatcttaattgtgtcatgagatcaagagcctctttgctcgtacttaaaaagtctgcagatgagctgaggattttgaaatcatatctttccctgtttctttttttaaaatcattgattttagattttcaatttttacttgttactatcaatgagccctgtcttctagtttctaatatgctttttcttatctgttatagactggaaacttccaaaatgtttgaaataagtcagtgttaagagtaaatagacatcaaatgaatgccttaggtactttctgtcgtgagagaagtgtataaactttattttattgatggtcattcatatgttgtttgtctagatgcctttgttgcatatttcctggaacactatctttcgtttgaattctgccaattagtttgagaaaatttttgttacattggtatatgttaagttgaggttttgaataattttagtataattataaatgtattttaaatagtgcttatttgattttgaaatacttgaaaaatgatgaattttaaactattttgtttgtatgaaaggctgaaaaacaatcagctaatttacgggcagaacgyttggaaaaagagctacaatcaagcagtgaacaaaatacctttttaattaataaattgcataaagctgaacgagaaataaatacattgtccagtaaagtaagttgttttatgtttctgtttcattctttagaatgtttgttagtatataatgataaattttatttttaataattgatttctttatactgaaatgttttattatatcattctgccttctaagaaataaatacattgatcagtagagtatgttatcttatgcctctatttcattctttagaatgcttgatactgtacagtgacaaattttgtgtttagttctctgtattgaaatatttttaatcctttatcattctaccttccaaatacatgcagaatctgatcaattcttatgacatccactgtgactattccagtccaagccatgatttttctaggctccatttctgtgctaggttgctaactggtctttctgctttctacccattcagagctctgtatgatctggatcctgcagtcttttcacagccatgacctgtatttttcctcctgttcactttgctccctttggccttctcactctttgagcaaactcacatcttgctcagggtttctgcacttgtctgagtttggctcagtcttccctcacgtatccacataacttgcttcttcaccacctagatgttgcctaaccagggaggctttccttgtcttcacattgtaaaacagcatcttccttcttcctctgtctttctctctgtcttccttacctgcttcatagctcttaatactatctgatatagttatttggtttttattttttggtctctccttttctttcccaccaccttcccctcaacccaatgtaagctccaagagagcagggacattgttttcatcactactgcttttccagcttctagaatggtgccggcacatagtaggtactcaaatatttcttcaatgaataaattagtagtagcagcatgatctacatttatattctccttaacagactggattcaaattctgattttttcattactaaaaaaagctgtgtgaccttgggcagttcactgtctctctgaaacttaagtgcctttgtctatgcaatgggactaatacctacattacagagttgtggcaaaaattaaatgtagctgatgatgaaaatgataatagcagtgattatacactggtgatatccttaaataagaaaatattgtaacataaagaatacagaatttttagtccattgactagtctgtgtctcactgtctcaataactatgtgtaacctaaggcaagttacctaatatcattaggatccaatttccttatatctgtaagaacccttccagcctactaagactgtgtaagaactactaggaaataatttgattgcctcctgattaactgtaagtagattatatattcaacagatacacattgaaagcttataactatagagtatacaaaaaaatagatacaaaacacaagtaaattcaggatatggggagtttccatgcttttcttccaattccagtataaattattttcaattttgtgaaataatattgagtacgtagtatttgcagcacattgttcttgacctgagtagccagactacactgctggaataattggaaccacagatgtcgcaataggacatgggatgtgctggcttctgctgtggcttctctcttgggggggycaccaagtataatacttttcatgcagtacattttacctgagctccctagctcacctgtgtgctgaccctgatttttcttctttttttccatatatatatactcttccctattgctctttcctcttagagttagagcctaggtgatttctcctactccgctgaagaaagaacagcaatctagtatagtatttatttctctgtgcttgtttattaatacacattgctaagagttgcctgtctttttaaaggcacacttgccttattttgcatataaatggagtattaaataccatccttcaactttaaacaaaccaagtttcatttgaagtcttgtatgtaaagattccattggaagggtagattttaaaataatatttcaaacatgactgccacagttttctttgcaacttgaagttttcatcaacattttgcaattctagcaaatggttgtttgcagtgcaaaggaacacctggggtgtgtttgtcttagttactcaaattcataaatgtttgtcagattttagaacaaagttatgtcagtgtgagtatcagtgtcttggattaaaaggtattaccaaagatggcctgaaaatgatgaccttaaagagatttcacattcagtgaggtaaattcttctagttccctcataaggtttttcattttcagaatgccaataaaaggtagttttaagaaagccacccaacagagttgtccttatttacctaaattaattgggtaattacatctcagaactttgaaaaagatcaagatttaagtaccatctctttggaatctgtatccagagcttcttaggtaatacatattgtcaattatatttccatttcttgcttatttatgctgkgctcttgtgtgtctttctgtgagtatgtgtactttaacagatactgaccccctgtaaaatgcccagttttgccagttttgacatttattaaagttttgttagtaatatctgaatacttccattgtgtcaaaacataaagcaaattcacaacataaaggccagaatctatatggcaaacattctgtgaagaacagggtgacttggtccagtggagctttaggagaccatgaattgcttgaaattttatgcaacattttaacatgagcattttatttaaaaaaaaaatccctaattttcctaggatttgggacttgatcacaaagaagattaagaaccaaggatctaggggcagaaagaaactttactgtaacatttggaatttggttcagattactcatagaaaagtgctattatttgtcattactgggtaatacattttcatacgttaagtaaaattccttttagtatatttttaggaaattaacagtgttcatataagtgatgcatcagtgatgttaggataatagaaataaggcaataaagaaaaactttagatccataaatgagtacatttgaatgcagagaggacaggtaaattgcttgagcatataccactggtttaacagcaaaagtaggcctgaagacagacctcacttgttgcttgacttcctattcggtgttctttcagtttcaataattgtagtttagttaaaaatgtcgtctcatttcagtaaatttcagggtgaaatgaataagaaataagtttttgtagatcttttaccatgagatgaatcaacttcctatgaaataagatggctctaattttccacctcatgcagctatagtatgtttgttaatgaaatgctgtgtcattcttaaccttttacagttagtatataatagcaggttataattacatttgtcatagtgattggattttctttgtaatcatatttcttcaaaattttaaagtatttataatttaaattctatctgtccatgaaattataatgtagtaaaatccaatctacagaaagtttaagtattaaaacaaattatcagctgttgtcatgtaaacatcattttataaaacttgcttttatagaaaataacttccaaaaggaaattaaaaccacaggccaggtgtggtggcttaacgcctgtaatcccagcactttggaaggccgaggcggatggatcacgaggtcaggagttcaagaccagcctggccaagatggtgaaaccccatctctactaaaaatacaaaatttagccaggtgtggtggtgcatgcctgtaatcctagctactcaggaggctgaggcagagaatttgcttgaacccaggagacagaggttgcagtaagctgagattaagccactgtactccagcctgggcgacagagcgagactctgtctcagaaaataaataaataaaaatgcaaaactgatgtcagcacagggtcaccattttatgtacggtcatttaaaaatctacgagttaatttggagggatgtcttattgtagttaccagtacataaggcagtactcacttttctgtttatttcctttggatgaggattttgcatgaaactattccttgaaacgttttcaggaccttttgttgatggaatatcttccaataagacacttctatttcttatccttgccctctttggctctaggacctttttttgatttgtgtctgactcccaactccagtatttatggggttttattggactcttaagtaaattgtcttttattttcctgtttctgccatctcacattttctgtatttgatgtgtatgtatttgtagtttcctactctgattccatacttttatatatttggataatatatcagaaaatgggttaatctaacctttgtgtttgtattgattaaatccttattatatgactatatctaattttagaagctccttaccaaagagaagggctatggaaaatgaatttatatgatttatacttgttcctgcccccartcccctacctaatacttgtgcacatgcgcacacagacacagtctatacacattacactattttgtcaccagattcaattgattcttccttcccccctccgtttattcatttcttgcctcttaattgatttatttaccttcagtttcttaagccaacagattcgcattagttaattgtgccaccttcaacagctaacctgaaaaacaacccttttgtatggtatataaagtttattccctgccattcctccacagatttcacatcttccggtgctctacatgtaatgcttagcttgttttaagagcagaccatgtgatgttatacatataataacattttgtatgctgttccttctacctagaataccttctttgtccccagcacattttttattcttaaatttaattttaatttttttttagagacaaggtctcactctgttgcccaggctggaatacattggcacaatcatagcactgcagcctcaaacccctagactcaagtgatcctcttacctcagtctccccagtggctgggactaaggggcatgtcatgtctggctaatttttaaatttttttttagagaaaggatctcactatgttgcccaggctggtctccaacaccaggcctcaaacacttccttctgccacagcctcttgagtagctgggattttaggtgcaagttactgtatccagctgtggacactttttaaaaggaaggtttcaggccaagtgcagtggattacaactataatcctagcactttaggaggccaaagcaggtggattgcttgaggccaggagtttgagaccagcctggtcaacatagcaagaccctattgctacaaaaaaattgaaaaattatctgagtgtggtggtgtgcacctatagtcctgacagctacttggaatgctgaggagagaggatcacttgagcccaggagtttgaagttgaaatgagctatgatcgtgccactgcactccagcctggatgacatagcaagaccctgtcttttagaaatattaacaaattttaaaagtttcagggttttttcccctgcagattttccaatcattgagtagttgattttagatacttgtaattaagtctttaaggcaagattaagccaaaggaccatacacagatattcgtaaagaaatgcctctgttctgttaggaaagaacagtattttcttaatgtctccttacttgaagtactgttgcaggcactgacacttctttcttcttggaagatacttagactctactttactaccagagcgttttcttgtttccacttatgttttggggtaagtattgaatggcaagaaaatgaccaatagtaatttcagtttttaattatcaacaggtaaaagaacttaaacattcaaacaaactggaaataacagacatcaaactggagacagcaagagctaagagtgagctagaaagagaaaggaataagattcaaagtgaactggatggtaatatgtgatttcccttgctgctgctgctgctgcttattttcagatatgaactcaaattattaaaatagttgaatctgaatttttatttccaaattttcaacttaatttagttttaattttggagtacatatgaaatgtttattatatgttgagtgttttgttcattgtaagatttaataactttaaaaaaatcagtcttatgtttttatcatagttattggatacataaatgaattttgtaaatgggatgccatacttcctgatttataaattttaaatctatttatggtgtagttattagtcccaggacattttaagtctggagaatgtgaggaagataattgggttccaggcttaatttttttcaattaaaaagatttttttatgtagacctcaggccagttcattgtagcctagtgcagagtaggcttatttatttattttttatttttattttttatttttgagatggagtctcgctctgtccccctggctggagtgcagtggcgtgatctcggctcactggaagctctgcctcccaggttcacgccattctcctgcctcagcctcccaaatagctgggactacaggcgcccaccaccaggctggctatttttttgtatttttaagtagagacagcgtttcaccgtgttagccaggatggtcttgatctcctgacctcgtgatctgcctgcctcggcctcccaaagtactgggattacaggcatgagccacgcccagccgagtaggcttatttttaagttccagtttaatcttggaacatctgtctcatcagatttcctcattatttatgttgtttctaacttgaagtatttaaataagcttacctttggcctgtagctatgcttgagttgatctgtagttgaactcatttcagacagagtttatgatgaatgcctttcatgttttgaaatggggtctcaccatgttgcccaggctagccttgaactcctgggctcaaatggtcctcctgcctaagcctcctcagtagctgggactacaggtgctaacaccgtgtctggctgctatgaatgattttttccaattgttaatttctatttattgactcatggatttccatagagttaagaagtaaatttttttaggaacttaaagaatgctgcattttgttttcactttgagttagatgtgaatttgctttagttattccatctgcaaagtatttgccatttcattgcaaagatttctgaattcattgtacaaacttgaaagtgtccatgttatttatacttctgctagagatctagcaattctgctagaatcaataggttttgaagggttttgtgatttatttcactctgctatcagccagctttttctatgaggcttaggtcacagaacctctttagaggtgaagtaagtaaacctctggttatcatccagtttgatctcaactctcaatgttcgaatgagtaaatgtatacagcttttattaaagtttttatatgtgtatgcactaaataaacagtgacaggaaaatttgctctgagttttagcctgtttcattcttattttaagagtgtttattaatgatgtgagtattgttgagaatatatatttgtagagactttctacattcatttgtcttaccagcttatgaatgcttgctgttaaatgtgatttttcatcttaataacattgaatatagtacacttttctccttgaaaaacactaggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagtaagtacttaattaccttagtttgacttaaatatccttgcaaatgaaaacattttgctgtcatatcatctttattatagttcttgtaacataattatgatctcttgttttaggttagaactcgagaacagrttagcagatttggagaaaatgaaagtggaacatgatgtctggaggcaatctgaaaaggatcagtatgaagagaaattgcgggcttcacagatggcagaagagatcaccaggaaggagcttcagagtgttaggttatatatacatntatatttaaagtttttcatgttgaaataaggtcagagttaacaaaatgatgtacaactagtacaaagaattcccatgtgctcttcaccctgatctcccaaatacaaatacctatgtaaccatattataataatcaagattaagaaattaacatgaatataatcaggaaatcaggcattactattataaaatctattaactgtacttaaattttaccagttgtcccactgatgtctttcttctggtctaaaacccaattcaggatcacatgttgcatttagttacttttaatctggaacttatgaacactttgacaaatacttgtcagtattttgtatatcctctctcattttggttttgtattgcatttttcatggttaaattcaggttaggcatttttagcaaaacatcaaagtcatgtgtcctcagtgaatttccatgatttggccccttaactggtgattttaaccttgatcacttggttaaggtggtatctgccacatttttcccctataaaattactattttttccctttgtaatatataattatctgtggttgcccatatgatatttcaagtctgtgtaaatattctcatattttgcctttatataatcttccattaattttagtatccattgataattcttatctgaaacagttataactctagcatttgccaaatggtgatctttccatttctatgatccttcctcatttattagttggaattctcctgaaagtaagtgctttcccttctcctctaaatatatttatatcattatggatttatacattcatattttttctatagattataagattttgttattttttttgttgcttaacttttctcagatttggctattggaagatctttcaagttgaatcccatgtccttttgacataatcccaccatttattgtgacttttttctgtcattacaggatgttctgtgattctctttcactttccctgccccagccctggaattaaacatttatctgaggtgctttgattcctttttaattggagaatggcatttagaaaccaaaatctcaactctaggtatgcttattggtactagagagtcattgcttctaggtcctcccagtgaactgaaaattacacatttacatctatttctttattttttctctatattaataatcttgagtttacattgatatttccagttctgttccagcaccgtggagttcattctggtcttcctcttttcatacttgcaattcttttgacagtgagaaaactggcattcattattcctaccatatttacttatttcctcagtcctaaaatataaagttgttttagaattgctaactcatcactcaatgaaaaacaaacctattaacttacatgtaatatttgtgtatagttgtttttatctttagccttagagtatatagtcaaaatattattttccaaagttacttaggatttttctcaccaaattctcctttaatgtggtttgttattcacttataaagcaggtttattctttctattctattctgttttgagtccatacctcatccttgtttatttatttattaatatgttgggcatttggaatgtctacatggttctaaaggacagaactataatacaccaaaaaaaaacaaaaacaaaaaaacaaaaccttcaaaaaaatgccacttcccacatctcctctaccctgttcccatttccctcatcttttctcatctatcctgccccatgtgagattaatctcattagtttctggtttagacttcctacattttttgtttgtttgtttttgttcctcacaaataccagatgtcattgtatttttccttctttcttatcagtgcaccctggaaactgcttcagattagttcatagggattagcctcattcttttttatggctgcatagcactccactatgtgtatctatcagtgtttagtgaaatagtctcctawgttcatttaatttccaatattttgtctttttttttttttttttttcaaacacagtcttgctctgttgcccaggctggagggcagtggggcgatcttggctcactgcagcctccgcctctgcctctgggattcaagtgattctcctgcctcctgagtagctgagattacaggtgtatgtcaccacaactggctaaattttgtatttttagtaggggtggggtttcaccatgttggccaggctgctgtcaaacttctggcttcgggtgatctgcccacctcggcctcccagagtactgggattataggtgttgagccactgcacctggcctccagtattttgtgattacaactaatcaataatgttgtacatgtaaatattttcattttctggaggtgtatcttcagggtgaattcctgaagtaaataggtgggtcaaaaggtaaatcatacgcagttttgttagatattgccaaatttccatccaagagaattatatcactttgcatcttagtgtagtttaatttgcatttctcatattacaaatgagattgaacaatgttccatgtgtttaagggccatttttatatcatttttgtatgtattgtttgttcttgtctttccctattatacttggtttttttggccttttttcccttgcttaaaaattttttttaaattaccttactttttaagagttctttatatattaggattatrctgcagatattttctgccagtgtgtgtcagcagtcctttgattttgcttccgytatttttttgccatgcaaaaatttttattatgtaatcaaatttaatctgttattgcctctgggtattaagtcagagttagtactctctccctgaactgaggttaaagaggaattcacttctttttgcttgtatggtttcattttttacatttagttctctgatctatttgaagtgtattcttttgtatgctgtgaggtatggatttgatcagttttttctaaatggctaattgattgtcccacacttttattaaaaacctgtctttgccccagtgattcatgatgatgcttttattgtattttaaatttccatatatacttgggtatatttctggactttctattctgtttcactcatctggttgtctgttcatgtgccattttacattaaaaaaattttttttgttttaatttttatttagagacagagtctttctttgttgcccaggctggagtgagcgatcatggctcactgtaacactgaactcctgagctcaagcaatcctcctgcctcagcctcccaagtagttggaactttaggcgcctgtaccattattatgatactttaattatagaggctttatagtatgctttaatgtctggttgtggtactcagtccttatagtttttctctcagtattttcctagctataattatatgtttgttttttcatatcaacttgaatattaatgtctagctccattaaaaagtttgtttgcagttttattgggattccattaatttttttccaatatttgaaaattgttaaaatacatgtaaaaataaaatctaccatcttaactatttttaagtgtacaattcagtggtattgaatacattcatattgtggaaccatcattaccatctatctccagagttctttttagcttgtaaaacaaactctgtacccattaaacaataactcccctttagcccatcctcccaaaccctggtaatcaccatttcactttctgtcttttaggatttttgactgctctacatacctttgtaagtggaatcaaacagtatttgtcttttttttttgactgggttattttacttagcatgatgtaattacttttttttttttttttttgagacagcgtctcactctgttgcccaggctggagtgcagtggcatgatctcagctcactgcaacctctgtctcccaggttcaagccattctcctgccttagtctcccaagtagctgggattaaaggcgcctgctaccatacctggctaatttttgtatttttgtagagatgccgtttcaccatgttggccaggctggtctcgaactcatgacctcaggtgatttgcccacctcagcctcccaaagtgctgagattacaagcgtgagccaccgcacctgccctaatgttcattactttctaaggcttaataatatttcagttctacatatatactatatttatcgatttgtttatggacacctggatttcttccacattttagctattaataatgctgttatgaacatgtgtgtacaaacatctccttacgaccttggtttcagttattttgggtgtatatccagaagaagaattactggcttatattgtaattctgtttttaattttttgaggaactgccattctattttcttcagtggctgcaccattttaaattcccaccaaaaatgcaaaagacttctaatttctccatatcttcaccagcacttatttcatgtttttaaaaaacttaattgacacacaattgtacatgtttacagggtacagtgtgatattttgattcacgtatacaatgtgtaatgatcaaatcagggtaattagcatattcaatcacctcaaacatttcatatgttctttgatttgggaacattcaaaatcgtctcttctagctcaaatatacaataaattagtgctaactgtagtcagtctgtagtgctgtagaacaccagaaattattcttcctatccaatagtaattttgtatttgttaaccaacctctgtcttccctcctcactacccttccagcctctagtaaccactattctactctctagttctatgaaataaactttttagcttacacatgtgagtgagaacatgcagtatatatctttgtgtgcctgacttatttaattaacaattgtcctccatacttgtccatgttgccatgaatgacaggatttcatccttttttatggctgaatagtattccattgtttatatatgccacattttctttatccatccgttgatgggcacgtaggttgattccatatcttgcttactgtgaatagttctacagtaaacataggagtgcagatatcactttgacatactaatttcctttgctttgggtatatacccagttgtggaatttctgggtcctgtggtagttctgtttcagttttttttgagacagggtctcactctgtcacctaggctggagtgcagtggtgtgatctcggctcactgtaacctctgcctcccaggttcaagtgattctcttgcctcagcctcctgagcagctggattacaggtgtgtgccaccatgcctggctaatttattgattaattgattgaytgttatttttagtagagacggggtttcactgtgttggccaggctggtctccaactcttgacctcaagtgatccacctgccttggcctcccaaagtactgagattataagcgtgagccaccgcacttggcctgttgttagttttttttgtagagcttccatactatttttcttaatggctatactaatttacatccccactaacagtgtattagagtcccttttctcctcattcttgacaacatttgttttgtctttttgacaggcattctagctggtgagatgaaatctcattgtggtttgatttgcatttccctgataaatagttatgttgaacaatttttcatgaatgatccattcagatcatttgcccatttttaaatgaaattacttggggctttttgcagttgtttgagtttcttgtttattctaaattttaatcccttgtcagataaatagtttgcaggtgggccaggtatgatggttcacacctgtaatcccagcactttgagaggccaaggcgggtggatcacctgaggtcaggagtacaagaccagcctgaccaacatggtgaaaccctgcctctactaaaaatacaaaattagctgggcctggtagtgtgcgccagtaatcccagctacactggaggctgaggcaggagaattgcttgaactcaggaggcggaggttgtggtgagccgagaccatgccattgcaccccagcctgggcaaaaagagcgaaactctgtctcaaaaaaaaaaaaattagtttgcaggtattaatattttctcccattgtataggttgtctcttcactctgttgattgtttccttgttgtgcagaaacttggtttgatacgatctcatttatctatgtttgcttttgttgcctgcgttttctgttgttatagttgtttcatttattttgtttttgtatttatataagggatgggattttgctgtgttgcccaggctggattgcagtgggtattcacaggtgcaatgctactattgttcagcgtagagttttgacccactctatttctgacctgggtcaggtcacccctccttaggcattctggtggtcctctactcttgggaggtcattatcctgatgcgaaacttaatgtgaatgcccaattgcagtagcgcactacagcatctacagcacaaaatttctggactcaggtgatcctcttgcctcagcttcccaagtagctgagactataggcacgtgccaccatgcccaacttgttgcctgtgttattgaggtctcacccgtaaaatcttcccctagggcaatgtcctgaagtcttttccttgtgttttcctgtagtagtttcatagtttggggtctcatacttaagtttttgatttttatatatgatgagagatggatctagttttattcttctgcatttggatatgcagttttcccataatcatttattgaagaggctgtcctttccccaatgtattttcttggtgcttttgttgaaaatcagttatctgtaaatatgtggaattatttttgacttctctcttctgtttcatttgtgggtgtatgtgtttttatgccagtactatggtgttttggttactacagctttgtagcatattttgaagtcagatagtgtgatagatagctccaactttgttctttttacacaggattgctttgactctttggagtcttgtgactccatgcaaattttaagattttttttttcaatttctgtgaagaaattcattggtaatatggtagaaattgcattgactgtagatcacttttggtagtatggtcatgttaacaatattaatctcccaatccataagcatgagatttcttttcattttttggtgtcttcaatttctttaatcagtattttatagttttccttttagagatcttttacctcctttgttaaatttattcataggtattttaatttttataattataataaagaagatttctttcttttccagttagtttaagtatgtagaaatgctactgatttttgtatgttgagtttttttatcctgaaactttaatgaattaaaagttctaagagctttttggtgggatctttaggtttttctatatataagataatgtcatctgcaagtggacagttttgactttctccttttttattttgaagccatttatttctctctcatgcctaattgctttggctgagatttccagtgctgtgttgaataagattgacaagggtgaacatccttgtattgttctagttcttaggggaaaagctttcaatgtttttttgttcagtatgatgttagttgtggttttgtcatatatggtattcattgtattgaggtatgtttcttttatacctaattttttttaaagtttttgtcatgaaggaaagctgaatttttgtcagacgctttttctgcatgtattgaaattatcgttttttcttcattcagttgatacgatgtatcacatttattgatttgcatatattgaaccatccttgcatacctgtgataaatctaactygatcatggtgaataatctttttaacgtgttgctggatttggtttgctggtgtttttgttgagggtttttgcatctgtatttattagggatactggccatagtgctcttttttttgttgtgtccctgtctggttttggtgtcagggtaatgctggcctcgtagagtttggaagaatcctctccctttcaattttttggaatagtttgagaagaattagtattagttcttttttaaaagtttggtagaattcagcagtgaagccatctggtcctgggctttttttcttgggagactttttattgatgatgcagtcttgttactcattattgatctgttcaggttttgtatttccttctgtttggttcagtcttgataggttttgtgtgtttagcaatttatccattttctctaggttttcctatttgttgtcctacagttgctcataatagtctctaatgatctttagtatttctgtggcatcagctgtaatgtctgctttttcatttttgattttatttatttgggtcttctcacttttagttagtctagctaatgttttgtcaattttgttttttcaaaaaaccaacattttgttttgttgatattttatagttttttagtctcctttttgccgagaccagctcagttggggagaccctaacccagcggcactagagggattagagacacacacacagaaatatagaagtgtgaagtgggaaatcccctgatttctcacaaccttcagagctgagagccctgaacagagatttacccacatatttattaacagcaaaccagtcattagcattgtttctatagatattaaattaactaaaagtatcccttaagggaaatgaagggatgggccaaattaattgcagcaggaacacacccttaagacacagatgctcaggcttttgtttgtggcttaagaatgcctttaagcagttttctgccctgggcgggccaggtattccttgtcctcattcccataaactcacaaccttccagcttggactttatggccattatggacatgttacattgctgcagagattttatttatggccagttttggggccagtttatggccagactttggggggttgctcccaacatgtctcccttcttagatttgcaaagagataaaagcaagggcagctttgtcatggtgagctacttcttgcaggaatcaggccagttttttggaattatagcaggagaaggcaatcctggctgtaatgctcccataggttgtataactgaattggtggctcttaagtcagtgaacattttccattttcctgattttttcttaattacgaaaattggagaattccaagaagaaaatgttggagctatgtgcccattttctaattgttcagcaactaatttctctaaagcctccagtttctctttacttagcagccattgttctatccaaattgggtatctgttaaccatttgaaaggtataggttctggaggcttaacaatggctgccatcaaaaatttttccctaatgtttggcgggaactttgttttttccacttgaagtggttctttcaaaccttgcaatttttttttctagtcccgtaccagggacatacctcatttcatgcattgtatattgactttgagggctatataattgttctggaattagaacttgtgctccccattgttgtaataaatctcttccccatcagtttataggtacagaagttataattgcttgaatagtcccaggttgtccatcgggcccctcacaatgcaaaatataactactttgatatacttcagtgactttaccaacttcaactatgttaaattgagcaggttgaattggccacgtggatggccagtactgtagagaaatgattgaaatgtctgctcctgtatctaccaaacctttacatttctttccttcaatagttatttcacaggtaggacatttatcagtaatttgatttacccagtaagctgctttgccttgtttatttgtgcttccaaatcctcctgttcgtttaatttcactttttcccattcccacatacggcacaatcaggagctgtgctatgtgctttcctggctctgctttccagggaacagaagtagatataacaatttgaatatacccattataatctgaatcaatgactcctgtatgtatttgtacaccttttaaacttacactagaccttcctaaaagtaatcctatagtccctgctggcaagggtccacagactcctgttgggaccttttgcaggggttccccaggcagaaggctcacagcttttgtgcagcataaatctactgtggaactacttgctgtggcaggggacagacattgtacaggggtgagggaatggcctgtgctggaaatgccccggtttagaacagggcccgagacggctccctcatggcatttcccgaaatcggattcccttctttatcaaacttagagtgacactgactagcccagtgtcttccttttttacattttggacatatttctggctcaacagttttcttttttcccctatctggtggcctgactcgctgattttttctacattcttttttagtatgaccatgcttcccacagttaaaacaagctccaggaaatggagtatttcctttatccactctcagtcctgccattgcctgtgccaacaaggtagctttatgcagattacctccgataccatcacaggccttgatataatcaactaaatgtgttttccctctgataggtcacagagcagcctggcaatcgggattagcattgtggaaagctaataactgcaacactatatcctgagcagccaaatctgcaatcatctttttaagagactcctgtaaccgagctataaaatcaacatatggttcccttggtccctgttttatagcactaaaggaagggtattgttccccacattaagtgattttttttccccaagctctaatgtgcacacctctaagttgttctatggcatcatcctgcatgaccagttgtgcatctaaaccagcccagccgccaacccccaaaagttggtctgcagttatattaatttgaggttgggcctgggcattgcgagcagcccaaatggaagcttcatctgcccaccaaattttaaattgtaagaactgagcaggagttagacaagctcgagtaagagcgtcccagtcagtaggaatcatccgactggaaacagtaacattccttaacagtcccattacaaaaggagaacctggtccatattgacttattgcttgttttagttctttaagtaatttaaaaggaaaaggctcaaatatagctgtaatatttccctcttgatctgggggatgtattctaacagggaactgccaagcctctaaatcaccctcttgtctagcttgccgaattcctgcctaatagaactaagagccatcgctcgaggcgctgctcgaacagtcactggggcagctatttttcacccagtgtcctctggaaaagaaagatctggggggtcattttcctcaaaaaataatgagggggtgcagaagggtagggatgaacctgtccttcctttgccgctttagctttagctggcaaataaacatgctctgtaacctcttctgttacttcactatactcttgttcctccttgttatcagtgtgaaaaagttctaagatgaaacgaaccagaccccatacctatcccattgttaccctgatgcttcagagctccccttcttactcaccacagggattgctttaagagtactcgggtgtcctccagctagttttctgttcccagccgtcgctctggcgacccttcgacctggattcgagcccccatgaatgggcgccacttgccgagacaggcttggtaggggagaccctaacccagcggcactagaggaattaaagacacacacgcagaaatatagaggtgtgaagtgggaaatcaggggtctcacagccttcagagctgagagccctgaacagagatttacccacatatttattaacagcaaaccagtcattagcattgtttctatagatattaaattaactaaaagtaccccttaagggaaacgaaaggatgggccgaattaattgcagcaggaatacgcccttaagacacagatgctcaggcttttgtttgtggcttaagaatgcttttaagcggttttccaccctgggcgggccaggtgttccttgccctcgttcctgtaaacccacaaccttccagcttggacattatggccattatggacatgttacattgctgcagagattttatttatggccagttttggggccagtttatggccagactttggggggcttgctcccaacatctttttgtaagtttctgtactgatttttacgttttagttctctctactaactttgggctttgtttgttcttgtttttcttttctttttttttgagacggagtctcgctctgttgcccaggctggagtgcagtggtgcgatctgctcactgcaagctctgcctcctgggttcacgccattctcccgcctcagcctcctgagtagccaggactacaggcacctgccaccatgcctggctaattttttgtatttttagtagagatggggtttcacggtgttagccaggatagtctcgatctcctgacctcgtgatccacccgccttggcctcccaaagtgctgagattacaggtgtgagccactgtgcccggcctgttcttgtttttctagttccctggggaacatgattatgttgttgatttgaagtttctgtacttttttgatgtaggcatttattgctataaactttcactcttaattctgcttttgtggtattcattgcataggttttgggtatgttgcatttttatttttatttatttgtttttaagaaatttttctgtttttttttgttttgtgtttttgagacggagtctcactctgtagccaggctggagtgcagtggcacgatctcagctaactgcaacctccacctcccagattcaagcagttctcctgcttcagcctcccgagtagcaaggcgtgtgccaccacgcccatataatttttatatttttagtacagacagggtttcaccatgatggccaggatggtttcgatctcttgaccttgtgatcctcctgcctcagcctgctgaagtgttgggattacaggtgtgagccaccacacccggccttcagttaattttttaatttcctccttgactcattggtcattcaggagcatgttatttaattttcatgtatttgtacacctttcagagttcttcttgttactgatttctagttttatactgctgttgtcagaaaatatacttgatatattgatttttaaaaatttattgagacttgttttgtggcctaacatatggtctgtcctgtggaatgctccatgttctgataaaaagagtgaatattctggccaagcatggtggctcatacctgtaatcccagcactttgggagaccaaggtgggcagatcacttgaggtcaggagttggagagcagcctggccaaaatggtgaaaccttgtccctactaaaaatacagaaaaaaattgattgggtttggtggtgcgtgacagtaatccccgctactcgagaggctgaggcacaagaacccaggaggcagaggttacagtgagccgagattgtgccactgccctccagcctgggtgccagagcaagactccatctcaaaaaaaaaaagaagaagaagaatgagtactctgcattctccagctactggatgaaatgttttacaagtgtctgtgaagtccatttggtctacagtgtagtttaaatctatgtttctttctaggtgatctctctaatgcagagagtggggtattgaaatcctctactattattgcattggtgtctatctttccccttagataataattatatttgctttaatatatcttggttctctggtgtttgatgcatacatatttactattgctaatcctcttgctgaattgggtttttttttccattatataatgaacttccttgtctctttacagcttaaaaactttttttttttacagttctttttacagtgtgacaaacttttcacagtttttgacttaaagtttattttatctgatataagtaagttgcttctgttcatttttggtttctctttgcatggagtgtttttttttttttcccccacttcgttttcagactatgtatgtctttatgggtgaagtgagttgtgtttaggcagcttatatttgggctttgagtttttatgcctttacccagtctatatgtcttaattgggggatgtaatctgtttacattcaaagttattcttggtagagaaggacttagtcctgtcattttgttaattgttttctggttgtactgtagatcttctgtttctttcttgctctcttaattgtttatctttgtggtttggtggatttctgtagtgacaaagtttgatttctttctcatttgtatatctatctgctctactagtgagttttatactagcatgttttcatgatgttagtcattgtcttttcattttcagttgtaggactcccttaagaatttcttgttgagtaggtttagtggtgatgaattgtctcagtttttgcttgtctgagaaagactttgtttcttcttcatttctgaagatagttttgctgggtatagtattttggaatggaagttatttttctttcactacttttgagtataacattctgttctcttcttgcctgtaaggtttctcttgagaaatctgctgtttgtctcacggggattttcttatatatgacttgatgcttttttcttgttgtttatagaattctctctttgatttgatttttgatgtttgagtatagtatgccttggagaggacctttttgggttgaatcagtttggggtctttgagctttttggatttggatgttcatctctctcctaagacttgggaactctacagttatgattttgtttacaacgtttttgataccatttcccatctcttattcttctggaatttttataatgtgaatatgtgttcacttaatggtgtcacataagtctcataggctttcttcatcccttttattctttattattatttgtctgactggattattttaaaagacctgtcttaatgttcaaaaattctttttcctgcttgatctagactgttcctgaaattcttgattgtatttttaattttgttcatggaattcttcagctccaaggattctgtttggttcttttttatgatatctgtgtctctcagatttctcattcatatcattttttcctgatttcgttgaattttctatctgtattctcttgtatctttccaagtttccttaacattgttatttttaatttcttttcaggcattttttagatttctttttcgttagggtctattactggagtattattgggttccatttgaggtgtcatgttttctttttcatgtttcttttttttttttttttgagacaaagtctcacactgtcacccaggttggagtgcagtggcacaatcttggctcactgcaacctctgcctcccaggtttaagcgattttcctgccacagcctcccaagtagctgggattgcaggcacccaccaccaagcccaggtaattttttgtatttttagtagagacggggtttcagtatgttggccaggctgttctcaaactcctgacctcgtgatctgcctgccttggcctcccaaagtgctggaattacaggcgtgaaccaccacgcccaacttttttcatgtttcttgtgtccctatgttatgggtgcatctggtagaatagttgtctctttctattttatggagtagcttttgtaaagaaggactttttcctgtatatttgtcctgcagtattgtttgggtagttgctttggctttgtttctatattagtacagtaatgtagtctccatatgatctttggctgtaattcgtgtcagcagtgtctgcaagtacctcagtggtctctgctgtgagtttttgtagaatgaatctcatgtctttggtgttgataggggcctctaggtggaacagttctcaggccttgggtgttgggtgctcattgggtatggtggctttgccagttgtggggtggaattgccagtggtggctgttgccatatgggcccatcattggtccctacaggtatgtggggtgcatttctgcttcaccagttatgggaatgggattgctggcagtggctggcagctagttcttaaaccctagggactgcatgcaccagtgcccttggtcttggaggtggcctccctgctgtgctagattgcttgttcctttaggtctactatatcagctcaggttctggagttttggctttactgctctgtgtagctgaggttgtggtgttggacccttttatttgattgtggcatgattacagtgggacccttcagatatggaaataccaggtctgttgaaccccatggcagcatgtatttcagcattggctcggttctcaaaatggtgccatgctgtagcagcttgggtcacagggagtggggggacccagtgtgtgttccttctctggagcaatgtaaccatgtggactccaagcagctccctgtaccggattcagggcctgttaggactctagggctcttctgtagctaggtttacacatgtccacagtggtattagggattgctaaggaactcctacctaccatttctcacacaatggggagtctctcttggttctgagccaatcctggctgggtgctttgctttcttctctatgctgccatctcaagtctccatgattaagtggattttttttttctctttcatgtgaattctgttgttctcccttagaaactcttacctgaagtgcagttatttacttgttattttgggcctttgtggaagagtgttggtcctctagtcagtcatcttaatgatgtcttcctcatgtttttttgatagtaaccatcctgataggtgtgaggtagtaagtatctcattgtagttttgatttgcatctttctaatgattagtgatgtcgagcatcttttaatatgcatcttttttgaaaaacagctagtcaagttttttgtccatttaaaaattttattttttattcttgtttagtttttctctgtatattctggatattaatgccttatcagatacatgatttgcaaatattttctcctattctgtagggttttactctgttgataagtatcttttgttgcagaaaaatttattttcatggagttcattttgtctgtttttttttgttgttgttgttattgccctatgcctttcgtgtcatatccaagaaatcattatcaaatcaaattccatgaagcctttcccccatcttctaagagtttatagttttaggttgcacatttagtcctttgatctattttaaattaattttcctatataaagagaggtccaagttcattcttttatatgtatgtatccagttttcccaacactgtttgttgacaacattgccctttcttcattgaatgaccttggtactcttgtcaaaaatcatttgaccstatatgggagggtttatttactcattctgtattctattccagttgcttatatgttggtctttatgtcagtgtcacactattttgattattataactttgcaataaattttgaaataaggaagtatgagttctctagttttgttcttcaggattatttcatctacttgggttgccttgagattccatacgaattttaggatagatttttctatttctgtgcaaaatattgggattttgatagcaattgcattgattctgtagattatttttggtagtattgacatctcaacaatattraatctttcaatttatgaacatgggatgtgtttccatttatttatatcttctttaatttctgttagcagcgtcttttagttttctaagtatttcacctccttggttcagttaatttttatgtattctttttgatgctattgtaaatggaattattttcttcattttccttttcatagtattcattgttagtgtatagagatgcagctaatttttgtttgttggctttgtattcagctactttgctgaattcattgtctttctcttgcctaatagctctggctagaacttccagtttcatgtcaaatggaagtggcaaaagtgggagtacttggtttattcctgatcttaaaggaaaacatttcagtctctcaccattgcttatgatactcactgtggctttttcatatatggctttattatgttgaggtagtgtccttctattccgagtttgttagtttgttttatcatgaaagggtgttgaattttgtcaaatgctttttctgcatcagttgagatgatcatgcatttttttcttcattcttttaatatggtgtattattaggttggtgcaaaagtaattgtggttttggaccatgaattttaaatcagtgtaactaggctcaaacacatctttattaatcaaaataggaaccattacagtcaacacatttttgccaatgagaaataagtttattcttgtagtataaaaatccatgcttcgggattctacaaactttttttctttttttttttttttttgagacagagtcttgctcttgtcacccaggctggagtgcagtggcgcaatcttggctcactgcaagttccacctcctgggttcagcgattctcctgcctcagcctcccgagtagctgggattataggcacccaccaccacacctagctaatttttgtatttttagtagagacggtgtttcactatgttggccaggctggtcttgaactcctgatctcaggtgatccacccacctcggcctcccaaagtgctgggattacaagtgtgagccaccacacctggtgggattagacaaacacttagcattttctgcatcctgctcgttgtggaagcattttccctgcaaaaagttgttgagatgcttaaagaagtcatagtcagttggcaagaggtcaggtgactatggcagatgaggcaaaactttgtagtgcagttcgttccacttttgacgcattggttgtgtggcatacagttggacattgtcgtagagaagaattggaccctttctgttgatcagtgccggctgygggcattgcagttttcaatgcatctcatcgatttgctgagcatacttatcaaatgtaatggtttccctgggattcagaaagctgtagtagatcagaccggcagcagaccaccaaacagtgaccatgagcctttttggcacaagtttggcttcgggaagtgctctggagcttcttctccatccagccactgaggtggtcattgccggtagtcgtatgaaatccactttttgtcgcatrtcacaatctgcttgagaaatagtttgttgttgcatagaataagagaagactacacttcaaaatgacgatattttaaattttcactcagttcatgagacacccacttatctagctttttcacctttccgaattgcttcaaatgccaaatgaccataaaatggttgacattgagttctttggcagcttcttgtgtagttgtagaggatcagctccaatgattgctctcaactggtcattgtcaacttctgacggctggccactatgctcctccttttgaaaagtagacctcttttttttaaattttttttctgtttcaatgcttatttcccctttgttattttttgttctatacgtgtgctttctttctttcttggtcaagtcagccactgctttgtgtatatatatatattttttttgtggtaaaatatacataaaatttaccattttaactattttaaaacatacagttcagtacattcatttaaattaggattttggtttatttattagatcgactggtttcccattttctaactcattaatttctgcttttatcttctggttctttgcccttaaaaagtttctatagttttattgttatcatttaatgtacctaaaataaaattcatccattttgtatacagttgtacaatcctcaccataataaaaatatggaatagtttcatcaccccaaaagtttctttatgtctctttatagttgacctcctttcctgagtcccaacattaggcaacccgtgacttatccatgctctgagtgtatcagtagcccatgtctttttattgctgattagtattcattgtataaacgtaatatgatttatttattcttttgttggacaaatgttgggttgtttttagttgggggctattatgaataatgctgctgtgaacattcatttacaagtctttgtgtggaaatatgtttttatttctccttgttaaatacctagaaatgggattactaagtcatatgttaagtatatatttaattttataacatacagaaatactgttttccaatgtggaaacacttgagaagttttttcattccaactagcaatatatgaggattttgtttgttttacatccctactgacacttgttattttcagtcttaataataattctaattggatatgttgtaacatgtcacctgtggtcttaattttattgtctctgtgactagtggtggttagcatctttttgtgtgcttataagctacttttgtgaagtttctgttcaaatattttggccactttttacattcagaagttatcttattgatttataatagttatttatgtgttacgcataaaagctctttcttagatacatattttacagatattttctccttatctatgactttccttttcatttacttgtgtgtgtatgtgtgtgtgtgtgtatgtgtgtgtgtgtgtgtgtatgtgtatatatatatatatatatttgtttattttttgatacaggatcttgctctgttgcccaggctggagtgccgtggtgccatctcagctcactgcaacctctgcctcttgggctcaagcgatcctcccacctcagcctcctgagtagctgggactacaggtgcatggcaccgtgcctggctaagttttatatttttagcagagacaaggtttctccatgtttcccagactggtcttgaactcctgagtggtgttttttcctgtgttttcacaccacaacacagaaaacttctgtgaccaaatgtatggatttctacccatcaacaagcaagcattcagttctgcagtggacagcagtctgacatcttctaatctaatttgattctactgctctctayatggagatagcatcagatcctgcgggttgaaggcttggtcccacaagattgccaccatttcagacaccagtctcactttcaggactctggaacttctgatcgaccaggtttttaagttggggtttccataaccttctctttcagctaaatttactagagtggttcacaagcttaaggaaacactttatgtttcccaggttattgaagaggattttttttttttttttgagacggcgtctcgctctgtcacccaggctggagtgcaatggtgtgatctcagctcactgcggatacaaataaacagctagatgaagaaataataggccaggtgcggtggcccacgcctataatcccagcattttgggaagctgaggtgggtggatcacctgaggtcaggagtttgagaccagcctgaccaacatagtgaaaccccgtctctactaaaaatacaaaaaaaattagttgggcgtggtggcaggtgcctgtaatcccagctactcgggaggctgaggcaggagacttgcttgaacctgggaggcagaggttgcagtgagccgagattggccattgcactccagcctgggcagcagagcaagaccccgtctcaaaaaaacaataagaaagagaaataatagggtgagatctcaagggtccagagctcaggagcttctgttcctgtgaagttggagtgtgccattctcctagcacatgggtgagttcttgtttaccttcatgtaatcctccatgagttcagctgtctggaggcttgcggtaccctgtcctcttgagtcttttttggagacttcattggataaacatgattgaagaatggacaatcgtatggaaatcttattggacaaaaagggcatgatctaatactaatagactgtgcagagaattgtaacaagtcctgtgcatttagattcttcttggcccctctgtgtagcattatttcctcctggataaggaaggggcaggaccccttcagaaatgcgggtcttatgacctgctgtcgggtaaggtaattcagaggatttttttatgaccagttccaagacagaaagatgggggaagattggagtatatttttagtgtgtgtggcctgccttggagagaaaaaggcgcaggtaaaaggaggacagaaggtcagagagagattctgttttctgaggcccagagcaccccagtattataaccaaagactgtctttcgcctttatcactctgaagctgttctgaagctgcctcccgagccataaacaaagggcctaatacggtaacaaagatacatgtattgttttagtcacttaggaaatgtggacaagggctatggaagttacgagccaggaaccatgaatgtaaacccatatgtatatgtaaaccaatatatatacatcataatactacaccactttatcaatttttttcttgtttgtattttttgtgttctcttcaagaagtctttgcctaattctgtgttaaaaagatatttgttttcttctaaaagattaatatttggtttttacctttaggttttaaggtctaattcatcttaacttttatgtggtgtaaggtaatggcacacatatgctttttattttcatgtaggtatccagttgttccagcaccattttttgaagactatcttttccctcactgaattacaggtgtgagtctatttctggactctattctattttactgatcttgtctttacaccagtatcataccattttgattactgtagctttatagtaagtttggttcaggtagtgcacgtcctctacctggttcttttttgtctaaattcttttggcttttctaggtcctttgcctttcaaatattaattttttaatcagttttttatctttttaaattcttgttaaaattttaattgggattgtattggatttttaggtcaatttgaggagaattgttaccttaacaatattgagtcttccaatccatgaatatcatacatctctccatttatttaggtttcatttctttcatcagtgtgttgcagttttcattgtatatatcatgttcatctttgattcaattttatttctaaatatggtataaatggagttcatttgacttcttaattgttcgttgcatatagaaatatagtttacttttatgtattgatcttgaatcctgtgactttactaaagtcacatattttctaatagctgctttgttgatttcttagagttttctaaggtcatgttgtataccttgggctttcttttagtttactttgttcatttggttgtttttgagttgagaatttaattttactacagtttattctttcattcttattggtaagagtatttagtgctaataattttcttctcatcactgctttacgtgtatcccataaattatatagtgttttaattattatttttaaagaaattcactaattttaatttgcatttttctttctgccaaagagttgtttaacagaagatgtagtagtttgctaagtctgccataataaaataccacagactgggtgatcaaacaacaggaattaattttcttacagttttggagactagaagtcatagattaaggtattgcctggcttggtttctcctaagacctctcttcttgacttgcaggtagccaccttcttcccactttgtcctcacatggccttttctctgtgcctttgcatcccctcttgtctatcctttttgtaaggacactagtcatattggattagggcccacccatatgactttaaccttaattgtctctttaaaggccctatctcgaaatgtagtcatatcttgaaggaacatgtttcagtctataacagaaggttttttaatttccaggtaggagaacctttttaaaaagttaatttcggctgggcgcggtggctcacgcctgtaatcccagcactttgggaggccgaggcgggtggatcatgaggtcaggagatcgagaccatcctggctaacaaggtgaaaccccgtctctactaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaragttaatttctagctttattgcattgtgatcacaatattgtttgtactctttctgctttgtggaacactctgatgtttctttgtaacctaatctatcaagggtaggactagggtaaagcaattgaggcacccagggtgcaaaaaatttaaggcgacagtctcacggtgctgaccctgcacttgcaggagtcttagaatgggtgtcttcttaagttcgcattctggacatgtcacatgcccagcgactatagaactatagtcacttagtcccatagtatatgtcagttattgtgttacgtaaacacatggagtcttataagagtatgaagttctatatatatatatatatatgaagttctatatatatatacatacacacacagacatacatacacacatatgtgtctgtacacatargatctgccttgttaactgcgatgtttargtcttctgtatacttgcttattttttgtccacttgatttgtcttgtacaaagaatgatatattaaagtctcctattattactgtgtttctgtatgtgactctttgtatatcttgtagtttttgtttcataaaggtgagtttcatggtatttggtacagaatataaatattcatagcagttctattttaagtgtgaattgtagcgtttagcattaaaaattgctttttttgtcttttttttttgcttgacttgtctgataccatcaccacttctgttttcatatagtttccatttgcctggtatacttttatcctcttatttttaaattttctgaatcgttttgctttttaaatgtgtgttttatatgtagcgtttagttgggtcttgttttgtgggccaaattttaataaattaaacattttattttaatgggcgaattaagtacattcacatgcagtgagcccttgcctgcaaagatgtgcaggcgggaatgggagagatcacttgctgggatttggtattttttccttcattttacttagttactttgaggttttgggcattttctgtctgccagttatgctaagggtatggttttgtgtggctttatttgttctctttgctttttctgtattgtttttgcagaatatatggataacacagagctagacatctgctgttatcctcaacacttggaaatgctttatgtctgcttttcaaattctaatatcttagtgacgtctctaattatataaagtttgagtggcttttaaaaatcatgttcattaagtggtaggctatgttttgagacagagttcttgatctgcattacttaggaaagaattacttcaggcagaggtatacttattayttacttaggttttataactttatttaaattgttagtggctgtgattctaaaagcatgaatctgtaatagattttaagaaccaatcttgtctgtccttttgcttttagatgggtacattttttaggacatattcaagacaggtcgtttttaaatctctctttgacagtctccagaaagtaggggtagaccctccccaggcatcctactctaatgttttatcctatgataatcccacagtttggccagttagaatcttttctgttagaatttaagcctgtttctcctgctttgggtttctgttgccatagtgataaaatgttcagcattctgtcattacttgaacacaataatgaacttgacccttaggttttgttttgttttgttttttagttttttgctatataaaacagctttcattcctttagcttttcttaaatgtgaataattttctattctgttagtcacattgataatttttctttgattcctctggagtttcacttacaatgtgtaaatgacctcaacttattttaaaataaagacatagtaaccaacataaaatctagcaggattaaattcacacgatttgcatggctttttttttttaatgttcaacaattgtggtattttttccttgacagttatgatttactgatttataagtccagctacatcaaccaggtctattttgatcattcattaaaatggtcataattgcagcacctcctatttagataacccgtgacagattggagacttatctgtgaagcaaaaggtcttactaaggaaatggaaagtataaatcatgcaaagcagaaatatccatttatttacaaataatatatatctgtgataagtagatattaatctattacatattaatcactgctttgacagatcctttattaattatataccagtcttttcttttgatgaaagtgttttttttttaccactagcttatcatagtgccaagagtaataaaaattatttttataaaagtactgtatttcaaaaggctgctccgctgcacatttattcaatttgcaaattaaaaccatgtaaaaattaaaggagtttaaatataatagaatatgtagtcaacttttggttatgacagcaacgcaactccaactaatgcaagcaaacaaaagggactttcttggtttacacaattgtgggaaagataagggttttgctggtttcagggacacctggatctaggaactcaaatgcaattagataatagtgacttttctcctccttttcttttattcctcctctcttattttctctctcctctcttattatctctctcgtttgtctgctgtcctatctctgtgatgctgggaacatatgttgaagccaagaggacaaagttcttgttagcaaactcaagtttaaaaagtctagagtcgaggctgggcgtggtggctcacgcctgtgatcccagcactttgggaggccgaggcgggtggaacacctgaggtcaggcatttgagaccagcctggccaacttggttaaaccccatctctactgaaaatacaaaaattagtggggtgtggtggcagccacctatagtcccagctactcaggaggctgaggcaggagaattgcgtgaacctgggaggcggaggttacagtgagccaagattgtgccactgcactccagcctgggtgacagagtgagactctgtcttaaaaaaaaaaaaaaaaaatctagagacaagtttgggtctagttcacatgctcatccctggacctaccactgcgaccgtggtatcaggcactctggctcagccaaggttatatgcccatgtctctgtgtggagtgggtgaaggaggaggaagtaaatgatatgcagtttgatataatagcaaataaccaaggggaatagcaataaccaagggaaagggaagctgaacatttatgatatcctgtagtcaatacccccttaatttattttttgcatggcttaaagccagggctcttatttcccatttggggctttctgtttttttcttgagcttttaatgaacgtttacatttcatcagtttggatttctttgctgccagtgttggatatttgcttttttaaaaacaaaccaaaaaactatcatttaatatatccacctttctacttagactccatcttgaaaagaattatattggcccattggacacattttctcccaagaatttaaactgtgaagtaagggatgaaaggatatgtgtcaatgtttgaaggaccaggcagggctgtggcatgtctttgcctgtgattcctatcaattattgtatcctggtttcagttttctagttctcttttgagtgggttcttatattctttcaggaaagtttatttttgctaataatggccagtgtcaatttccagtgctcacaagcaagaaccatgctttcagaaggttggtataagaaggctactgccattctcatgagacttgtaggactctttgacagtagagaaatcacagtagaaaaatacaacttctattgtttgccctgtatgttgcttccctttgatagcagggactcacattaaatgaagccaagaagttacattagagcytttgctgcccaatatgatattactagtcacagatgactgttgaaacytaaatttaaattagaattttaaaaaattaaaattcagtttcttcagtcacatgaagtacatttcaagtgtgcactagcaacatgttgctagtgactatcatattggaaggcacagattgtagaatatttccaccatcaaagaaagttctatcagacaacactgttggagtataaactcaagggtaggcattctgtccttgttattttctgatgtatccacaacacttagaatgggcttagcatgtataggtactcaataaatatttgttgaatgtcgaaatagcatatattgggaggccaaggcgggcagattacctgaggtcgggagttcaagaccagcctgcccaacatggagaaactccgtctctactaaaaatacaaaaaattagccgggcgtggtggtggatgcctgtaatcccagctacttgagaggctgaggcaggagaatcacttgaacccaggaggyggaggttgcggtgagctgagatcacaccattgcactccagcctgggcaacaagagtgaaactccatctctaaaaaaagaaaaaaaaaaaaagaaatagtatatatcagtatatcagctgcctgccacagaagacctagaccatgatccttacggttgacttccctatactttgaagggaacttgaaatagttccatcttaatgttattccaaagtttccatttaaacttatttatagctacattttctgttgtaacttggccctccagttcacctactatttctgccttcataattacttcaaaagtataaagtacttgatctcatagttaacttttcccccaacttactcatccttcaccctctgatttctccctatcacctactcattaaaacttttaacagtttccactgtagcctctggaatccctattctgataccaataactttttttgcaatctcaacatttttttaatgcctctccccctgctgaaaactgctttcttcctctcatggcatataacctggaatgccttttaagtagaaattacttttccttcctctctcctgcaacaagagaccaagaagagaaatgagcatttgtaagccccgtttgtgcttccagttcattgtttgagtatggttaaagtgatttttttctttgatatttgtggcatccagttttatacctgtcttttatctcttgcagttaatgacctacagtgtattccttaacagtcgctgaggactttgatatctggctcaacttttttctgttttctgtttctcttaccatcattcttggtgactatgtattcatattgttgaactacccaacaccttagccttacagtttattctatctgcactctggcattcttttatctttattctactttagcatcttgtacacctagacgcttcttggaccttgtcgtcacctagaactgatcacttcaaagacataaatatcttttctttctcttatccatgctcctgtcactgaagatactgaaattagcagtctttggacttctctttttcttccagcctattaacctggctcccttgcttccttttcagcttggaaactgttcgatgttcttacttgtacataagctaaggatatgaattttctcaacttcttgccatcttataattccggtaccttcatccattctctcctccctttctattttgaaaatgtccttttcccctttacttcttaagtgaacagtgcttttaatcccatctctctacttcctctatactcttcgtcacctgtatctttaatttctctatctcggactcttatttttccttcaagatctagttcaaattgcatctcttttatgtagccttaacttatcctctaatgaaagttaattgcagttttttctgttccttgtacgtctgttataaggtatattttcttttgacttactgtgacacaccttgagtattcaaaacctaataaaaagagatactgtactttactcctaaatttacagcactgtcttttgaaactatctgcctttttgaactttaataccattagtcttattcctatcttatttatcttaagattcattatcccatagaatcctaaatgtaatgatcttaaatcatggactaattttctccaaaaaaaaatgagttttagattctaacccagtactgcttcaacaaaatgacctgaaggaaggtcttgttgtatatcatcttctatagtctaccacaatggtgctcttacttagttcatattttcatttagttgttttccccatcctttcatattttaatgaattttcagatactctaccattggtttctttggcttcagcttttgtatgtagggcactattgtttctcttcatgtctgtgtaacctatatagaaagcattaggccataactttcttaactgggtcatgtttcttgttaatttaccaattgtatccagattctcaactggagctaggatatacttagggcctaagttttctaactgtggacctgagctgggacccacagtgttctctgttccattttcatcttcatgattttgtggaaagaaacctttataagtcagtaacctaaaagccccaagttagccaccctgctacctgagaggctgaggcaggaggattgcttaagccaaagagtttgagcccagcctaggcaatatagtgagaccacatctcttatttaaaaaaaaaaaaagaaggcacccagttgataacattcataaacatttaatggaggaagtgcacagaaagtttgaatgagtaatcatgtagctagaattatgaaataagaatgtgactggtactgacggtggagcaaaaggaaaaggactggccctctttagatttatcgtttctggcatttgtatgtaaacgtctcaggaagcaatgggtcatatcttcaggttttttatgttatattatccaatcatctcacacatttaaacagctaatccatgatttgggttggttcgttcagtctgccaacaaatgtttattgagtccttattgtgtttaaagcacagacctagggtcttgagagtgttgtctagataaacacattctacttgggcagataagacatgctaataataccaagctataaataggtgccaagtgaattatatttgagataggcgtttgaagagttttgaaagggaggaggctgaagggcctatcctgccaaacctaattagtgtaatgtcttcctcatgaggttactcatttggtcactagagctgctctgctttttaaggctctggctgtagatgtattattccctttgaagagtctgcaaatgtgtaagtattcattcatctcagggatgaaaagctccataagatattttatagaatacaggatggtgtgttgtattagttttcttttaaatctgtagccttgttagaaggaaaatgaagtagcgtgtgtctgaaagaattttgcaaattgtaaaatactatatggatgtaagttggcctctcctaaactagactactttctgataccttagcaacacattctataattttccatgaaaggccactttttcaggctgttgtttatgtatatcaaaatcctacctgtcaggtttttatccatgtagcgttccccagtacccctggrcagacttgatttctyatcctctctatgcccctagtttgtagattttcctatcacaatagcagtaatttgttttacatttttgttatacgtgaacacaacctartttcttgaagtctcaatctttggttgtgtttgtgctctggtgtcaaacaggcattcaataaaatgactctttaattcagtgaaataaatgaatcatggattcttaataatgccttttgttgggttgtgatttttaggttaaaacttcagcaacaaattgtgactattgaaaatgcagagaaggaaaaaaatgaaaattctgacctaaaacaggtatgattttagcgaagattttccttttattttttcaagtgcttctttaaatttatgttttgcaaattttaaaaaaattttgccatcagtatttttagaatctaaccacaattggtaacatattgttggaggtgatatgtaaagataaaatgttttaaaatgtttaaacttctatactttaataagcttctttggctaactgctattattcttaagatatatatatttatttattaaatgctgwggcccatgataatttttaattacagttataaggacagtattttaatattcagaattttaaaaactcaataraaatatcatccaggttttaagttacttgtgtgattgacttgtaactttatatcatgaggtattttttgctatatccctatgaaatccaagatttgtatttatggaaggaaatttgtgtttataattaaagttatttgggttcaggaaagatttgtataaagttgggtaaaacatggaagagtgatcttttctgaattctattttcttttttgttgttgtttttttccctataaattatgaagtaggattccatttttagaattcatgctcatatgcgagttggtactgcttttcatgtgcagttatggtttctaagtcttaactagatggacataacgtttgatactcagaagttatttagtatcattggcatttgggctttctgtcatgctatgcatatggagaggtattaagctctttgaaggttgcttattcaagcagctgtaatacagatttaatatttgccactccagttaaaaataaagagtgaatagttctacatggataaatttattctaaaatagaaatctgagacataccgtttagttttattctgctaaaaattgctctgtggaccttcagaatcctatctgaattgttttgttaccattaggaagtaatgagattattacccatttattttgtttattatataagaatcttgtttctttttacccttgaatctcataataggttcttttgatccctgtctcttgactgtctttgctttgaaatgtcttcagaaaatggctaagagagataaaaggaagtgaaaggaaaataaggacttttattgtttactaattggtaaaatagcttgtgggggaggtatgtgtaactgtcccaaataaagagatttggatataatttagaagagtgtgaatctttctagcctgttaatctgtaactagacttcttatgagaaaaagtactcccagataaaggtaaattgggatggaaaaaaaagctgtgagtgacattatgtagtttggtaaatggctgtagaggccaaggaatctatagcatttattagatttcccagagcatctttcttctgcccagcactggacatacagaaggtttggaaaccttttaaaaacaatgtgaggagtgatccttcccacatttacactgaacaattttgattgctcggagagtagaacttctggaaggttgctgatctcagggtatgtgggaagaggaggatggatttttttttttagctgctttcccagctgacttgcttttaaaatcagttttttttcctaggaggtgaggagaaggctagagtggtaggagactcactctaatcactggattcccttttctcatctcactgctaatccccctgataacccttctctccattcccaatacctctcctggcctgcatattttggaaagaagagggaggggactcagtgactgaggaatatagttcttgatagtctctgattataataagaaatgctcctgggtgctgctatttgttatttcctttaggggtcatctccaaggacacaccagcttgagggagcatttgcaaagggagatgcttagtatcttctgcttctctcataccttaccgcatttatttagtgggctttaatttatcttctttcttctcttttaagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagtagagtttgctctttatgtacaaactattttttcttttttctatataacatgtacttattttagtaatgattccaatgttgattatattttagaaactagttacaaatacactttaatagtgtacaatggtctactgaggtaataatgtactttatgtttttatagaatgaactatactgactcttgaattgtttttaaaaaaattaagacattaaaattctgacagtatagtattctgaaaaacctcaaagaaaactttttttattcattgattaaaccaaaacatttcttcaaaaatctattcttctgaatgccagagaacagaatgggttttttgttttgtttttgatgtgcaaaacttaattccttgaattagaactatcttggattttctttgaaaagctaatttatttgttttttttttttttttttttggtcttaaaatttgttactagtagacagtatggagtaaaactggtagggataaaatgattgtggtgatgttcaagatcttatatcctctggaaaaatttgtttagatgtggtagaacactgtactattttgtatttgctttgtctttataacatgttggccttgtaagtaagtttttattttaatctacaaaacattattcttttcaaatttcttcttctgaaggccaccatgccacataaaactgtatttcttcagtttttctattattacatattcaaaggtttgtccatgcttttttatatggggttgaatttcaagaaaaggaagtaagcaagataaatgtccatagcatgtgacatttcagttgatccaacttatttttcttttattttgtaaaaaacagaaacatgtgcttggatttctcaagtgtttgattgaaatgagcttaataattctaatgacagtatagctagcaaatttaagtaattaatcattggtttctaaataatattcatagaatttcatagaagaaaatagctgaactaagggtcaatggaatgtgattttagttccagctaagatacttaaaatcttgtatgaccttaggcaagtaatctaacttctcagggtttgttattttcattagtactgcctatagtaagaatactaaaaaaatcatataaagtatgcagaatagctttaaaaatataagttgttatgatgttattttaagatatcatttatatgcattttactctagtcagaagacatactgcattaagatttgataccaggcttgattttcttaaaccaaatttatgaggacagatatttgtagtttgatggttattatacttcacatctggttatcaagtgtttgtcttgccattaactagatgtgagcccttaagttcgttaactgctctaatcctcagtttcctcatttataaaatggacagaagtataaaggtgacagaaatacctaactcaggatttttgtaaagaacacatagttttctaagtccagtgccttattcataggaagtgctcagtaatggtgggatttccaaacaagtggccatacaggagggcctgcagttggataattaagaatgtggtcagacaggtagtgagtttgcttatacttgtgataatatctatttaatcctaagaacttatttaacttccatgttttacatacattcttctgacaggacattggaagagaaacagatacagtggttggaagaaaagcataagcttcatgagcgtatcacagacagagaagaaaagtacaatcaagctaaggagaaactgcagcgagctgcaattgcccagaaaaaggcaagtggttcttattaaagtgatctctggccaggcatggtggctcacacctgtaatcccagcactttgggaggcggaggcaggtggatcacgaggtcaggagatcattgagaccatcctggctaacacagtgaaaccccatctctactgaaaaaatacaaaaaaattagccaggcatagtggcgggcgcctgtagccccagctactcgggaggctgagacaggagaatggcatgaacccgggaggcagagcttatagtgagccgagatcgtgccactgcactccagcctgggtgacagagcaagactctgtcgcaaaaaaaaaaaaaaaaaaaaaaaaaaaggaaaaaaggtgatttctatggagtaaaatataattaaatctttttttttttttttttttttttttttctgagagtctgactcccatcacccaggttggattgcagtggtgcaatcttggctcactgcaacctccatcccctgggttcaagcgattctcatacctcagcctttcgagtagctggaattataggcacatgccaccacacccgactaatttttgtatttttagtagagacagggtttcccatgtttgccagactggtctcaaactcctgacctcaagtgatcctcccacctcagcctcccaaagtgctgggattaagaggtgtgagctaccgcgtccatcctaataaactcttataggagaataaagtatatagttgaatctgagattttagtgatatgtttaatttgatatataagcatgacattttgctgtcaaccttgcagaaataaattgggaaaatccaaactgtccagcaggtttgtttctaaattttgtatgtaagtcagttgttttgagctgacatgcatttttccatacagaaggtgtttttcagagtgatagtttccaggccatcccatggaagtcatatttaacacattctccagttaaattatagtgtgattaagcttgtttcatttatacctaatatctgttttattgcttttgtggttaaaaggcttttttgtttccaattcagaaatacaagagcaagtatttctttgctccagcaggaggaaatgggactcccttggtttctgaaactgccacaggagttcccacagcattgtgatcctttttaagttttacctttgcaggcatacttttctccagaacctaactttgttttcttggaaacaatccagggcatcatggaaataatgtatctagatggatcttctaaatcagtgacttacaacttttttctatttcagcaaacccaagaataatataacaggtcccattagtaaccatgacttatggtggtgattaagggaggggaaggacatggtaatcttttcaacaggattagaggaagaggagggacatgataaagtgtgtgtgtgtgtgtgtgcgtgttatatgtaaagtcccacaaatgatttgagttgtcttcatttgataaattcccctaatagtagcatttgttgtggagaggagagaagatctgaggtgagaggaaaatgcttctaggtgcaggaaccattatcttaatatctgtttattggaaaggttaactgtttatatttggataagagaaaataactgtagatcgttcagttattctgaatttgaaaaccacacagcagttcctagacccctttttatgtaattggatatcactgccaaatgttgctgatggttggagtgacaacatgagtagtctaaaagtcattccttctctactttcttggtctctgaatattacttttatcttctcataatgctagaagtagtattattggaaaaacagcatttattatatagggatcccagtgttttatacccaaatatgcacacttgtttgtttttctgtatatgtcacttttcttcctttctgtcgatgtaggtactgaaaagtgtatgaatattaatgggatttcagaggattgttttatgacctatgaactcagaaatcctactgatttttgtttgcactgtgtttgaagcctagaaacatctgaagccgtgttacagcaagaaattttaagagctaaattttgaggctttaggaataagtatcttacagatcaaattctaattattaaggttagtttgggttgaattcttttgaagcaaaagtgacacccagtggtgagattatcagctaatcataagtataccagaaggagtggaggaggttatatttttaaaaatctacaaaatatagccagaccccatctctataaaacatgaaaaaactgtgcatggtggcacatgcttgtagtcccagctacttggaaggctgaggtgggaggattgcttgagcccaggagttcaagattgcaaagagctgtgatggcaccactgccctccagcctggatgacacagcaagaccctatctcaaaaaaaaataataattaaacaaaaaaaccccaaaacactacaaagtaacatttcattagtattgtgacaggatgaatttttttttctactgaaatgtctaccagatgatgagtgtgaagatagtagatagtcattttactttttaaaatgtgatctatggattgtgatttaagtcatagtgaaattgttaaggtcaattcagtgaatgattatgacctagaattgtcctaytatgtgggacactgccctaggagcttacaagtttacatcaattaaaatagaaaaacatcatgtgtaacttagaaatacaattaaaaagtatataastatgtataattttaggactggaagggatcttagcattcaaatagcttttacaagttagcaacctaaagtaggaggtacccaagattacttaactagtaagaatcaaaagttgactaaaatctacatgtttctgttctcagtctggtgctctttccactgcgctgttaggctttaatttcctactttccttgattccaaatactttacaacttttcgcttaatatagctatggtccatatgagtcgtttcttatgtcagaataatcactgtaaattaatttaactcatacccttttcccattcaagttaaagataatgcttctatttgaccattttggctatcagattacataaatataattcataagagtgcaacagacttcttagattctttaatgccaaaagtcatagcattttttgccgtaagatgtaacaaaagtcacaaattatgaacccagtgcagaaataatcctttggagttgctttcctgtgaaaagttcttttttccctgaggctgggtaagatggctcgctgccgtctgtgtttactcagagctccaagctcctgagcacagagattgtcatttctgctgtttttaagtagtctttggtgtaaatgatgttttgttgtgttgatttgtttggaaaagcttgaacaggatcttgagttgggatgcccttctgtgactgatacatacagagagagtgtattccccccacccccattgaagagagatctcttgaagtgaacacagtgagttgggtttttttcttttttcttgaggaacctgaaatgacaacttgttaattttattctaaggtatacgtctctgaaataattcttggtcagatactattatgaatgttttcaaaaaagagatgaatcatagtcttgaagttgcaaaatatctgattgaatatgttgtgtggcctagattacactatacactggggagaaatagaagccatgattactccttggctttgataactatataatcttgctggagaaataagataacatgcaagaaacacctaaataatcccactagtcactcctgggtgatttatgtggactctaaagtttgagaaccactgtgctagacagacaaaagtctgaagacaaggagaccagttaggaagctgttatagtaaacttaaagtgaggtaagaagtctagaattggggcttggaatataggaatgaaggtaaagcgtgactgccagaggtattccaaaggaaaaaataattgcagaatatattggtaaataagaaagaaaactatgaagtattttagctgtgagaagatgtaagtggagttatgataatggattgaagaatgtcagttgagtagaaagataaaaaacacatgtcagataggaaatgatggcagtgcatccatgtagacatgacgtagactcttaagtaaagatattatataggtaactagaaataatagaatgtgaagtacagagatgaataattcaaattagagaaatataattagaaactcaggattttgcagatcactgaagaatactaagtttacttagaacgaggagctaggtgtggtggtgaacagaggtagaagctatattgtgatgttatgggaaccaaaggtaaagaaagttatcaaagataaatggtcattaacatgatcattgaaaaaaagttaattggatttgactagagggtggtaaaaggggaatcccagccttaattcttatatctatattgttttaattgttctattagtcctttgtgtcatattgtttataacactaaggcatcgatttgactatcctgtgattgtgttggaccactcaagtaaaaattagaatcattcctttccactaattttacctctggactttgcatttctttcagtagaagttattcttccagtcacttaggcttcaaacctgtgattcatcctgaggtctgccttatctccaaatttagtcaggcactatattagtttcctagggctgctatgacaaattaccacaaaccttgtggcttaaaacaacaaaagcttattctctcacagttctggagcctagaaatctacagtcagagtgccagcaggagcatccttcttcaaaaggctctggaggaggatcttttttcatgccccttgtgtagcttctggtagttgctggtaatccttggagttcttgggttttagacaggcacatcactctggtctctgccttgtctttacatgatggtctccctgtgtatctgtagctctgtgtccagatttcactcctgttatgtaaggacaccagtcatagtggatttagggyccactcgaatccaatctaacttcatcttaacttgattacatttgtagaccctatttccaaataaggttactctagggtgttttccaataccagcaatcatttctttgttctctggataccaaccaggtgtccaaaaattcaattctgaaactatctacctggagttagagtcagatcccacaagttaaacggctcagtcccacaagactgccccaactgcagacaccagttgcaagtctgagtcacctatattctgactgactaacttaggggttcccatgaccccctcctccagtttgataatttgctagaatggctcacaaaattcaggaaaacactatatttaccagtttattgtaaaggataaaagtcaggaatagccaaatgggagaaatgcattgggcaaggtgttgggggtcggggattgtggtgcagagcctccatgccctctctgtgtgagccaccctcccagcaagtcaatgtggtcaccagcccggaagctctcaaaatctcattgttgaagagtttccagccccctccccttcttacgggtcaggggagtgaacctgaaagcattcaccatctaatcacttggtctttctggtgaccagcccccatccttaggctatctagggacctcaactctaagttacctcattaacatcaactcaggtatgattgaaggggacttgctaagaattatacaaaaaccactcctatcacttatacaattccataggtcttagcagctttgtaccaggatctgggtacaaagaccaaatatatttcttcttataccacagtcacattctgggtgcccatgaatttttgggagacattattcaacctaaaataagaactcataaagcctatgaattcttcctttatgatgcctctcaaattttcccccaccccatatttcttttcattcctattactaacatccttggtcagactgtcttccctacgaggtttatctgtattcatttatccaatttactcaacatatctgttaagcatctattatgtatcaggtacttactcattcactggaatacagaagtaaacaaagaccctgcaccatggagtttacattgtagtttgttaggagacatagaataaagaaagaaatactatcaggtggaggtgagtactaagaggaaaattgacaggagtaggctgggtgcggtgactcacgcctgtaatcccagcactttgggaggccaaggcggacagatcacctgaggtcaggagtttgagaccagcctggccaacatggggaaaccccatctctactaaaactacaaaaattagccgggcatggtggcgggtgcctgtaatcccagctagtcagggggctaaggcagggagaattgcttgaaccctggaggcagaggttgcagtgagcggagatggtggcagcacattccagcctgggcagcacagcaagactccatctcaaaaaaaaaaaagggagagaaaattgacaggagtagggggtgctgttttatgtaggtggtcaggcaaggcttctctggtaaggtaacatttgagcagagactgaaggaaaggagggaggatgccatgttgttatatgtaaggtaagggtgttccagagggaatagcaagtacaagagaggcaggaatctgcttggtatgttgagggaacacaggaggcccagggagctagaatagaaagaggtatagtaggaggccaaatttatgccatgacttcagcttttattctcagttaaggtaggaacacactggaggtttttgaattgagaagtgatatctgaattacatttttgaagaatctctggctgttgtgtagaggggcagaataggagtcagggaaaccatgttttagtygtccaggttacagatcagcactaaaaaagatgagtttagaactaaaaaaatacaataacaataattaactcaatggatagatttaatagcaaacaacatcaccatcatcaagagatgagcacaaatcagtgacagagacagaagatgtacagtgaggaaaatagaaatgccaagagttggttttaaaaagattacgaaattgataaagccttggcaagactgattgtcctcagactccccacaaagtagatgagatgagattagagccacaaatgaacaatgtagtgaatgaaaaaagggatatctatctatagatattaactatctgcatatagatattaaaacaaaaggaatagtataaaaactattatgctaattaatcatgcaatttagaataaatgaatacatttctttaagaacatcttaaacctaatacaagaagaattaggtcatttggatagtcctgtatctattaatgaaatgaaatctttagttaaaaaccttccacaaagaaatgcctcatttggcttcactggtaaattattccaaatacttaaggaagaattaatactaatcttaacgcaaactcttccagatgatagaaaaggaggaaacacatctccacttatgagattagaacctgatagaatcaatataagaaaaattgcattataaacatgtaaaaatcttaaatattagcaaactgaatttagtgatatagaaaaatgataatatagcatgagcatttaggttttattctgggaatataggtggcttaacatgcaaaattgttcagtgtaattcaacaccctaacagaacaaagaaggaaaactattgtgatctctagtgtgaaacataatttgacaacattcagtacccattcatgataaaaacttttgccaaactgggaacagaagggaattttcaatcttataaatggtatctataaaaattctgcagctaacatcatacttactgattaaaaatattgactgcttccccttacttacccaaggtcaggaacagatgtctactatcaccattttgtttaatattttatyggaggttctagttagtgtaataaggcaagaaaaagaaatggagggggaggctggtcaagatggccaactagaagcagctggtgtgtgccactttcatggagagaaatagaaggagtaagtaaatacagcaccttcaactgaagcatccaggtacacgcattgggattcatcaagaaaacaacttgacccagaaagaatggagaagagcaatcaggacagtcatccacttgggagtgacacagagccagaggagcctcctcttcccagggaagtggtgagtgagtgagtgaccccagcgacccamgcttctcccttggatctttgcaacycacaggtcaggagatccccttgtgagcccactccaccagggtctgcagcctgttacacagaattatgtggagtctcagcaatgcagccgctcagatacacrtagagccctgggagctttagatacccaggtttcccatcaaaagcaactgcaactccagccaagcrggacgttagacccctgtacatacccctaggaaagaggctgtatacaggggatagagcagtgacagtctgcaggccccactaccatggcaccttgcaggataagacccactggcttggaactctagccagccactggtagcagtgttacacctctctgagatggagctcccagagggaggggtgggctgccatctttgctgttttgtagccttagctattgccttcattgcagccaccctatggaaaagcatccagactgcttttttatgcaggtccyagaccctgcttttcaatgggtgggggacctcccgaccagggtcactagtcacccttgttggtgttttccagctggcagtggttccaagccaccctgggacagagttcccagggggagggatggggctgtcatctttgatgtttcacattcttagccattgttgcctttgggctctagggagtctgagttggttagggactggagtgatcccctggtacagagcagcagctctaaggagaagtggtcaggctgcttcctcatgtggctcctggatctcatttctcctcactgggtgggatctcccgactgaggtctacaaccataccccaaccagtgttttctggccagcagcagtttcaaacctccctggaatggctctcccagagagaggggcagggtgccagctttgctgttttgcagccttatctctttgcctttgggatttggagagtctgaagcaactgttctcgaggtaccccctcacagcacaactgctctatgaaaaagtggccagactgcttttttacttgaatccctaatcccattcctcctcagtggacaggaccttttgaccagggtttccagccacctgcaccagtgttttttggctagcaacagtttcaaacctccctggaacagagctcccaaagagaggggtggaccaccacttctgctgtttagcagccttagctgttgtcttcaggctttagagagtctgaggtgattagcggctggagtggacccctagcaaagcatggctaccctatggaaaaagctagacggcttttgtatgtgggtccctgatcctgttactcctcactaggtaggatctcccaaccgaggtctctagccacctcctgttagtgtgttctgccagcaacaggtccgtgcctccctgggacagagttcccagagagaaggcagtcctccatctttgctgtttcacagacttccttgttgatatcttcaggtactggaaaatttaagatgaaaagggattggagcggacccccagcatactgtagcagccctatggaaaagtggccagactgttatttgggtccttgattctatatctcctcactgagcacgtcctcccaacctgaatctccagccatccccaccagggccatccagccagtagcagctctgttactgtctgggacagagctcctagtgggagggatgggttgccatctttgctgtcttgtagccctcactcttactgtctccaggttctggagagtctgtggggaccaggggctggtacggatgcccaacacaaagcacctacctcagaaaagtggccagactgttctctatgcaagtcccagtcctcacttctcctccctgggcagggtcacccaacctggaactgtagcacaactaccctgagcttgcctgaccacttcaatcagaggcagcccagcagttaaaggaacacccccacgcagagatggaaccatcagacagaaggaatcaacggaagaactctagcaacacagatggtcggagtgtcaaatggccactagttctccaacaagggttcttaaccaggctgagttggctgaagtgacacaaatagaattcagaatatgaataggcatgaagataatcaagattcaggagaatggcaaaacccaatccaaggaatctaagaatcacaataaaacgatacaggcactgacagatgaaatagccagtataaaaaagaacctaactgatctgatagagctgaaaaacacaagaatgtcacaatgcaatcacaagtattaacagcagaagagagagaccaagctgaataatttcagaacttgaatactggctctttggagtaagacagtcagacaaaaataaaaaagaagaatagaaaagaatgaacaaaacctccaagaaatatgagattatgtaaagagaccaaatctacaaatcactggcatccctgaaagggttggggagaaagcaaacaacttaggaaacatatttcaggatattgtccaagaaaacttcctcagcctcactagagagaccaacaggaactatagagaacaaaattctacacaggaagataatccccaagacacataatcatcagattttccaaggtcaaaatgaaagaatattaaaggcacttggagaaaaagggcaggtcacctacaaaggaaaccccctcaggataacagctgacttctcagcaggagcccttcaagccaggagagactggggacctatagtcaacattcttaaaaaaatcttcaaccaagaatttcatatccagccaaactaaccttcctcgacaaaggagaaataagatcctttttagataagcaaatactgagggagttttagataagcaaatgcttgttaaatggagacccatctcacaagagatcttgacaggaacactaaatatagaaagatggttaccatgattctgctgagagagagcattaaaaaaaaaagatggttaccagccaatacagaaacacacttaagtacacagatgagccacactataaagcaaccacacaagccagcctaataaccagctaacaacacaatgacaggatcaaatccacacatattaatactgaccttgaatataaatgggctaagtgcccccatttaaaaggcacagagtggcaagctggataaaaaagcaagacccagtgatatgctgtcttcaagagacccatcttatatgcaatgacacccataggctcaaaataaatggatggaggaacatctgccaagcaaatggaaatcagaaaaatgccagggttgcaatcctagtttcagacaaaacattttaaaccaacaaaaatcaaaaaagacacgggtttacataatggtaaagggttcaattcaataagaagacgtaactatcctaaatatatatgcacccaacataggagcaccyggattcataaagcaagttcttagagacctacaaagagatttatactcccacacaataacagtgggagacttccacattccactgacagtattaaatccttgaggaagaaagttaacaaagatattcaggacgtgaacttaacattggaccagatagatctgatagacctctacagaactctacatccaaaaacaacaggaatatacattcttctcattgctgcatggcacatactctgaaattgaccacacaatcagacataaaacaatcctcagcaaatgcaaaagaactgaaataccaaacacacagcacaataaaaattgaaatcaagactaaaaatataattgctcaaaaccatttacatggaagttaacctgctcctgaatgacttttgagtaaagaatgaaattaaggcagaaatcgagaagttatttgaaactaagagaaaaaagatacaacataccagaatctctgggacacagctaaggcaatgttatgagggaaatttatagcaccaaatgcccacatcaaacagttaaaaaagatatcagcaacctagcagcacaactaaaacaatgagaggaccaagagaaaaccaacccaaagctagcattagagctgaacagaaggagatcaaaacatgaacagccattcaaaagattaactaatacgggagttgcgtttttgaaaaaattgttaggccactagttagcctaatgaagaaaaatgagaagatccaaataaacacaattagaaatgacagaggggatgttaccactgaccccacagaaatacaaacaaccgtcacagacaactataaacacctttctgcatacaaactaacaaagctagaagagacagataaatttctggacacatacaccttcccaagatagaaccaggaagaagttgatttcctgtacagaccaataatgagttctgaaattgaggcagtagtaaatacctgccaaccaaaaaaagcccagggccagatggattcacagccacatgctaccaaatgttcaaagaagagctggtactgcttctcctgaaactgttaacaaaaaatagaggagcaggaaatccttcccaaatcattctgtgaagccagcattgtcctgataacaaaacctggcagagacacaacaatgaaaactttaggccaatatctttgacgaatattgatgcagaaatccttaacaaaatgcttacaaaccgaatccagtagcacatcaaaaacctaatctaccatgattatgtaggttttatctttgggatgcaaggttgattcaacatgtgcaaatcaataaatgtgattcatcacataaacaggactaaagacaaaaaccacatggttatctcaatagatgtagaaaaggcttttgataaaattcaccatccctttctattaaaaactcaataaactaagtattgaaggaacatactacaaaatgtgagagccatctgtgacaaacccacagctaacatcatactgaatgggcaaaatatggaagcattctctttgaaaaccagcacaagacaattataccctctctcaccactcccattcaacatagtattaaaagtcctggccagagtagttaggcaagagaaagaaagaaakaaagggcatccaagtaggaggagaggaagtgaaactattcatgtttgcagtcgacatggttttatgtttaggaaacccccatagtctcaatccaaaaagctccttcagctgataactttagcaaagtttcaagatacaaactcaatgtacaaaaatcactagcattcctgtacaccaacagccaagctgagagccaaatcaggaatgcaatcccattcacaattgcacaaaataaaatacctaggaatacagctaaatgtgggtgaatgatctctacaatgataattataaaacactgcttagacaaatcagagatgatacaaataaatggcaaaactttccatgctcatggataggaagaatcaatatcattaaaatggccatactgtcaaaagcaatttattgattcagtgctatttctatcacactaccaatggcattcttcatggaactagaaaaaaacttttaaaattcatgtggaaccaaaaaagagtccaaatagccacagcaatcctatgccaaacaacaacaacaaaaaacgtggagtcatcatgctacctgacttaaaactatactatagagcaacaataaccaaaacagcatgatattgatacaaaaacaaacacataaatcaatggaacagaatagagtaaccagaattaaggcctcacagctacaatcatctgatcttcaacaaagctgacaaaaacaagcartgggaaaaaggacaccccattcattaaatggtgctgggataaacagctagccatatgcagaagattgaaactagacctcttccttacaccatatgcaaaagtcaactcaagaaggattaaagacttaaatgtaaaatccaaaactataaaaacactggaggacaacctaggcaataccattcaggacataggaactggcaaagatttcatgatgaagatgccaaaagcaatcacgacaaaagcaaaagttgataaatgggttctaattaaacttaagagcttctgcacagcaaaagaaactgtcaacagagtagacagataacctacagaatgggagaagatatttagaagctatgcatctgcatctgacaaaggtctatctagcatctataaagaacttaaatttacaggataaaaacaaccccatcaaaagtgggcaaaggaaatgaacagatcattttcaaaagacatacatgtgaccaacaagcatatgaaataaagctcaatgtcactgatcattagagaaatgcaaatcaaaaccacaatgagataccatcttacaccagtcagaatggctattaaaaaataaaaaaatagcagattctggcgaggttgtggagaaaagggaatactttgatacactgttggtgggagtgtaaattagttcaaccattgtggaaagcagtgtggtaattcctcaaagagctagaaacaactaccattggacccagcaatcccattactgggtaaatatactcaaaggaatataaatctttctgccataaagacacatgcatatgttcattgcaacactattcacaatagcaaagacatggaatcaacctaaatgcccatcaatggaagattggataaagaaaatgcggtatatatacaccatggaatactatatagccataaaaaagaatgagataatgtcctttgccaggtacatggatggagcaagaggccattatccttagcaaactaacacaaaaaaggaaaaccgaatactgcatgttttcattgtcataagtgggagctaaatgatgagaacacatggacacaaaggggagcaacagatactggggcctacttgagactggagcatgggaggaaggagaggatcagaaaaaataacttgggtactaggcttagtacctgggtgatgaaataatctatttacctataaaacaaacctgcacatgtacctctgagcctaaaaaaagttttaagaataaagaaatggacataaagagtagacaggaatttaaaattattcacagatgtcactgtgcatgcataaaagtcaaacctatcaaactattaaaattaatatgaatttttaaaatttctaagtacgaagtcaagtaacaaatactagttatttttctttacacacacaattagaaaatatttaaatgccatttacaatagcataaaaatacctaaaatacctaggaacaaatctagtgaaagatgtttatgacttctacactgaaatacaaatactgctaagaaaaatggaaaaatgcctaaagggaaaactgtaccatgttcatgacttggaagattcaatattaaggtgtcagttcttcccaaatttatccataagttgaatgcagttctaatcaaaatctcagcaggtttctttgtagaaattagaaagtagattctaaaattcatctgaaagtacaaaggactagaatacccaaagcaatcttgaagaacaataaarctagaggacttaaaactaccaggtatcaacactaaatataagctacagtaattcagtgtggtattggcataaggataaacaggcaaatggaacagtatagagtccagaaataggtttacactaaaggtaccactgcatttcgataaaggatgttccttcaaatagtagtgagtcaatagattaaactcagcctaacctcacaacatagataaaaatgaaccatacacctaagtgtgataggtaaaaaaaaaaaataaagcttctagatgaaaacttgggagaaaattttaggatcttgggataataaagataagcaggatgcaaaaagttcctactataaaatacatgattgatgtaattgattttatttaaattaaaatctttttattaagggatactcttaagcaaaagaaaatgacaccacaggctggagaaggtcaatctgcaatacatatatatctgacatacgattcatatcttgaatatataaagaactacaaatcagtaggaatcaggttactcaaaagttttaatggacaaaagactaggatggacacgtcacaaagaagggatatccagatgactaacatgcataaaaaaagatgctcaatacctttagctatcaggaaaatgtaaattaaaactacagtgagatactgtatttcaccaaaacaggatgcaaaagctaaaagaccgaccataccaagtactggcaaaaatgtagaacagctagaactctcacatattgctggtggaaatgtaattggtaaaactgctttagaaaactggcagtatctactaaagctaaaacatgtatacactatgacccattcataggtatatactgaagagaatgaggtacttaatctgcgaaaaacatgtttaggaatgttcgtaaaatatttatgatatccccagactggaaagaatttaaattttcattaacaggaaaatgtataaaatgtggtatatttgtacaatgaatgacaacattgcaatgaaaaagaagtactgtgacaatrcataaccatggcttagtcatatagataaaatgttgagaaaaaagtccagatacaaaagagcataaatttatgatttctttcatatgaatgggtggatggatagacagatggactccttaactgcctataaattcataaataaatacttatggtgataaaaaccagaagagtggttcctttgccagggtagacaggagcataaggaagccttctgagatgttggaggatgtgggacaatcaaagcatgagaatgaatgctcgtagcagagttatttgtaatagtcccaactggaaataatgcagataacccttaacggtgtactgagtgaatatactaggttatgcaataatcgtaagtggaatataatatgtgggaatgaatgaagtatatctgtaagtaacataaatctcactaacaatgttgagtgaaataaagtcattaataaaagactacatactatgattgtatgtatatgaggttcaaaaataggcaaaagtaaactatagttttggaagtaaattagttggttaccctttcagaggatgacagggctagtgattggaagggggaaaggtaggggcccttctggcatggcagtgctcttgacctacaaggaaatcatgccagcatttgttttgtggtttttctttgagctttacgtttctattctatgcattttgctgtaagattatacttcagttaaaaaagagttagaaaatacctaaaaggtttgtagcgactaaatgagttttaacattttaggtgtttttctattaaaaaacaaaaggcctgtgtataaaaactgaaaaaaaatactacttttttccatacactccttttgcattttacctggacttttccgtattgtttaatgaaaccatacaagatttacttaggaatttctccctttgtatattgtaaagtttaaattttttccttttaagatttagaaaggcaacttttaaacagatgcatccatatttatcttagctttctgatccttcagttttattaatttggtagtactttataacttacaaacgtgcttgtaattttgaattttacttcagttcttttcttttccttttttgagacagagtcttgcttttttgccaggctggagtgcagtggtgcaatctcggctcactgcaacctccgcctcccaggttcaagtgattctcctgcctcagcctcctgagtagctggaactacaggcacccgccaccacgcccagctaatttttatatttttagtagagatggggttttaccatgttggtcaggatggtctcaatctcttgaccttgtgatctgtccgcctcggcctcccaaagtgctgggattataggcgtgagccactgtgcctggctccccacccttttttttttttttttttttaatgggttcttgatctgttgtccagggtggagtggcacagtcatagctaactgtagccttgaactcctaggcttaatccatcctcctgcctcagcctcccaaagcactgggattacaggcatgagccactgtacctggctcagttctcttaaacacatgctatcttctggaacaatggagagctcattatttcttaccagatgtacaggcagactcagtagtaaaatttgactccttccctttgtagattttttttttgcagcaattattgataacagtttttttgtttggcattcataattaattgtcacattgagaatattagatagatttgtggtttattatctttgcaattttcagtaagagccatgtctactaacctttgtttctagtattcactgaaaacattcatatctaaacacagtttttggtgagtaaaatattttctatatagttttgttcaaataagagattatgtattaacatacttgttcatatttctctttttagagaaaatctcttcatgaaaacaaattgaaaagactacaagagaaagtagaagtcttggaggcaaagaaagaagaattggaaacagaaaatcaggtcttaaataggtaatgtgtttgtatgtgtatcttccccatgtggttattttgatgtcatagaactttgtctctaagtataacgtaccttcttttcttttaaaatatacattttaaagatttctaaaacagcttgataactcctaatgtactatcctttttttaccccctaactgaatgtttctttaaaccaaaaggtctctgtcacataccaggtgtttgccttatgattgggactaacagaaaatgtcactggctttggtagcaaggagtggtgttagttgttgctgctgtacaagacagttgtagctattgcatagttctgaaaattgtgcctacaactttgaatcaaaggtcagttttggtttcctggtgtggagattttattgagctgtagtttcgggttttgcagtcacattcaagcacatctgataatcaggatcatcagcatttttaaagcagagatttgtcatattaagttgttggtagtggcattatatgacacatttgattcaagttaagaaaaatctttttaatttagtgaattagtggtagccttcagcgccttggctattcaagtatagatttttctgtaatggaaactgcctataatatcatgcagtgacgttttatgatgtgcactggtgttcttgggtgcaattattaccaacaggtgaacaattgttttttaaagaacattctagaagtttctagactgtagaattagtgccagccttacaatactctattccaaagtaggaggccgcctttagtttattaatttggtagtaatttgtaaattacaaacatgcttgtaattttgaattttgtttcaattctttttttttttaaacatggggtcttcgtctatggttcagggtggagtgcagtggcacgatcatagctaactgtagcctcgaacccctaggcttaatctattctcctgcctcagcctcccaaagcactgggattacaagcatgagccaccattcctggctcagtccttctaaaacagaattcaacttacttcctcttccataaacattaatattgaaatgttagcaattcaagattggccagttgtggtgcagatcatctagaattttgagtgattttgaaattatatttgattactggatgtcgtgtccaaaaagatgatgatctgtgaaggcctggaaagttagcctttttctccatgtcattttttcctaaagttgtgtagcttcacctttgtgattaccttttataataggaaaaaccagtgtttttcctattctcacacagtcaacacaacatttctgacaccagatgtttggggttttttcctatacatggagtaatcagttttccagtggacacgagctaggtgtcctgtaattcaggtctgatcctgtctacctggatttagcatcagatcccacaggtagagggctcagtcccacaagactgccccccacttcagaatgcagccataagccccaagttgtaacccgtgcttctgactggctaaaaatggccataaattggggttcccatgacctgctcatcatgttcagttaatttgctagagcagcttacagaactcagggaaacttatgttaaccagcttactagaaaggatattacaaaatatatagatgagcagtcagatgaargagatacataggaaaagttatgaggaagggggtgtggagtttccatgccctctctgggcatgcctccctgcagacacctgcacatgttcagcaacccagaagctctctgaccccatgcttttgggtttttatggaggcttcattacataggcatgattgattacatcattggccattggtgatcaactcaacctttagtcctttaccttcccagatgtcatggggtggggttggagagtggggctgaaagttccaaccctctaatcatgcctcagtctttctggtgacctgccccatcctgaagctattcaggggcccccagccaccagttatcttattaatatacaaaagatactcttatcacttcagagtttcccagagttttaggagctgtgtgccaggaaccaagggcaaagaccaaatatatatttcttactaaaatattacactgacattttgaaaattagattgaactatgaaaatctctatatttgaccatatttcacctatttaaaaatggcaattttgtaagcttcaatccagcattttctttacacttgacccttgacaacatgggcttgaactgcatgggtctacttatatacagatttttattcgggcaaacatggatagaaaatatagtattcacaggatgtgaaacccaccagttcagagaaccaacttttccattatgagggttctgcagggctgactgcaggacttgtatgcacaggctttgatatatgagggatgtcctggaactaatcccatgtgtatactgagggatgaactgtatttttatttgattctttctgtaagataaggcactcttttggtttagagtctccctttagtttcaggattcatgaatgggggtgagtaggagggtaggagtgagtaccaaagtatcaaaagattttagatctttaattagcaaataaaactttataatgagttgatagtctgcaatgctaatgattgctaatgattaagatgttatgtcatgtttctgtttatctttctaggtaaacagattttttatctatatattatatatagatctcataatttagaaattccagtttaaaattatattctgtgaatcatactgtgcttcaatagggtataaccatgttaaagaaacatttctttttctttttaagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggtatgagcatttattttagggggaaaaaaaaagtcgtacatttttgtaggtttttatgtttaaatatggtgataaaactcaaattataactttggtcagtgctcaaaattcaccacaaaaatggcataaacatttaaaactacttttaacttcttccctttcatttagcatagaaatttgctgaattcagtttgaatcatgatcctttagtgttggtgctgagagtgaaatctcttactggacgatagaaaagaggaaacttgattgagtcattgagtaacctagagtttgtagcttattcataatgttaatagtaattactactgagaatttactaacgcagtgaactgtgcatgttccgtgcaatgtctaatactaacgaaaaatgctttgagggcagatattactattcctaattcatagataaggaaactgattcagagtgaagtgacttgcataaggtcatagctaataagtgacaaagtttcaaacctaaacctgttgaatccaaaacccgggytctttctattgtatcaagcccctgaggtattgaaggaatcagattgattctttttcagaagatgggagtattaataagtaattatgttttataacataagcacagaagattttaatcactgaattgaatctcaggccaagtgctttgtttataataaactgctgttaaacaccagtgttgttggaaagttaccatgtaagtatacctgggccctgcattagtattttctaattcactccctggtgaattttatacctagagaagaacagactacgggttttgcttaaggctagagcctgaggcaggagagaagcaaaactagatggtagtttagcccatgctactgtttttagactgctacagtggtcagcatttccttgccagatgttataggcatatataaaagaggcagtccaaggttgctacctaacagtttttctaatagtttcttttgctatgctttctctacatcattttaaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaatcgtgtgtttaattttacatcaaccatatagcatatatttagcaatatgacagtctactgattttggctttgttagaatagagaataagtgcaaataattaaatcctatggctgtattaacaagggggccattgattataaaacttgaactcaggtccttttataaacattgttggtatttaactttacttcccattactgtggatctaaccaaataattatgtgttttgtgtccctaagtatgctctcattttttttggtctacacccattggaagcctttttaatgtgacatcttttagaggaattctgctggaataatttcatgttaacgaggctaaagctcaagtctcccaaattaagtggaatgttcattatcccaaggtgttcatagtcaaaagtcccagttgatagtgaagaaggccaggactgtaattgagcagtccttagcaccatttagcaaactaggtttacttactacataatatagctgcttattcacagcatatacagtgacaccttatctctgaaaaataatttccacggagccacttagaataaaaaaactattataactagaaaattgaaaaaaaaaaaagacagtccacagttacatcaaaatgtttattttttggatatagacatttaaaacattcatctccaagaacagcttcaatcaggtatacaataagaaatagactttaaatcctaatacagaaaaggtaacagaatttttttgaatgctgctgtagacactagtgttagaaaaaaaagtttataaatggttttgcaccaaaaaaatatgcaaagaaacttgaaaatagaaattgtttgccatttgttgctctggttgctgtttaatatagacccagtgactgattgtcttcagcacacatctaatttggccatttactgcatttggctaatgtgatccaaaatgtgatctagatagtgcttttcactggaggattgacaaacacgctacatacattagtgaatcttcataccacctcagtgaggtagcttagaaatattatacagaaattgaggcacaaagaggtaagtgacttgcccaaagttcccaacagcacagtccctggaagaggaggtaactctccacacaggactcatgtgccagaaagctggacagggacaccctcatgtagcatttagtaaatacttagataaagctgtagctgatcctttgagttttcagtaccctaaagtagtaggggaagtcttttgggcaactctcctacccttggctctcaactttcctactgttgttctcttatgaactccttcacctctttgaagactgtagcagccttcaatggggaccagacctctcacctttattctgatctgtcatctatttggtagttttgtttgtttgaggtgtgtccgttggacagacaatggtcaaaagcaacaggattgggaaggtgcctatcagggtagtaactgcttattttctctgatcagtttgttgaggtgtcacctctctcatgcttttccagataatacagaagcaaaaaggaattgcctttaagacaaattcatatttaaatcctaatgctccatacagtgttggtaaatgatttcaaggaatatgtgatcaatgttatttgacttgaaaaaattttctttcctagatgggggatttggagcaccaagggtaaaaggtgcctgccacaagaaaagctcaagagttgccaattatgctgtttacttcttctggtttaatagaaggaaaacacagtggtattaaaactggtcatgagcagcaaaaattcaggaattaaaaaatcagcactaaaaagactacagtataactggatagagaattctttaaaaagaaaggcatgaataaaatgggtattttaaattctttctcctgcgaggaatactttcaaaaagtacatagtaagactaagataccaagttgtatactaatatttttcaggccttgggcctcaaatatatatatttatatataatactccagtgtgaacagcaattcgatgaaatgtaaaatgtatctttttttttttaaatcacacacaagtattcataaccacagggttcaccagaaatctaaagcaaggagacactcactcatatagaaatggagttactcttccacagatcgttctgatcaaaggttttggaacagaaatgaattaatgatttttttgtataatatccaacatgtccactatcaaatacatttagtatgaaaaaacagatgaagaaaaggaacatacattaggacaaagtatctggttaaaatgctgttcatttaaataaagcccactctccttactttagagctccttggtgaaatggaggtgagtttgatggagtgcagttgatgaccactgaaaaacacgagccctttcaacaatgttgcaacactgttagtttttggtttaaacacacacacacactcacaaatgctaagtgtacactaccaaattctgcggtcagcttttccaagaactactggggaaagtttcaatgctgcaaatcctcgaggttgccctaacacccccaccttgtttccaaatgactcatttcacattttgttttgagcactggcagtatccctttacaatgcagaggtgcagtgtagcacaagtgctacatagctgtagttttcaaacaaaaccacttatatcattgtgcttaagtggagactgtagttacaatactgacattcgcttactggccttgtattctctgtaaacaaggaggctgtttgcaacaaccacttcaactctatttacagaagggttcccacggtatacacacaggcacaagggttggtatgctttctaaaagctgtgcatgtgccttggtctcttaaaaagacagtgcccaaagtggaacctatgtgcaaacaacaaattaacgacacagagtagctcaagcagccattttgctcccaagtcgtctgaagaactttgccagattaagccaggccccagagtgcttacatccacttgcatttcttcttttcatcaaataagacttttacatgcaagagttgtttctgagcttcttccagccctcgttctctttctagtttatttagaatctgttgacaattagaacagttattttagatattgtggttttagcgttacaattctgttttttgcatacctgatgctgtgagtggtaaaatctgtatgaaacagatgccaacattttcttccatcatttacatactcactttgcaagttgttttgctaagtccttatcacaggatcaacaataccttggcttaaaatagaagctcgcaagaaataccaactatttgcttacaaatatggggccaggcttcctaggccctgctttatgcattatgtcacagccattccaagcacagcaagcattcctgggcagccaacatgcaggcaagtatttctccttaaatgcagcaggcagggacatcctggtcagagacagatccttcccttccctcccatctgggcagtgtagtccctcctcgtgcttcccttctctcccctgacccctggaacgagggatgcttatcatgtttaagaactcattgcctctaccctaccttagagcttcacttcatcttcaagtagcaaatggaattggtgagctattctcaccattgacatggatagcctgtcccagcatgattgggggggaatcagggaagggggagttaacatttgtttggaaacaaagcatctgatgaatgtgtctgtttgaatttccaaagaaaaaaacccagattaaggagaattaatcataaaggagaatggtttattgaaatagtcgcttaagttagaaatatgtcataatttcatataacgattgaatacagaatctaggcaatttaacaagcttagctttcatttttagcaaattacaatcaagcataagctgaccccatttaatagggccactacttactcatcaaagttaacttgagtcagggtggctgtaggccccatgaactcaaatgtaaattcaggctggtccaaatgtgggcagcatgataaaactgtaaggggggcagccatgtacagggtctggctcagtgccaggatcccccatctcagacaggcttcctggcttccctttctggccttttgggatgccagagctgttctgaaactgacagaatgctataaccacatccttgtgcctgattcaaaggttaaaaacaatgttatttaaaatcttacctcatcaaaatattttacgatgtatttgtaaatttctgtcaaggccacttcttcattaaattcattttcatgtttctaaaagaaagacttgttgagagattctgaaatgacgtaaagtaaccaaatataagcttatttctgctttctaatgataccttagattcctgagttaaaaattcttccatttctgaggatgacaatggaggcaaatccctgattgctttgtaataagattttacttcttctttgtaggttgggatatccttggcatagagaagcttattagttggtgcttcctggggaaaaaaaaaaaaaaaaagcaaccatcaccaaaagagtaaaaaaaaaaaaaaaaaaagatggaggaatttataatattccaatgtagctgaacccccaccaccaaccagttttacctcttgctaacaaggcttcatgcagtaggccttaaatgttgttgactgaatgactgactgctatctagatagttctggtgagtcactgttattttcaggcagattaaatgctaatatattctgccttcctctcataaaagaactaaaattattatttttgcatgattttgagttactgtaacaatggaacttatttcaatcatagttcattactaatggttgtaaaaagcctgaattaaaacatttgctctcatcctcacccaccagtgaatttggcatttacaaaagacttgattgtaggtctgattgagccctttatataaccatgaaactggtaagtaattggcagaggcagattttccagcttgtcccttttatttcattagattatagacatcatccagtttcttcagggaagcacatggtcattagtattggtggctctgatgtgtgattttgcagaggttctctggcaatttgaatgattctacgtaattataacagtgatatttaaaaattaaatatgattttatttttaaaaatcattatttttcacaaaactttaaaaaattctactcagggaagataggtaagttaatgatagggctaatgtcccagcccatgaggctgaatcaatggcttgatgaatcattctgaaggatgcctagagactgagatattattgagattttctcatttgtcaaatttaagtggaacccagaaatcatgctatcattcattcattcaataaacattattaagcactggagcaggcattgagagtacaatgataaagactagtggctgcccttgagaagcttacaatctagttgcaaagacagatttatgaagtgcttactatgatacaaataattagcagcagtagttgacagaaagagttggacaaatcagaaatcataattctgctactttgtgtggtttcaggcaagacttgtaacctcccagaacatcaattttctcatctataaaatgagggtaataataactaccttatttggtacttgtgaggattaagtgaagtgtgtcaagaacataattcataaacaactgtttttagtgtgaacaaacatttaagtgcctttcagtgtgctgcatgctaagatgaactttattagtcaaatgaagaaagtgctgtaggaaatatattggggaaagttcacaaagtaggcatatgtagactgatctgagtctcctacagtttctggtcctcattaggaaatcatatttgtcgaatgaataaaatgtttatgatgaatgaatgggtaggattttactagacagagggactgtgagacaggaaagatgagcaaaggggtgtgagaacaagttcatgg

SEQ ID NO: 12589 - DNA, 36360 bp, Homo sapiens
ttttcagtctgtgtgagtctttataggcgacgtgtgtttcttgtaggcagcagatggttgggtcttgttttttttttatccattcagccactccgtcttttgattggagagtttagtctatttacattcaaagtttcttggttgtttttgaccaaactcacatactatcattcatcgatttgactgtgctgtaatttttttttttggagacagggtctcactttgatgcccaggctggagtgcagtggtgcaatcttggctcactgcaacctccgcctcctgggttcaagtgattctcatgcctcagccacccgagtagctgggattataggtgcgtgccaccacgcccagctaatctttgtatttttagtagagatggggttttgccacattgaccaggctggtctcaaactcctgacctcaagtgatccgcccacctcagcctcccaaagtactgggattacaggcatgagctactgcacctgcctatttacattcaaagttattattgataaagatttactcctgccattttgttatttgttttctcattgttttgtggtcttccctcctctttatctagaagagtttgtgttgaattggtgttatttattccttaagtggtagaattcaccgctgaaactacccgagccttgaatggtctctgtgggaacattttccccctacaaattccattttattgataatgtcaactgaaattaaggctgttgagacaaataattcgataaaggtttattggaagccaaatgtgaggatcaacccagaggaacacaccaacaaagttgagagtgttctggaatctaagtcagaaggtttctataggagaggctaggaggagggaaaggactcctcatactcatgtctaagtcagaaggcttctataggagaggctaggaggagggaaaggactcctcatactcatgttgtccttttctagtcagaaggtttctataggagaggctaagaggagggaaaggactcatactcatatctaagtcagaaggcttctacaggagaggctaggaggagagaaaggactcctcatactcatgttgtccttttctttggagggtacaacacagaggttacaagcattggctacagatgacaacatacaggtcaacacatctctgtgcaagacagtcagtaaacctttatgattcaggaataaatcagcatcttttcagtccattaatcagcacatcagcaatctgaggaaatcatgataagattctttactcagggaccattaatcataagaccttcccaagcaggccagtttggaagtctgtttacttttaaactgtcaaatgtgacctgtaaggttatcagatataaggctattcagagtatctatttcttcttgagtgaactttggtagtttgtgtcttttaaggaattggtcaatttcatctaggttgtcaaatttattggcataaagtcattcctaatacttccttattatcctttttatgtctgtagaatctgtggtagtggcatctctaatttctgctagtggtaatttttgtcttctttcttttttcccctaagtctggctagaggtttatcaatgtatggcctttttcctttgaagaacaggtttttggctggatcttacagagcccaggttggactagaaatcatttctagaacctatactagaatcatttctcttctataggatgtttcttctacctcatttttgccttggtggggggatgggagaaagagcttgattctttttttttttttttttcttgagatggagtctcgctctgtcgcccaggctggagtgcagtggtgcgatctcggctcactgcaacatccacctcccgggttcaagccattctcctgcctcagcctcctcagtagctgggattacaggcacccgccaccatgcctggctaatttttgtatttttagtagagatggggtttcaccatgtttgccaagctggtctcgaactcctgaccttgtgatccacccacctcggcttcccaaagtgctgggattacaggcatgagccaccgcacctggccaagagcttgattcttgatgagagaaatacattgatacagaaggaggagattacacctgctcttccacacccctcattggccctaacacacttctgtgcagtgtgttgacatacctcttctgcagtcttgaaaagtgattgggaaagaaatacactgaaaactacaaacatcactgaaaggaatgaaagaagacataaatgaccaggcacagtggctcacacctgtaatcccaacattttggaaggctgagatgggcagatctcttgagcccaggagttcaagaccagcctcagcaacagggcgaaaccccatctctaccaaccccccaccacccaagttagctggtcgtggtggtgcatgcctgtagttccagctattcaggaggctgaggtgggaggatcactcaagcccagaaggtagaggttgcagtgagctgagatcgtgccactgcactccagcttgggtgacagagcgagaccctttcttcaaaaaaacaaacaaacaaacaataaataaataaacagaaaaacaccttgtgttcacagattagaagactttatattgttcaaaaatcaataattttgatatggattacattggatctgcagattcatgcaatcccaatcagaatcctagtggcttctttacagaaattgacaagcagaaactgaaattcatatagaagtgtaaggaaccagaataagtaaaacgatcttgaaaaaggagaacattgagggactcatacttcccagtttcaaaattgactataaaacttacagttaacaagactgtggtactgccataacgatggacatacagatcaatgcaatggaatgggaaggtcagaaataaaactgtacatagatggttttcaacaagagtgccaagacaattcaggagggactgaatactgtctaacgcgtggtgctggaacaaagaggtatccacatgccaaggaatgaggctgggccttactccacaccacatacacaaattaactcaaaatggatcaaagacctaagaggtctcaaagagctgaggccagaaaacttgtagaaaagacataggggtaaatcttcgtgaccttggatttggcaatggattcttagagatcacatcaaaagcatgagcaaaagagagaaacagacaaattggacttcatcaaaagtaaaacaaaacaaaaaaacaaacttttgtgcttcaaaggacagtatcaaaaaaatgaaaagccaacccggagaatgggagaaaacatttgtaaattgtgcgtttgaaatgggactagtatgcagaatatttaagaactctgacaattcaacagtaagaagacaaacaatccaatgaaaaatcactacaggacctgaatagatatttctccaaagaagatacagtatataaatggccaataagcacgtgaaaagatgctcgaatcactagtcgttagtgaaatgcaaatgagatactgtttcccgtcctccaggaaaaagatggacaaggtcatgtgctgttacggactcggatgccatcagaggctgtcctggggaggggggttcggaagcaggttttgtgggagcattgcagtctcctaagtaatgttgaggaagtaattaaagtagaatgtcctgggccaggtgcggtggctcacgcctgtaatcccagcactatgggaggctgaggtgggcggatcacctgaggtcagcagttcgagaccagcctggccaacagggtgaaaccccagctctactaaaaatacaaaaacttggctgggtgtggtggcacgcggctgtagtcccactactctggaggctgaggcaggagaatcgcttgagccggggaggcggaggttgcggtgagtggagatggcgccactgcactccagcctggatgacagagtgagactctgtctaagaaaaaaaaaaaagtcctgccaacccagcggtccttttctcagaggtaggaaagaatgaagcagttttattgaataaacattaaagcagcctttgatgcccagaggttgccaagacagaagaactctcccccttcctcccagccaagccgaccggccctgttccacgggcgtcctcactggaggggacccgtcccaactcagacctccagggccgggttcctctgtcctcgcaggggccgacgctggggcagactcccgcgtgacaggggaccagtccccacccccgagattaaaaggtttacctcatcgcaaagggacagaagggagccgaggacagggggaagggaaggctggcttgccctttggcactttaagaagctccttttctttcagattctatttgccagacagtggggggtggcggcaggtgggaggaggggggtggaggagccgccccccacgtggccgagggcaccctcgagggcagtggatcctcgcgctcccctgaccttgtccccggccttccctcccccagagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcaggtgcgccccgtggggagggcgcggccaggagggtgcggggcgctcggtccgtccctgtgcggcccccagatcttggctcctggccgggcactgtccgcaggaggggaccccggggacccaggcgggcggggcagggatcggccctgggcctggaagtccccgtccgagggccccgagccccccacccccatccatgcgctgcgcccgcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgcatgtctgcctttacctctggctctttgagggcgtggagggcgcctcggccgctgctccgcctgcaggaagcgccgctcggtgctcaaggagggaagccaggaaggagccgcagccggcaggggccccctcttccccctccccccttcccctcccccgggcctccacgcccacccgctttcccgcccgggacggcgagtcctgtcccagtttgggtttccccgaatgccgagctggggcaaggacttggttctggcggatggttgcgcacccctgccggcaaaatggaaacgcagccccttgttcaaaagcgaagaattcgaaagggcaacagccgcgttacagtgaacccggaccttagggctgagcagtggcaacgcaggcgggagagcgccggggagccccgagaccgtgggggtgctgggggtgggcgagcacaggggagccccggagaccatgggggtgccgggggtgggcgagcgccggggagccccagagaccgtgggagtgttgggggtgggcgaggacaggggagccccgagaccgtgggggtgccgggggtgggcgagcgccggggagccccggagaccatgggggtgctgggggtggacgagcacaggggagccccggagaccatgtcaggtgcaccttgcaccatcccggagcggggagctggggagctgacccatcaattcccctccccctgggtcatctccctgccggaggccggaacagcgagaagacgggccctcagtgaattggcgggaccttggggctgaggagatacccagttccaaagtgccctggaacgaggggcatttaccgtgtctcaggggagtcttggctcatgctgcacaagccagcacgctcagcctggtcctcacactgtctcagcaatagtggcgaggatggcagggctgtcacacattaacagttcagagctcgatggagactgctggggaccccactctggctggtagctacaacattcagctcccaggtgcagatgggctggatcctggggtgcgggcccaacctcatgcccggcagacgaggggcccactggcctgagaagctctggctgggtgctgatttctggccttacctttgagggtggcctgtggccacaccggcagtgggctggctctgtggctgggtgctgatttctggccttacctttgagggtcgcctgtggccacgccggcactgggctggctctgtggctgggccaggagctttgggccccaggcctagggctgcagccacacagtctcggccaggtggtccatgcccccttcccctcggtgccagcgagtggatactttcagcaagcctgggataggaagggctgtgatgaaacgcaccaggatttatttcagttgggtgtggtgggatacagacacaggacccctgactttaaaggagagtgtgtcacaaagtactgcagacccagctacttaaaccacaggagggcacgtaccgtgccacacagggccgcccggggcggggcgccgtggcaacaggacgcagaaggcgagaggggagagcatggccagaggctctgtgggggtttccctgggaagagaggccagggagggtaggcacgaaggagcaagtttaggattggacaggttaatttccctgggctccgggctatggggtggtgtctagttgaccaccgtcctgccccagggtgattgagggcagaggaacatgggtttggtgagtgagtcagataaggggtggttgggtttacaggctccaggtgggttggcttgtgccttaaaggggagctctgtttgcaggcaccttttgctgtctctaggaattagccagtcctgggagggcagtctccacctagccagtaaggcccccgagaggtcaaagcattgtaaaccagaaaacaaaaaccatatgagttatacaggaacagtctggtgggcaggtggcattcagcccctgtgctctgggtctctagaagaatggggttctcagcctctggccatgggtcccccaaacagccttagtgtcttccaggctcttgggcttggcttggagtggcccctgggggctttggctggggcggtgcccatggctcaccctctgtccatatagtggggcccaagttgtccactgtgctgggctagcctgggggggccctgtggtcagaagctagacccccaccctggcagtgccaccccctaggcccctaagctgcaggtgcacgtggaactttctggagggctcccgtgcagagagggtgaagcccattcctgcactttttcttactgtactattaaaatgaggagaaatgggaacagggtgaggagggtggccctgaagtggctggcgtggccatgtctcctggggcagcacccgggccctgggcaccagctcttccatctgtagacgggagggcagtgagcttctaggggatgatttccacctcctgggacggaggtgggcaccggcccaagtgaactcggattctcctgcacacagcttccgtattcagtcatttacttatgggcccactatgtttgtctcatactctgggttagaaaagtgtatggcctgcctggccctggaatcagtagccctgggcctgtcactggggagagatggtggaaaccctggtgtgggcatagctgagattctttctcctgtaagtggggtcccttagggtccccgattcaggagctatttacagcacctgccagcatttctaatgtctcagtgctgcccctgagaaccagcgccggcgtcacaaccagccccattccccctcgtgttctcagctgtagccaagccctggtccagcagtagctgggtaggaaatgcatgcagctcctgccggggcctcccgccccaaccctctctcctgacaggcgatttgctgggctggaggacagggccaggtcttggccttggcaccgtcctgggtcacgagtgtatggttctggtcactctgctgtggtgcgaggatgaaggtgccagcccagtgtgggcaaccctcacagccagaatgttccagtgccccgcacctcgggaccctggatgtgtgcggctgccgtcacaaagtaccgcagacccagcagcttaaaccacagaaatttattctatcacagtcctgaaggcccagagtacaagatcaaagtgtctgcagattctgtttgtctgaggtctctctgcttggcttgcaggcggccgcctccctgctttgtcctcctggccttttctctgagtgcatccctggtgtctctccctcttctcaccgccctgtccatctccacatccaatccagtcggcggtgctgggggtaatccagtctgccatgctggaggtcaggccttcagcagatggtttctcgagggaatgcagtgcggccctcaacagaccccatcctcccctcctggcctccagacatggatccctgactccatcctccccttgaggctccacagagctctgaccccatcctcccctcctggtctccctccagacacagatccctgaccccatcccccactcccagcctccagacgtggagccctggctggggaactctgtgtgctcccagcctctgaaggtttctgggcttacctggctcctgtctcatcccagtccccctgagtagccacggaggtggggtccctaaggcccacatggttggggttccattaagaacttcaagtgggtggctcacgcctgtaatcccagcactttgggagaccgaggtgggtggatcatgaggtcaagagatcgagaccatcctggccaacatggtgaaaccccatctctactaaaaatacaaaaaattagctgggtgtggtagcgggtgcctgtagtcccagctactctggaggctgaggcaggagaatggcgtgaacccgggaggcagagcttgcagtgagccaagatcgcaccactgcactccagcctgggcgacagagcgagactctgtctcaaaaaaaaaaaaaaaaaaaaaaaaaaagaacttcaagtggggctgggctcagtggctcacacttgtaattccagcactttgggaggccgaggcaggaggatcgcttgagcccaggagtttgagaccagcctgggcaacgtggtgagacctcatgtgtatttgtctgataaagacatacgcaagactgggtaatttttaaagaaaaagcagtttaatggactcaacagttccacaatcatggtggaaggtgaaagaggagcaaagtcacgtcttacaagagggtgtgtgcaggggaactgccctttataaaaccatcggatctcgtgagaccattcactatcacaaaaacagcaccggaaaaagccgcccccgtgattcagtgacctcccaccgggtccctcccatgacgtgggaactatgggctctacaattcaagatgagatttaggtggggacacagccaaaccatatcaccatgtctaccaaaaatggaaaagttagccagtgtagtggtgtgtgcctgtggcccagatgctcaggaggctaaggtgaaaggacctcttgagcctggggaccaaggctgcaggaagccatgattgtgccgctgcactccagcctggctgacagagtgagactttgtctcaaaaaaaaaaaaaagagaaaatgataaaagcactgcaagtgggcagcggctgaacgtggagacaggagttctcccttctgagcacggccctggtgccgctgacttcgtggggagcctgtagtcaggggagcagcagctggggagagctggggtctcagctgccttcccccatatcgcacatgcccgtctcgtgtgtatctgcactctcacacgcgtgttcccctgccctgcgctcacatgtatctgcactcactctcacatgcttgcttcccctgccccatgctcacgtgtacctgcactctcacacgtgtgctcccctaccccacactcacatgtatcctcgctcactctcacacgtgttcccctgtcctgtgctcacatgtatccacgctctcacacatgtgctcccctgccttgtgctcacgtgtatctgcactctcacgtgttcccctgccctgccctcacgtgtatcctcactcactctcacacgcgtgctcccctgcactctcctgtctgagctgagctgacctcagttgggtgctgcgagccagggcctcatgctggcctctcgccctccacagccccaggggtccaggctcctccaggaacaaacgcaggccccacgggctgcctggaaggcctcccagaaggcagcacagggtcacgagggtcacccgcagkggcacagggaggcctcgtcacgacaggattccagccaggctsgcctgatgctmctgggggtcctcggcacatgccccttcaccctggcatgtgcttcttttccgggaacccayactctggctgagtggagccatcccctctgggtcaacagcacccggggtggctctgcagcaccccactccgcggctgcacagggaccttggccccactgctccttgtgccttgctggttaatgagaagccggtggggaggtgctgccggtgagcgtataaaggccctggcggcggctgcggagcactggccctgtccttccatctgcycagagaggagcatctggatcaaggtgctggccatgtcccagctggtggaatgcgtccccaacttttcggaggggaagaaccaggaggtgaggcccgargagctggtcaagcatctagggctgatggggcagcttgagtggctaaggcccaggccatggaggaggtggtgggcttggtgtcccrggtcgtcttcccaggatgggcagagccgctgcccrtgggccccaaggacrtcccgtggctcagggccctggggagtgcctgacccaggggtgggtggaacacgactggtgcttgtgggggctgaggcttggctgtggcttcaggggcctttcgggtgctttcggtggggggttgggcagatctctgggcctcaaagggccttggtgctcccccctgaaaatggggctcctgccactgactgaaagggctgtgtgaggycacacgaggtggcccagcatggtccccactgccgcctctccatctccactggagttagcttgctgagcycccaccctgcagccaccatcctcactggacccaaaacgaagtaggcacagagggggcagcaggcccccaggtccggcctctcgccttccacagccctgaggtccaggctcctccgggaacaaacgcaggccctaagggccacctggaaggcctcccagagsgcagcaccaggccacaggggtcacccgcaggggtgcagggaggcctcgtcatgccgggattccagccagcaccaaggccctgggacagggcaagatttggggctgagcccctgctcccagcagtcctgccacccggaaggttctaggcccttcaggcccctcccccatgctggtgatctgtccctcccctgctcgggggtgggggtcccggcccctctgtgacctgcgcctgtggtcaccttcttggatccccggccacgtctctggcatctgtctgtcggagcagagcccgtgagtctctcctggaggcaccacctgcagccccttgtggggacygtgcttgggcctggagtgactgtggctgctgtgagggttcccgggcggccgctgtgtgcgggcactttcggtgggagctcagcttgtcggagagcccccaaaggcttggcccgcctcctcagcccccatttgtgtctcrgggtgcagccacctccaagctccttttccttctttcaaacggggagactgaggtgtgggggccgggcctgtgtcccaggtgatcgacgccatctctggagccatcacacagaccccgggctgcgtgctgctggatgtggacgcaggcccttccaccaaccgcacygtgtacaccttcgtggggccgccggagtgcgtggtggagggggccctcaacgctgcccgggtagcttccygacttatcgacatgagcaggcaccaaggtgaggtctctgggctctcctgtggctgccgtgtctcagaatgtcagggccgagccctgtcctggtgtcctgggagagggggtaggcccggggcccaggcttggaacgtggggtccagtggggctggctctggctctcctaggaggaccctggagtgtgggggtcatggcccccakcctgcctgcagggctgtgctctgggggacccccaggtcgccaygctcccacagcaccgggccaccttcacggctgggtggggggagggggccacgccggggaaggtttgtgggccccgtccacctgcccactcgtcaagggggctgagagccagtcttggagcaggcactggtgggggaagggctgcctgraagctgacctgtcaacagcccacaagccaaacacctcggtgggcaggcagggccaaaggtgtgtggacacacgggcgctggccaggggctgggctgtgggccgctcatgagaggccagggatccacagtgatcctgaggggtggayggatgagaagcttatctctaagtggccagccctgggcggtggcggcaaaggcgggggaggctggcgtcccctggggtgggygccgacccacggcttggtgtagccacagcgagggactcagctagtgagaagaatgctctggaaacgcagagtggattctcggcttcaggggagggggttggggtggccggaacccagcctcgagcgccccctcttggcctggccggggctgcctgagagctgagctttgcacccctttcaaagttatttttgtgagtgttaggagagggacaggtttatcccagagatgccagaccacccgctcaggtgctgctgctcctgggctgaaggacctcccccacactggctgggaggacggtgcgggaacttccgttgtcccgggagggctggtgctgccgctggggcagggctgggagcgcccagggccggcctcctccccgtgggtcagtgtgagcagcttgctgggtgtgtggactgggggctgcccaggccggagaggacagagggtccgagaaccccgtggagctcccacccgctcccacacctggcctcctgcccggcctcgcygtctctctgcaggagagcacccccgcatgggggccctagacgtctgccccttcatccccgtgaggggcgtcagcrtggatgagtgtgtgctctgcgcccaggcctttggccagaggctggcagaggagctggacgtgccaggtgagcgtgcccccccgcccccctcacyctgctcccgtctcattggtgtgggttattggctccttctgtatcccccagttccctgcccttgactgctcttgcaagggcagagtgttccaaaaagccaacatgcagaagcgcagctccctcaataccgaaataaacgcagcctcgcctgcggccgtgcaggcccggggcctcctcagactacaccgcagagcagctgcacaggcaaaccaagagccttaaagtccacgccttctagagcagaataatttcactttgggaaattaactaaatcaagaaaatgatatgaaacaaacagagacaaacgggacaaagtgcatacccacccctaggctgcaccaacccagcgctcctggaaagaaatcccgaggcagggacgtaggtcacagtcacgccagcgtgcagggcacacgtaacccccgtcacggtcacgccggcatgcagggcacacgtaacccccgtcacggtcatgccagtccccccgaaggaaatcccgacgcagggcccacgtcacagtcacactggtgtgcgggttcacgagtttttcctyttctctgccgttatatttatgtggttgcttgcggttctgtttatcatacaaagaaaacagaagcatgaacgtcctgccgttagcatgtcccacatgttccatcctaaccctgcaattcgccttttcagggccctctgaggagggggtgggcaggggtgctggcccacactgagggtccactgggaccacccgcatccatccaaggcggagaacgggcactccccaggagagggtgcagtagaggcccattcctgggttaggctggagggagcccctccacctgcgtcctccaggaactgagtcctggaccccctgccggtccaggcctgaccgccgggctctcctgcagtttacctgtacggcraggcagccaggatggacagtcgccggaccctgccrgccatccgggccggggagtacgaggccctccctaagaaggtgcccccaccccgggcggtcgggcctgggaaggaggtggacctgcccctttgtcctggctggggtggctgggccgggcccctccttcccgggaccccggggggctgttccctcccgtgggggatgtctcaccccagagcgaacttgctcacagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccaggtgaccccgttcactgaccccatggagccccacccagcccctcgggaaagggttagaggctgagagcctcaggcggggaggtcggtggggatggggcaccggccggacagggttcggcctcccacctgcagaccggcccagcctccgcgtccacaccgtgcggggaccgcgcaggtcggcaggtcaggggcggagtgaagctggggagctctggcctcctggggattttccagggaacgaggcaggacttccctttgttaacatgtggcagcatttccatactgctgggaaacagcgacttccggagtcccaggtgccctcaggggccccccatatccctccagatgccttgggagccccgacacccctacaaaccttcaggtgcccccaggcctttccctccacgtctgcacagcagtggtcacccggtctgagcgtcactccgggtatagatacccggagaaagcgggggggaccacctgcccatctgttccccactcagagaccccggtcccacaaacagccaaggtcctgggacccggcttcccgacctgcagactcagcacaaaagcacagggacctctaagtcctgctttaggccccggccaagggcagaggtcagagtccccccacgtggactcagtcaccccgacaagtgcggggctgaggggacttgtcgggagcggagcagatgggatgggagaacggcatgggggtgcctggggccccacccctcagcattcccccaacatctaggacacagcgtggctggaaggcagggcctaggctgggcgggggcctgccggggtgggcctccggygtctgacccttggggcctccgtttccctgtggcaagcgaagtttctctggccctccccggccagctcagtgagggacggaggagaaccacagcacccacscaggcacaggctcctccccgtccagctggggaatgcaagtgccaggagagactggcagggccaggcaggatgagcttcctagtccaggctggggaacgctcttcctttgcagccaggacgtctgaagaaagttcagggcattggctggtacctggatgagaagaacctggctcaggtgtccaccaatcttctggactttgaggtcacggcactgcacacggtctacgaggagacctgccgagaagcacaggtgagcccgggagcagccgctgctgctgtgaggggygagccgatctgtcccgtgggcagggcgggggccccacatcctccagccagggccattctccagccagcccccagggggtracgctgcctgtgccttggcaggagctgagcctcccagtggtgggctcacagctggtgggcctggtgcccctgaaggctctgctggatgcggccgccttctactgcgagaaggagaacctcttcatcctggaggaggagcagcggatcaggctggtgggccgggctgccgaggaagggtcggacaggggcgtgcagggagggtggggaggcggtggcggagctcacagccctggggcgcagcttccctccccctcctcccccttcattttattgacttgtgttcagaagatgagatttcactttttattttggacaccttattgaggtttttttgtgacctatgatatgctcagctgtgcaaattccacggagaggacaccccaccctttctgcttggtcttgcctcctgggccggccatgctcccgtggaggggcctgtgcctcctctcaccacctccatcggggcgtcctgcacccctggaactggcagctcatggatgtgtgtgcctttagctatgggacttagatccccatccacggagcggctccttcagaaagtgattccttttgtcttgtggacacctgggcctcaaggcttctggagtctgggttccaccggggcctcaggtcctgctggggtgtggcagcgtctgcagagccgctgtccgccttggtctgtcctttcactcgaggtcactgcagagccgctgtccgccttggtctgtcctttcactcaaggtcactttgttttaggtgtgtttttcgcaataagcacaatccacttaactggattttttggggacgttttgtctgtttgtgtttttactgatttagctctcgtgacttgtggattccgtccttgtttagtctcgggcatattttcttctattagatcgctgacccagttatttagttctctagctgtaggaccccgtgatgctgcagcagctttgatgtcttctctgcctccgtctttactttctcttccactcctttcctctggattcacagtggttttccaaaacccagcctcaatcattggtgcgtttgtggccttgtctgttgtattcttggctgttaacaaaattttttgtgactttacattttgtataatttcttacagagaagatacaggtggccctccactcctgcctcccacccatattttccaagtgcttgcattttgccccatttatttgtgtataatcatattatatttttttccggactatttaaaagttgggttgaagacattgtactcttttacccctaatttattaaggctgtgtttcttaagaacagggacattctcttacataaccacagtgtaattatcaaaatcaggaaattcaacactgatacaatcctagtatctaataatcctcaggccataatcaaattgcttcagtgtcccagtgattcccatcatagcgatttctcctccaatccgtgatccagttcacgtaacacagagcactgagccaaccttttctcctttcttccaactgttcctgtcttccttgtccttcattgaccttgacatagtttcaaaggacagacttttaaaagcgcctcagtggggactagtctgatgttgcttgtggccagatgtagttgtgcatttttattttaatttaatttgttacttcttttgagacagggtcttgctctgtcacccaggctggagtgcagtggcacaatcacagctcactgcagccccaaactccagggctcaggtgatcttcccacctcagcctctcaaagtgctgggattacaggcaaggaccactatgtagtcctggctaattttgtacagatggggttttgctctattgcccaggctggtctcaaactcctggactcaagcaatccactcacgtcagcctcctaaaagtgttgggacgacaggtgtgcaccaacacgcccagccagttacgcatttttggcaggaaaagcatagatggtattgtgtcctcctcagagacgccgactccccatgatgctcattttctcagggtgccgacgtggacccgtcacttgccaaggcgacccccttcctcctggacccttcactgcaatgttactatttttccttttgcaattaatacgttgtggggagtacttgaaggtgtttaaagtattgagtaggtaaatacctgtttattactgaaattccagagttttaggagccagtgacagcattccaacgtcatcctttctgtctaagcagcagctgtcgcttctccacatttccttgtcttcttatgtgtgaggccccgtctgctttccagtgtggcgttttgtcttcttcttttttttttttttttttgagatggagyctcactttgtcacccaggccggagtgcagtggtgtgatctcggctcactgcaacctccacctcccggattgaagcagttctctgcctcagcctctcgagtagctgggattacaggcgtgtgccaccgcacttggctaatttttgtattttttttttttagtagagacggggtttcaccatcttggccaggctggtcttgaactcctgacctcgtgatccgtccgcctcagcctcccaaagcactgggattacaggcgtgagccaccgtgactggctggggttttgtcttctttacctgaagggccccatgcctgcggcctgcacaggtctggctgtgcccgtggctgcgtgctgcctccttgtggtgaggctgctttgctttgtgttgtgtgatttttgattgccagtgcatgctctgtggaattttatctatggtaattcttggacacctgggttcaaagttttctcctccaaggagggtttgtgctggcgcttgtggacactgcctcacaggaccccctgaagctgagtttttggcttggagttctggaaccacacaagagtgaattcggtgtcgggtgaggcctgcagccctgtcagggtggcttgtgattaggaattcccaggagatttttttttttttcctgcttcacccaaagggaaggcagggactgggaagtacctcaactgtttcctctggcgggtggctgtttctaattcatccttgggggtgtcaccttccaggggtctccagtcggaccccactctgaaggccccagacctcccccactcatcaggggctgccagagaggggcagttgcccccagggcagacccagctccaggctggcaggcctttccggactcgtctttctggtcgtgtctggtttcgaatgatgtcctgtctgctagcttagccaggcctttaaaatgcccggcatcttcctggggttttctgcggaaggaggctttgccttgtggcttgctggttctatgccacggggaggcactctccacccygcccggctgctgtccgtctctgtggggtggggtgggggtcgcatagccaacgtgttctgaatgggtttcccagaatgaattctaatcttaaatgggactgtcacaactttattttgaatttaggtaaaactcacttttgtggcatacaagtttatgtgtgggtgacttggggctgttcctcagcttttgaggacttgttagatgtgaagacttggtgaattaaaatctttcccgcccgtcagcgatggggcagtggtgctggggggcggcgaagcatgagcagcagtttgctgaggggtccccagggggcaactcctttctctgggcctcaggttccccaagggcamctcagggtgayggctgtttccagaagcctgtacggggtgcctgctggggcggggcccacagggctcctggcggggcagmggtggggggtgccagccacgcccctgccctgctccccgcaaaagcacctgtgtgctyggggcagggggcggctgccgcaagggtgggacccgcgggttccgaggctttcctggtggtggagacgcgccgaggccgtttccactccaagccccttttccaggtggtgagccggctgggcctggactccctgtgccccttcagccctaaggagcggatcatcgagtgagcctctgccctcccgccctcttctcacccctcccgggctctgcctctcgggccttgcggggcgctggggtccctgcgtggagacccggctgagtcctcccagcgcctccctttgggcgcctactcggcctgcgccaagcmggggtctgggggctgaggggggcacagagaccccggccgggtccccgcaggttctcagccgagtggtcacctccccgtgggtgcagacgggcgtggggcctggggccgccccgggaggactgcgctccccccaccaaccccggccagacccgctgagccgcgcccaccctgcaggtacctggtccctgagcgcgggcctgagcgaggcctgggcagcaagtccctgcgcgccttcgtgggggaggtgggtgcccgctctgcggcccccgggggcggctcggtggcggcggccgctgcggccatggtgagcgcggggggaggggcaggggaggcgcagttgttggggggagggcggggagggggaagggcgctgttggggggagggcacggggtggggagggcgcggtggggccgccctgggtggagacgtgggggccacacgggtgggacccccgcagggatcacccgggcccctggctcttcctggggtcggtcccgggccgtctggggtccctgcgacccccacatccacccctctcgcagggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggtgagtggcggccacagcagggctccccgggccccaccaacagcgaacccccagctggggccccagtgagaagcgggtcagcctccggctggggaggggctggggaccaggaggggcctgagggcgtcaccactggccgctgtctggaccttgaccaccagcaccgccctcaccccggcaagtgcttgggcccagcagggtttgagggttcggccagggtgaccccacattcacaggccatggcagccggtacaagggaacaggcccctcccagcaggggagccaggagcccaggcttgggggaccccacagacctggagcaaggcagggcccttctttagaagcctgcaattccaggaaaggaggcctgcaagaatctcaggaacacagtgatgagtgctctcaggcaggccagagasgacccgtttcagccacagcataagacagaaacaccatcttcagataacacccactcaggcaggcagtgaccccacctccctccaaacgggacaggaacatgagcatcagctggcaggatgtgcccacagatgggtgctgggtgctcagagcctagggcaggggccagagagcctgggaaagggcagtgacaaggtcaggatgctcccaagcagttccagcccaggagaggacaggagggaagggcagaaaagagagagagagggaggggagagagaagagagggagagtggggagagaggcagatggcggagagagagagggagggagggatggggagggagggagggggaggagagggagagggggagagagggagggggagagacagagagagagggagagggagggagagagggagggagacagagggaggaggggggagagagggagggggaaaaggggagagagggagagggggagagagggagggagaggggaggagggaaaggggagggagagggggagaggggggagagaggggagagagggagagggggaaagaggggagggagggaggggggagagaggtaggtggagagagagggagggagagagagggagagaggggagagaggtgtaggggccagccctacagggtctgtgggtttttctccccgtgtgtagagatgagagattatagaaataaagacacaagacaaagagaagaaaagacagctgggcccgggggaccactaccactaagacacggagaccggtagtggccctgaatgcctggctgcgctgttatttattggatacaaagcaaaagaggcagggtaaagagtgtgagtcatctttaatgattgataaggtcacgtgagtcacatgtccaccgcacaggggccccttccctgttaggtagctgaggcagagagagagaggacagctcacatcattttttttaatcctctttttagaaagattaaagactaatacttttactaagtttgctactgttatctagagggcggagccaggtgtacagagtggaacataaaagtgaaacaggagcatgagctctaaagcacagcatcacagggagacgattaggcctcgggataactgcgggtgggccctttacaagaggtggtggaccagagtcttcttcaaactcccctggagaaagggagactgccttttccgatctgctaagtagcggatgcttttctttggcactgacactaccatagaccatgctccgcttggtaacgggcgccttcccagacgctggccttaccgctagaccaaggagccctctagtggccctgcccaggcctgacaaagagctcacactcgttttttggtcactttttagcgtgccccttcaactcctatctgtgtatggcctggtttttcctaggttatgattgcagagcaaagattattataatgttaaagagtaattgctacaaactaatgattaataattatatataatcatatctatgatctatatctagtacaactcttgttattttatatattttattgtactaaaacagctcgtgccctcggtctcttgcctgggcacctggctggcttgccgcccacaagagggagatggggagggggggtagggagagagggaggggagtggggagagagggaggtggggagagagacagggagggacagagtgggagggagggagagagaaacatgtgccccagcctctggagcagggcggtgggggcgcctgtgtttctgggagggccacaagacccccagccctaagttgggaagtctaccttacaaggctgggtgagaaaggcaggccccaaatgcacgtggaatccacacacaggcacagagggagccaagatgagggcctcggataaacagtcccggatttgcagagggagtcgcctgagggtcccgttctggtcctgtggagaggtgaagctggctgggcttctgggtctggtggggacttggagaacttttctgtctagctaaaggtttgtaaacacaccagtcagcactgtgtctagctactggggtgggaacttggagaacttctctgtctagctaaagtattgtaaaaacgcaccagtcagtgstctgtgtctagctaaaggtttgtaaaygcaccaatcagcactctttaaaaacggaccaatcagcactctgtaaaatggaccaatcagcactctgtaaagtggaccaatcagcaggatgtgggcrgggccaaataagggcataaaagctggccaccgaarccagcaagcgccaaccgtggcgggttctgttccaagctgtgggggctttgttcttttgctcttcgaactaaatcttgctgctgcttactctttgggccttcgctacctttacgacctgtaacactcactgccaaggtgtgtagcttcactcctcaagtcagcgagaccaccaacccaccgggaggagctaacagctgtgctacgcgccacctgtragagctgtaacactcgctgcgaaggtcggcggcctcacggggaggaagaaacagctcccgacgcgccacctgtaagagcttaacgctcactgtgaaggtcggcggcctcacggggaggaagaaacagctcccgacgcgccacctgtaagagcttatggctcactgtgaaggtckgcggcctcacsgggaggaagaaacagctcccgacgcgccacctgtaagagctcactgagaaggtctccggcttcactcctgaagtcaggcaagaccacgaacccgccagaaggaagaaactccggacgtatctgaacatcagaaggaaccaattccggacacactgtttgcagggaggtgtagacgctgatcaccgtttccagtcattttaaaaattcaggttttatttatttactttttacagtagataggcccttcgggggttcaccccgccttcgccacagcccgcccagtgctcgcctctcttgctgcctcagagctccgcctttccttcccctcgcacacagccccgcccgctcccagcctggccccttgggttttccactgggggaagcacccccctccccgggggggcccagggcacccaacacctgcttgcagaaccctgctttctgggatgcgcttctcattaccgggcaggttaagcatgttccgtacatttagcagtggtttttacttcttttccaggaagttatctggtgaatattttttgactccttttatcttagtttctcttggggctttcgctgccttctagtattttttttttttaataggggaggcaggccttgttctgggctcagctttccccgtttgttgttcgtctttggactttgcgtgtggggcttctgacaatgactcttaatctttatgtcgtggaatgtgtcaatcctgactttatattttttgggtcttgtatcacagttcaaatggcctccccagaacaagatgatcttttctatactttaatgggttgatgaactttagacccggacaggcatttgaagacagtcatgaatttaagtataaatattagaaataggccaggcatgatagctcacacctgtaatcctagcattttggaaaaccaaggtgggcaaatcccttgagctcaggtgtttgaaaccagcctagaccacacaccaagaccctgtatttacccacccaaaaagaaaaaaaaaaaataaagccaggcgtggtagcaggtacctgtggtcccagctactcaggaggcttaagtgggggtagcttgaggccaggagtttgaggctgcagtgagtcgtgattgcaccactgcactctagcctgggcaacagaacgacaccctgtctctaatgtaaacatatgtatataaaacatargaacaattttatgtttagaaatttaaaataaggtgmataattaaaaaacaagtaggaaaagtacatagatgaaaatgtaatcaagggacaggaargaaacaagacgtgtggtttagagaaccatgagcggggacagtgagactgtgctaggcatcagtggtcgaaatcagtggattggtttacgctccctgtgagccacgtgaaggtggacggggagtgctggattggtttacgctccctgtgagcaatgtgaaggcagacggggagtgctggattggtttacgctccctgtgagcaatgtgaaggctgacggggagtgctggattggtttacgctccctgtgagccacgtgaaggtggacggggagtgctgggttggtttacgctccctgtgagcaatgtgaaggcagacggggagtgctggattggtttacactccctgtgagccacgtgaaggtggacgaggagtgctgggttggtttacactccctgtgagccacgtgaaggtggacgggggagtgctggattggtttacactccctgtgagccacgtgaaggtggacggggagtgctgggttggtttacactccctctgagcaatgcgaaggtggacggggagggctgggttgatttacattccctgcgaacaatgtgaaggtggacgaggagtgctgggttggtttacactccctgtgagccacgcgaaggtggacggggagtgctggattggtttacactccctgtgagccacgtgaaggtggacggggagtgctggattggtttacactccctgtgagccacgtgaaggtggacgggggagtgctgggttggtttacactccctctgagcaatgcgaaggtggacggggagggctgggttgatttacattccctgtgaacaatgtgaaggtggatggggagtgctgcattggtttacgcaccctgtgaggcacgtgaaggtggacggggagtgctgggttggtgtacactccctgtgagcaatgtgaaggtggacggggagtgctggattggtttatgctccctctgagcaatgcaaaggtcgacttttgaaaaacataaggagatatctgtaccttgcaccaaatacataagtaatttccagatggaatagaaaactgtatttccccaycaccaacacaaccaagcctcacgataaatcacagaaaacaaaacggaccgggcgggcaggcctcggccggacgcagatgaggccacctaaagcacacccttggccaagatctgcccagggagaccatggacaccgcaaggcctgggtgtgagagagtgttcgtagcgcgagtcgcagcttgaggatggctgtcctkcctccgcctgcaactgctacagacccttgtgcagaggacagcctgggagaggggctgcagccaggaggcctggtctggatgatgccccagccagtcagggagacactgggcatttctgttcctcgatcactgctgtcggaatggtcaaaggatccagatctggctggcgcccagggagcatttgctctcatccatggtcgagggtaggggctgttgatgatgactttctggtggagagttggctgaatcttccaagatgaagtgagcatattccccactgagaaccccttggccagggctctggccacagtccgtgtgagtagggctcccagtgggtccttggaaggttggtgtgtggtcccagctrtgctcttccacacggggtgggtccgaggagccgagtgccttacggtgacgccgtgagctacacacatgagcacctaggaaaggccagtgcctgtgaccggggcagggacatgaggggctttgaggtttgctcttggtccttctgcacagtctgagcctcttatgcccaggcttgggggcggtgcagctgcttgtgttggagacacaggcccagagccactcctgcctacaggttctgagggctcaggggacctcctgggccctcaggctctttagctgagaataagggccctgagggaactacctgcttctcacatccccgggtctctgaccatctgctgtgtgccccgaccccccctaccctgctcctccaccaagcctgatgcyaagggctataaaccactggcccaacagaagcttggttcccagagaactggtccctgcctgggacatgctccttgctacagccccttgtgggagctcagagggcatggctgctccccctacggtccctcgcccagtggttctgtctctttatggcaggaagcaatgaggctccccaagaacacacctgaggaaaaggacaggtgagcctggagggccggccgcaccgtgggcctctgtgtctggggagttggtggccaggatcccgagtacctgggtgctgtgacggggcgtggttggcctgggcgtgctgggtgtttgggaatgacttcccatcgcccgcttctgcagcctgctcagccctgttggggtgcagtgtgtccactgcctgcctgtgtgtgccgcygygcycaggctctcctcttgctcctttcaggcgcacggyggccctacaggagggtctgaggcgggcagtctctgtgccgctgacgctggyggagacggtggcctcgctgtggccggcsctgcaggaactggcccrgtgtgggaacctggcctgccggtcagacctccaggtaggggggcccgggggaccccaggcctcctgccgcaaagcaggaagcagctgttggggctgagttgctggagagcacggtggttggctgggctgagccaggtagggagacctcacttcacgggcagttcccggggctttggcctcctccaacagggccggggtgtccgctgccttctaagatctcgctcacggcggcaccacagacggagacccaaatgtgtctgcagagcccaccctgaccactgtataagtgtatactcccccaagaccccttgtatcacccccactgtcttgttctagaaaacacctatgtcagcccaggcacaatggttctcgcctgtggtcccagcactttgggaggctgaggcgggaggatcacttgaatagaggaggtcgagaccagcctgggcaacatagtgggaccctggctgtacaatagatacatatgagccaggcacggtggtgcctgtggtcccagctacttgggaggctgaggcaggagaattgcttgagcacaggaggtcaaggctgcagtgagcygtgatcacaccactgcgctccagccttggtgacagagcaagaccctgggtcaaaaacaacaaaacacgagaaagcacacaaggcagctcttggaagtagatgcctcacactgacrggccacagctgggcagagggtcccagagaaggagcgtctctctcatgggctcagcactttctgcagctgccctaagacctcatggtcttcgggttctttataggaaagacgcctcttttcagcatctggtcccagagaagtgtcccctcagtccctgggaagtgtccctgggcagtgggcgggccgttagcctgaagctgcctccgggggccctccaggggatgactgtctctagaactgtggtcctggttcctagagtggcggagagcctccagtgtgactgctcccaggcytcctgtggggctgagccctgcttggataagagaaagttttgttttctaagctcartggtggggcttagccctctgtggggcgaaagcgggggctgcgctgggctccttgtgaggaggaggacgaagtccggcctgtcccagagcccgtcaggcagagaccctccttccggcagtttgctcagccttgatccatgtaggggctccctggggtccttgcaggtggcggccaaagccytggagatgggygtgtttggcgcatatttcaacgtgctcatcaacctgagggacatcacagacgaggcatttaaggaccaggtgagcaggaggcaggtgtggtgcccggaccccaygtgggggcctggattcacagcctcagggtgattgccgactggcygtgggcagtgggggtcggaggttgctgcccagcaagctgggctgaagactggaactaccagacccctctttccctgtgtccatcagatccaccatcgtgtttccagcctcctgcaggaagccaagacccaggctgcactggtgctggactgcttggagacccggcaggagtgacggtgcgggaggcctctcygggctctgtggcccctccctcgcccatccccagagggcagagctgtgacctcggtggggacacagcttgttcrtgtggggcccggaggrtaggtgggcaggcagcggggcatcgcctgggaatggaggcgctggcagggacagaaggcccctagtcccatgtgacctccagtaaagttttggcaccaaacctgtgttgtgtgttggcggttttgggggcagggctgagagctgagctgcgggtcttggggcaggagcaggacatatggtcagtggcccatgggagccagggttggagggaatggggttgcagcgtgaggagacagacctcagcgccagggtccccagacacccagtgcagcccacagtgggcagggtcacaggtattcagaggacctggggttcagtgcaggtccctgggctgtgaggccccttgtctgagggaaaggggccctggttctgtgcatgggacagaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcactatactctcaaattacttctagatggactattacatgtgacagatgatgtatgaatgtatttgttagtcagcactgcaggatattaaaaagaagattactgtgtccttgagtgaagcagaaaactcaaatgccttattggagagatttcccattctgaaaatagaacatacttgttcatgaaaaaagatgtcatcatccaagacaaatgacaagaatcctacagggagaaaaaacacccaaggtgtgtgtgggtacagggccatcatcactcagcatgaaaggttcctacatatccggccggcagggggtgacagggagggggtgccggggaggggagactgggagggaatgctgggagggaatgctgggaggggaggctgggagggaacgctggggaggggaggctggggaggggaggctgggagggaacgctggggaggggaggctgggaggggaggctgggagggaacgctggggaggggaggctgggagggaatgctggggaggggaggctgggaggggagtctgggaggggagactggggaggggactcaggagggaaggctgggaggggacattggtgaggggacattggtgttggggatggtgaggggacatttgtgaggggacattggtgttgggacggtgagggggcattggtgttgggaccatgaggggacattgtgaggggacattggtgttaggaccgtgagggaacatttgtgtggggacattggtgttgggacaatgaaggggacatttgtgaggggacactggtgttgggaccatgaggggacattggtgttaggaccatgaggggacatttgtgaggggacattgatgttaggaccgtgagggaggagacatttgtgaggggacattggtgttgggaccatgaggggacatttgaggggacattggtgttgggaccatgaggggacatttgtgagggatgctggtgaggggatgctggtgtggtgtaattggtgaagggccaatggtgagcggcagttgctgggtggagctgtgggtagagcctgtaggtagctggaagtcccttccagtgggactgacgttcctgccctgcagggtccgaggctgcacacgtgggagctggcacgagagaggggagcgccctctccctgcagaggccctgggcagctcctgtgtagctcctgtgggtggagcctgtgcacctgcaggggcctctgcctccctccacctgcgggacccgcggtgttcacctggagcacagagatctgagggctgacactcagggcgcaggggcttagcaaaacaggcgggcctcttctgcatctcctgctggcatttgcgtagtttttttgtgggatgggaaaaggaggaaaggaagagaaaataactgacgtactcccctggagctgcaggctgtgtggtcagatgacagagcggtggagtatgaagaaaagagtgagtcttttcaaaggacaacaaagtttcagggtatccagagtgaactgcatttccccagtttcacatgttgactcctgaccctgaccctcaccctaaacctgaccctcaccctcaccctcaccctcaccctgaccctaaacctgaccctcaccctgaccctcaccctgaccctaaacctgaccctcaccctgaccctcaccctgaccctgaccctgaccctaaacctgaccctcaccctaaacctgaccctcaccctcaccctgaccctaaacctgaccctcaccctgaccctaaacctgaccctcaccctgaccctaaacctgaccctcaccctgaccctaaacctgaccctcaccctgaccctaaacctgaccctcaccctgaccctgaccctgaccctaaacctgaccctgaccctaaacctgaccctgaccctgaccctgaccctaaatctgaccctgactcctgacccctacccccaaccccaaccccaaccccaaccccaacccctaaccctaagccccagacctctggatgtgaccttgtttggaaatggggtccttgcagatgcagtgagctcaggtgagatcatcctggagcagggtgagcttggtccagtgtgacttgggtgaggttatcttggaataggctgagtcctggtccagtgtgactccagtgaggtcatcctagagcaggctgagccttggtccactgtgactctggtgagctcatcctagaataggctgagccctggtccagtgtgactcgggtgagctcatcccggaataggctgagccctggtccagtgtgactcgggtgagctcatcccggaataggctgagccctggtccagtgtgactcgggtgagctcatcctagaataggctgagccctggtccagtgtgactcgggtgagctcatcccggaataggctgagccctggtccagtgtgactcgggtgagcttatcccaggataggctgatctctggtccagtgtctcgggtaagctcaccttagagcaggctgagcctggtccagtgtgacttaggtgaggtattctagagcaggctgagccccagtccagtgtggtgacttgtatccttatccaggagatcaggaaccctgggatgctggggagaggccggggcaggcccttctctagtcctcctctagccctccagaggaagcatggcccggctgatgcctccaggcctgtggccgatactggtagttgttcaagctgtgtctgtggtgccctgtgatggccaccaagcccactcctgtcaggtcagcacctgcctgtggagcctctggttcactgtggggctcctgagctgagcctgaaggaccctggggtctgaacagcaaaaactcactgagatctccacacagaacacaacaggctcagcacctgctgtctccccgtctagtgttaatcatgcgtccacccacagaagaccctcagccatggtgacacttcttagagcactttgggcctggctggggctggagggagagtttgctgatcaaggctgtggggtctgcacaggcggggtcagccagcacctgcagttgatgtcctaggaggtcagggctgggcccgggggagccattgaccctggtgggcgagcgacagctgcagtgtttccctcctggccacaagacacctttgaggtctctcctgcgcacagaagctcgcaagcaggcacgcaatgggttcaaagcctttattgggtcagggcttgctccagagctcaggggccaggtaggtcaggagccttgggatggctgcagggggagggaggccgggcagcctgcggagggcctggggagacctggggctgggcgggggccggggctacggggaccccgtgggaggagctggagaggtgcaggcccagggcgtcgtccgagtgagcagcggtgctggccgtgtgggacccgggcccgcttagcaccatggacggggtgggctcacgaccctcgactgcggggcccgggcggcggcgctagcagatccagcggatgaagcggtcgaagaagccgggttgcgccaggctgtcatagtccttctcgtggaacacggcggcgcggtcacccaggctgagcgtggtgagcacgtccatgtccacgtcgctgcccaaggccagcacggtgggtaccacgttctgcttgcgcatggagtgcgccgactcgtgcagactgtcgttgcccgtgacgccgtccgtgaggaacacgaaggacagctctgcgtgcctccgggccccgccacgcgggctgcgcacgatggcattgatggcgtgcaccacgcctgcgcccacgtgcgagaaggagttcaggtattgtgtggtctccagcgcctcgtggatggccgtgaggttgtggctcagcgggaaggccacctgctgctcgccggggccaccaaactgcagcagcgccacgcgtgcgttgagagggtcgtcgtccctccgggccagcgtcagccgccgcgccacctgctccacgaagcgccgggccttgtggaagttctgctcacccagccgctcggagccgtccagcaggaagacgatgtccacgggccgctgcgtgcactgtgccacggacagctctgtggggagacgcaggtgcgggctgggcggaggagaggtgggcaggaccgggcaggtgccagccccgcacctgtgcccttccattcgcaccctgcctgcaacctcacagaccactgggctctgcgggggcgtttctgcagggcagccctgggtgtgggtccttagcccaagacactttcaggcggcactgctgggagccgccatctcctctgctggtgctcccaggcctgagaccctgacacaggccccaggccctgtccacctgctgagcaccatccctgcacaggctgccctcctgggagggaaggggcccaaagcatcctttcatggctcaagaatttgctgcccacaaaagggccactgtctgtgtagtgtgggaggtacttaaggaggaccctggctctgacacccccagcctgacccctcaatcgctgggtcccagagctgctcagaacacctagagctggctgggccacgtccctcccggaaagaccaggagcccctgactcttctgattggccatggtggggagcagtgggcacaggggcagccagaccttctgtggcagcccaggtgggttctgccctatgactctgttaccaagtggggcccccacctgcctgggtggtcaccagccctgggcatcggggacagcttgggggcctggccatagccacaacccaggccaggctgcctaccacacgtgtgggtgtcacgtggggccagagaccacaggacaggacacggacagtccttgcgtggacctggccctgtggcctcaccaagacctcagctcctgggatgggggaggggagggacagagccagtttccccaagggtgtctgcttctcagcccaacccctggacgtcgtcacagctggtacatggacccccaggaatgcacacagaggaccctgacccgaaactcggtttctgggggccctggaggtgcaacggtccagccccgcaggcagtgagcaaagctctgaacacagcagggtgacctcacgctgcaccgcagccttcacagaacgcttgagacatggacgccgtctgagcacgcacgagctggcagatggggttccctcagtgagcttatgagtgacgcagctcattcagtgaaaggaagggcagcctccctgttaaggccacacctaggaaccggcttaaatgtccagaaactcctcaggtaccgctgggcttcccaaaccccctcaaaactaataacattttcactgctgtcaccaaacatatggagacagacatgcaaggggcagctggttttgggggtctctgtccattcatcagtgtctgtggggcctggaggagacggggaagctgtgggggccggccaggcacagggaggctgaggctgttgggatgtctgtggactctgctctcctcctcctgtggaggatccttcatccccacagtgggaagaccagcctggcctgccctgtgcagtgggtgtggggacgagaacctggccctgagaaatggtcacagccgtgcccggcaggagcccagcctggatgagggctcctgcagtcagaacgtcggggtcagctcgccgtgggggccgctccctttggatggtgatccctgccgctccccaacattgtggaccctgggattctctgctcagtcctctgaggaccgcagaggttgtgcctggtggatgctcccccgactgtgcttttggagacccagaggttgggctggaagggtgcagacaccccgggatcagggctgctggcaggcagctgtggccattcgccctactgtgcatgacaccagcccagatacgtcatggtgccaggactgccagcttcccccaggactatctgctgcccaaccggaagccttcacctgccaccaggtgggccgtgagcgcccacgagtcaccatgcacgggattagtgcccacacccagcgag

SEQ ID NO: 12590 - DNA, 21069 bp, Homo sapiens
  misc_feature (1)...(21069): n = A,T,C or G, or insertion/deletion polymorphism (see Tables 1-2)
cctgcaccgggtgtgggcagctgggcggtgggcacaccaccgggtcacagatcaccgttcgtctctgcagagaggagcagaggcattgacgggagtgtccaggccccttgctccagatcccaggacccagtgtgcccttccaggacctcctacctggcaggtgcagagtgagcagagcgggtcgtagttgggcgcccagcgagccccgtgggggcgctgctgcccctcgaagaagcatgtgttggggtctcggggccgcccaggaccaccaggtttggcgggcgctagggccgggagaccaggcaccacaggcggcgcagcagaggctgtatccggagcccccagcgcccgcaccccctcggccccggccgcctccaggcgcagtccgccaacctcacattggttggctatgtgcacctgggaggagaggccaactgaggcagcgctggggctccccctcgcgtctttaccagcggcagctggccagccagcaggagacacctcggccccctgagcgctgcagtggcccaggaggatgccattcgctccacaatcatctcagctgccagggatagggtgccgggctgccagcctcctcatgtagctcatcctccccaccagccgggggggcgctgtgatacgaccacccccaggactcagagacagcaagtgactagtgcaatggcacacagtgcccctccaactctgcaccctccccactgcccccactgcccacactcgccacctacctgccctcggagctcccctctggggctacccttggtggtgatcatcagggaggccatgccttttgccaggtgccgcagcagttccggctccaggtccttcaccacaccctgggcctgcacatagacaggacaatggataggaataaggcactttagggctgagcctactgtccccagttcacagatgaagaaactgagagccagggaggttaaataaagtcttcatggtagcaaagcccattggcaatagtgtggagcttggaagccaggtctctctgaccaagtccatgagaactcaccccacttgaagggcttagtccatcccacctacccccctgaggtccaggatattacatactatccaagacaccccaccaaaaaaagacttagaaaggagaatgaataataaaaagccagtcagagtcatgcccaggtctatctgactcccaagcccatgccagctctttttttttttttttttttttttttttgagacggatttttgctctttctgtccaggctggagtgcaatggcgccatctcggctcactgcaacctccacctcccaggttcaagcgattctcctgcctcagcctctggagtagctgggattataggcatgtgccaccacgcccagctaattttgtatttttagtagagatggggtttctccatgttggtcaggctagtcttgagcttcctacctcaggtgatccacccacctggcctcccaaagtgctgggattacaggcttgagccactgcacccagcctacaaatcactgtttaatttattttatttatgccagctcttctataccaggctgcctgctctctgctttccccaacacaggcccacacagcccttcaagctaaaaaacagaaatgttccaagctgccgcctaccatcacatccttacctctgagccatagaatcccttcagcagccgccgaggccctggcgttccaggaggcccaaggaggtgggcagtgacagtgccttgttctgagccaccaagcccagccagcagcacttcatagtgcaggtgacagtgggtatccaaggaaagccaggcgtgccctgctgcttggctcttcacagggggtagcaccagggctcctgctaggggcacgggcagcgctgggtccagacagaggagagatgacaggtgagaaggtggcctagggcaagccctcaaacccagcattcccagctccccagcacacattccacgagctggaagacactgtccataggtccagggcctggagagcagcaagttttagacccttgaacctcagcaacaggaagagtccgccagcagggccaccctatatgtccccaccttcagatggcaaccggagcttaggcacaaagaaagacacaccaggctccggctgtctgccaccatccctcaaatgttctaggaaaccaaagggcagacagacccctaaggacactcactgtcatggcgggcgctatgcccacagtagggcagggcagccacgtgcccccgaagctctccgtctgggaagtccttggtgcccacgttcaggaagagctcattctgcagcagcatatgagcccctcgggcacccagcccagggcagatacccacggcctgggggcaggggaggataggccttctcagctctcacacgagtccaaggttctgaagtcttggaccattttgtgcccccactccacccacacacacttccacacaccagaaacacaggataaggacctggcaggcccagtttcaaggccctcccctgctgcttcctagctatgtaacaaccttcaagagtaacttaacttctccaagtcttcacttcctcatctctcaaatggatactgtgaaagccaaaaactatgtaaggccaccaatgcagcacctagcacatggaaaggccctataagtagcaaccattgccattacatttactaatatgtggcctgtggcactgttctccaggtccaatgctcccatttgactgtgagcttgctaagcacaggggccacatatgatttgctttgtactctagtccctagtctggggctcactaaaaatgtcaaatcatgccgggcacggtggctctcgcctgtaatcccagcactttgggaggccgaagtgggcggaccatgaggtcaagagatcaagaccatcctggccaacacggtgaaaccccgtctctactaaaaatacagaaattagctgggtgtggtggtgcacacctgtggtcccagctacttgggaggctgaggcaggagaatcgcttgaacccaggaggcagaggttgcagtaagccaagatcacaccactgcactccagcctggtgacagagccagactccatctcaaaaaaaaaaaaaaaaaaaagtcaaatgaataaatgaatgagtgggagaacccatgagtgagtggatgataatgaacatccctgctcatccaacctggcttcccacagcccatgcattgggccctggggtccagctccacctggagccctcaccgtgtgtcctcctggctggagtccagccatgtggcacaggacagtgcgctgatccctccgctgaggcttggtctccagtgtcatggccaccacctcactgcttgtccctaccacttgcacctgatgggcagggatggaggagggcaaagtggagaggcagtaaaggcctggggcctgctgcccacgccacccctcccccaccttctgcagcccctggctcttacctgatagatcagggagccatttcctagcagcgtgaggctggctgagccggcagcacccgtctggactgggatcagggcatcagccccacaaaggacactttgcaggactacggaggggcaagacaggtgaggctaggtttaccccatggccgcttacacccccagtccacaggatctctcccacacccaccctggcacttgtctgtgtctctcagttgtgcatgcccggcgcaccaggccccccccccgcctcaccgtcgcagctcttcctggcagcaatgtgtccactgatgcgcagccctggcctgcctgcccactccagggccatctgcagctcccccagcaccagccagtccatctcctggactgtcaggttgggcagcacctcagcaaagcctggttcctggggacagagcagggtgtgatgggcaatagcaagaggccaagacaggtggcagcgagagccagatccccactcacctgggctgagacattggcctgaagttctcgcagtagctgcccctggtgtagaatctggagcctcaagggaacctgggttagtcctgcaaggccgcacatgtgggcctttctgagacaggtgctctccctaaccttctcacgtgttttgcccccatcccacttacccccactcctgggttccagcagccctcggaagagcagcaaaaaatgcaaggagtcctctgtgtcactgagagtgagcagggtgatgccccctacgccctgctgtggggggccttctagagtcaggatggcactgaaggtctctggggaagggacgatgatgagagcccgtcagaaaccctccccccctttcctgggtgatagagaagactcagaacttcacgcccggggctctttgctccctacctgcagccagggcccggtgccggatgagaggcccccagacctcccctgaagggtgagtgagtgtcacaagtgccacatgcagctgttctgccctaaggagccgcagagacaaccgaggcactgcccgccacaccccacagacctggagcagagagacaagaaggccctacgctcagacactgtgcaggctaggccaattaggatgcccaggcagggcttatgaaaaaggaacatggaaaggaacctccagggtgccctaggaagcttaagaaagaacgctggagccagatgcttgggttccaatcctggctgcaccacttactagctgtgtgaccttgaacaaatcacattatcctactgagcctcagttcccccttctgtaaaatgggcatcataatgtcagtgccttcctcccactgggctgtggtgaggaccacgggaggcaatgcagagcatgctctcggcacagtgcccagactgggcaagtgctcataaatggcatcatctcaccaggccatcttgggtgggggctgcagggtgctcaaacaggacactgccattggagtctgagaagcggatcctggtagggcggtccagcctgggaatgagaggtcgggtgaggccggactgagccaaaagcagcccctcccagctctcccagtttccctcccgggccccggcagctgacccctccttgctccttcccctttctcaccgcctgtaggagatagagaagcggaggctagagcgcagcagcgagactcgggctcgtgccaccgcctgcgacctcggccctgtcagcagcgccacgaagtctgggacgggaggaagatggcctgagcactgtcaaacgccgctttggtggcccagcctcaaccacaaccccgctgttcgccagccccctacccgtgtggccgtcaccacgggcccgctcctcagcgcctggctccccgcggtcgctataactgcgatgctccgggtcccgcggatactcgaaggacaggccgctcggctgccgctccgaactgctgcgctctgcgggcgggggggtaagaacacgggcttcagctggccatgggaaaggccagtccgacgccccatccaagtggcccgggacctagtatcgtggccctgcctccctccccgcagggcggagcaagacttaccctgggggcaggtctggcagcagtgtcccggcagctggcgcggctgcccacaggccggggttgggcactctggtttgatgttcttgcagctgaccctgccagggcccctggtacggcgaccccactgaggctgctcccggaaaaggcgggaaacccaagtgagtgcaagatgccaactgatgagacccccccaggcaaggatgtcccgcagagtcagccagctctgccacttacaagctgcgtgaccctagacaagctacttcatctctctgggcctcaaggtccctgtctggaaaatggggataataatactctctatctagcaaggctgccatgagagttagatgagcagggaacgaaacggagttggcacagagcctcacacagagtgggcgatcagtaacagcacctaagaattggaggggctgattccccttcctccaccagaaaaatatccccaacatctgccgactgggctccttctcagcagctccgagtccactccracgcccgcgcgacccggcgctccccacccgccagggcccgggccggccgcggggtgcactcaccgcctcgcaggcgcacagcacgcagcgcatcaccccgaatggctcccctaggtccgggtgccacgtctcgtccaaggcatagaccttcccgccgaaggtgcagcctgcggggacgggcttggctggaggccgctgcccagctcgcgccgtgtgccgccccgggggctgcccgcgggtcccgggtcccaggcaccgcgcccttctgcccccgcccaccctccgggccgcccgccgcgccgagccacctgcgccccgcgccccctccgggctggcgctgactcgccccgagcccgactccccgcccgcgcctcccccgggcgcccacctacctgccgctccccgaacgggcagcggctccttctcagaacggatgggcagcacggggggctckgggccggcgccgcgggccggccgggagccgagcagcagcagcccgaggagcagcagcggggccggcggggccgggaggctcggcatgacgcgaacgggacagctggggaggagggagggaggagggcgcgggagcgggcggagggagggaggcgggagtgcggagggcggagggccgggccgggggcggtgcggcgggagggggccggggccggggccggggccggggcagtgccgcgaggggctcgtcgggcggccgcagagtcggcgccggcccgggcggggcgggaggagcggccgggaggagcgcgggcgggcctcaaatgcgcgtcagtttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgggaccgggcaggggaggagggaggggcgggaggggaagggggagcgggggagggggaggggagggaccagggggcgcgaagagggggaggagaggcgggcccggagccccccgctgctggcggccacagggcggctggaccaggaggtcggtgtccagcccaggaagggagcctcaggctagggaggggcagaggctaggcctgaggcctggaccgctctgtgagcgaggacccggttccgcccgaaggatgaagacttgtctttaaagatgacaacgtacaggaaaggtccatcagccgatctccccctgcctgggcccacagcgccccccaaaccctcaccaccctctctcactgcctagcctgcctccctaccttctctctgaggtcgctcctcattcttgtgttacccaggacagggacctagccagaaaccggcagcattcccccttctgtggagtgacagtatctccctctcattgtaacttatcctcaggcgcattcgacagtcccctcttgctttctcacccccttccttcacccaagggaccctctgcctctccagcccactcccagcctccyttctcttggttccctggtcatgcctgcctccctgtctcctgtctctccctcccacacacacccactatcctcccagctatcccagcaccctccttcctaatcttgggagacatctcgtctggctggacgggaaaattccaggatctaggccacacttctcagcagacatgcccatccttggggaggaggaacaggagagagcctgaggaagttctgggggacagggggatgatgggatcaaggtcaggccaggaagcccctgaggacagagactgtggggagactgggactgggaagaaagcaaaggagctagagccagggccaaaggaaaaggggggccagcagggaggtatttgcgggggaggtccagcagctgtctttcctaagacagggacacatgggcctggttattcctcttgtcacatgtggaacggtaggagatggaagacggagacagaacaagcaaaggagggccctgggcacagaggtctgtgtgtgtagccatcyaagccactggaccccagcagacgagcacctaagctcaggcttaacccagtgcacgtgtgcgcacatacatgtgccccgcacctgacagtccactcaacccgtccaaaccctttccccataacaccaacccataacaggagatttctctcatgtgggcaatatccgtgttcccacttcgaaagggggaatgacaagataggactccctaggggattacagaaagaaaagcaggaaagcaagcatcctgttggatttcagcagcaggtatgatgtccagggaaaagaaatttggatagccagggagtgaaaaccccaccaatcttaaacaagacctctgtgcttcttccccagcaacacaaatgtcctgccagattcctcctggaaaaaaacttctgctcctgtccccctccaggtcccaggttgcccatgtccaggaaaagatggatccccctatccaaatcttctccgtggtgtgtgtgggtggaggagtggaccctggtccaggcaggggctccagggaagagaaggcgtcacttccgggggccttcaccagtgtctggtggctcccttctctgattgggcagaagtggcccaggcaggcgtatgacctgctgctgtggaggggctgtgccccaccgccacatgtcttcctacccatctgctccccagagggctgcctgctgtgcacttgggtcctggagcccttctccacccggtgagtggccagcagggtgtggggttatgtgagggtagaaaggacagcaaagagaaatgggctcccagctgggggaggggcaggcaaactggaacctacaggcactgacctttgtcgagaagagtgtagccttcccagaatgggaggagcagggcagagcaggggtagggggtggggtgctggtttctgagggactgatcacttacttggtggaatacagcacagccctggctggccctaaggaaaggggacatgagcccagggagaaaataagagagggagctgcacttagggcttagcaaacacagtagtaagatggacacagccccaatccccattcttagctggtcattcctcgttagcttaaggttctgaatctggtgctggggaagctgggccaggcaagccagggcgcaaggagagggtaatgggaggagggcccactcatgttgacagacctacaggaaatcccaatattgaatcaggtgcaagcctctttgcacaacttgtgaaaggaggaggaagccatgtggggggtcctgtgaaggaaccggaaggggttctgccaagggggcagggaggcaggtgtgagctatgagacagatatgttagtgggcgcctaagacaaggtaagcccctaaggtgggcatcacccagcaggtgcccgttcctgggcagctggtctcaggaaggaagtcccagaactgttagcccatctcttggcctcagataatggagtatttcaggacttggagtccaragaaaagctccagtggctttatgtgtgggggtagatagggaaagaatagaggttaatttctcccataccgccttttaatcctgacctctagtggtcccagttacagctttgtgcagttcccctccccagccccactccccaccgcagaagttacccctcaacatattgcgcccgtttgccagttcctcacccaggccctgcatcccattttccactctcttctccaggctgaagccacaatactttccttctctatccccatcccagattttctctgacctaacaaccaaggttgctcagaatttaaggctaattaagatatgtgtgtatacatatcatgtcctgctgctctcagcaggggtaggtggcaccaaatccatgtccgattcactgaggagtcctgacaaaaaggagacaccatatgctttcttgctttctttctttctttctttctttcttttttttttttgagacggagtttcactcttattgcccaggctggagtgcaatggtgcgatctcggctcaccacaacctccgcctcccaggtacaagcgattctcctgtctcagcctcccaagtagcttggattacaggcatgaaccaccacaccctgctagtttttttgtatttcgtagagccggggtttcaccatgttagtgaggctggtggcgaactcctgacctcaggtgatccacccgccttggactcccaaagtgctgggattacaggcatgagccactgcacccggcacaccatatgctttcatcacaagaaaatgtgagagaattcagggctttggcagttccaggctggtcagcatctcaagccctccccagcatctgttcaccctgccaggcagtctcttcctagaaacttggttaaatgttcactcttcttgctactttcaggatagattcytcacccttggcccgcctttgccccaccctactctgcccagaagtgcaagagcctaagccgcctccatggccccaggaaggattcaggggagaggccccaaacagggagccacgccagccagacaccccggccagaatggagctgactggtgagaacacacctgaggggctagggccatatggaaacatgacagaaggggagagagaaaggagacacgcygcagggggcaggaagctgggggaacccattctcccaaaaataaggggtctgaggggtggattccctgggtttcaggtctgggtcctgaatgggaattcctggaataccagctgacaatgatttcctcctcatctttcaacctcacctctcctcatctaagaattgctcctcgtggtcatgcttctcctaactgcaaggctaacgctgtccagcccggctcctcctgcttgtgacctccgagtcctcagtaaactgcttcgtgactcccatgtccttcacagcagactggtgagaactcccaacattatcccctttatccgcgtaactggtaagacacccatactcccaggaagacaccatcacttcctctaactccttgacccaatgactattcttcccatattgtccccacctactgatcacactctctgacaagrattattcttcacaatacagcccgcatttaaaagctctcgtctagagatagtactcatggaggactagcctgcttattaggctaccatagctctctctatttcagctcccttctccccccaccaatctttttcaacagagccagtgcccagaggttcaccctttgcctacacctgtcctgctgcctgctgtggactttagcttgggagaatggaaaacccagatggtaagaaagccatccctaaccttggcttccctaagtcctgtcttcagtttcccactgcttcccatggattctccaacattcttgagctttttaaaaatatctcaccttcagcttggccaccctaacccaatctacattcacctatgatgatagcctgtggataagatgatggcttgcaggtccaatatgtgaatagatttgmagctgaacaccatgaaaagctggagagaaatcgctcatggccatgcctttgacctattccygttcagtcttcttaaattggcatgaagaagcaagactcatatgtcatccacagatgacacaaagctgggaagtaccactaaaataacaaaagactgaatcaagattcaaatcactgaaagactaggtcaaaaacaaggtgaaacaacagagatataaacttctacatgtgggccgggggctcacgcctgtaatcccagcactttgggaggccgaggcaggcagatcacctgagggcaggagtttgagagcagcctggccaacatggcgaaaccccgtctctactaagaatacaaaattagccgggcatggtagtgcatgcctgtaatcccagctacttggaaggctgaagcaggagaatcccttgaacccaggaggtggaggttgtagtgagctgagatcatgccaatgcactccagcctgggtgacaagagcaaaactccgtctcaaaaagaaaaaaaaattctacatgtgtaaattaatgagtaaagtcctattccagctttcaggccacaatgccctgcttccatcatttaagcctctggccctagcacttcctacgaaaaggatctgagagaattaaattgcccccaaacttaccatgtaacattactgaagctgctattcttaaagctagtaattcttgtctgtttgatgtttagcatccccattgtggaaatgctcgtacagaactctattccgagtggactacacttaaatatactggcctgaacaccggacatccccctgaagacatatgctaatttattaagagggaccatattaaactaacatgtgtctagaaagcagcagcctgaacagaaagagactagaagcatgttttatgggcaatagtttaaaaaactaaaatctatcctcaagaaccctagcgtcccttcttccttcaggactgagtcagggaagaagggcagttcckatgggtcccttctagtcctttcttttcatccttatgatcattatggtagagtctcatacctacatttagtttatttattattattatttgagacggagtctcactctatcccccaggctggagtgcagtggcatgatctcaactcactgcaacctcagcctcccggattcaagcgattctcctgcctcagtctcccaagtagctgggattacaggtgcccaccaccatgcccagctaatttttgtatttttggtagagatggggtttcaccatgttggccaggctgatcttgaactcctgacctcaggtgatccacctgcctcagcctcccaaagtgctgggattacaggcgtgagccactgcacccagccttcattcagtttaaaaatcaaatgatcctaaggttttgcagcagaaagagtaaatttgcagcactagaaccaagaggtaaaagctgtaacagggcagatttcagcaacgtaagaaaaaaggagctcttctcactgaaaccaagtgtaagaccaggctggactagaggacacgggagtttttgaagcagaggctgatgaccagctgtcgggagactgtgaaggaattcctgccctgggtgggaccttggtcctgtccagttctcagcctgwatgattcactctgctggctactcctaaggctccccacccgcttttagtgtgccctttgaggcagtgcgcttctctcttccatctctttctcaggaggagaccaaggcacaggacattctgggagcagtgacccttctgctggagggagtgatggcagcacggggacaactgggacccacttgcctctcatccctcctggggcagctttctgracaggtccgtctcctccttggggccctgcagagcctccttggaacccaggtaagtccccagtcaagggatctgtagaaactgttcttttctgactcagtcccmctagaagacctgagggaagaagggctcttccagggagctcaagggcmgaagagctgatctactaagagtgctccctgccagccacaatgcctgggtactggcatcctgtctttcctacttagacaagggaggcctgagatctggccctggtgtttggcctcaggaccatcctctgccctcagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaacwactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacrcccactcccagaatctgtctcaggaagggtaaggttctcagacactgccgacatcagcattgtctcrtgtacagctcccttccctgcaggrcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgawtaagctttctctcagaaatgctgtccctatacactagacaaaactgagcctgtataaggaataaatgggagcgccgaaaagctccctaaaaagcaagggaaagatgttcttcgagggtggcaatagatccccctcaccctgccaccccaaacaaaaaagctaacaggaagccttggagagcctcacaccccaggtaaggctgtgtagacagttcagtaaagacaggacctggatgtgacagctgagcaaacagctagagctttggcagctcagcaggaggctttgccaggcatggacgcctgcctccctcctgtggaggtcaggaggaagtgcaggaagtggcatgagtcaggctccttgagctcacacagcaggagaacaagtacaagtcaagtacaagttgaaggctcatttcccagttcccgcaaatgcatctaaaaagcagctctgtgtgaccaccataaactctgctaggggatctctaaaaaggagtcaggcttatggggctttgcaaataagtgctgccttggtgctcaggaaaaggtttgtgttgcacaaaaacacaaattccactgcaaaaatcaacctgctacctccagaggttcctgtaggaaaactagtggaagcttcttcctctccccgacccctgaggaaggaaaggctaccacggaggtagaggagccaggaacccagaaacccaaacactgccacaaataccccagggtcaccaaaggcattccaaagcagcagaatgaaaggcaatgtgctaggaacctcgtgtactttaccttttgtaacattcacacaactctgtaaggtaggtattatcttttctgttttagagatgaggaaactgaggctcagagaagccaggtgagttatcagtggttacacgccctgtgggcaggagaagaaacaccctagtctgacctcactctagggtccatactctctccagtgtggtacactgtcctatatgtcatttaatgattctgtttactgggaaagacatacaagtccttaaggagtaacagttagagttttgaggccgggcgcggtggctcacgcctgtaatcccagcactttgggaggccaaggcaggcggatcacaaggtcaggagatcaaggccatcctggccaacacggtgaaaccctgcctttactaaaaatatgaaaaattagccgagtgtggtggcaagcgcctgtagtcttgaacccgggagatggaggttgcagtgagccaagatcgcgccactgcactccagcctgggcaacagagtgagactccatctcaaaaaaaaaaaagagttctgagtagaaaaccaaagttcttagtggaggtgaccaatttagacatcttcccatgtccctctctcccttcacggacagaatagttttcctagagaaggaatcaacaaatgcacaaagctcaaaaatgttgtccaaatctcaaatgctgtcagtttctgcatggaagagaagtagttcattcatactacaaattccagcatgcagtcaagggaatgttaagtggaaactaacttactgacatattgagctgggttaaatttaataatcaaatgaaacactttatagcacatgaaagtgccagcacctaggacacgatacaccaatagaaccagagaatgatgggttcccagcacagacagatgagagacaagaatggcaaaactttagggccaggtatggtggctcacacccagcactttgggaggccgaggcaggcggatcacctgaggtcgggagttcgagaccagcctgaccaacatggagaaactccatctctactaaaaaatacaaaattagctgggcatggtggtgcatcacctgaggttgggagtttgagactggcctgaccaacatggagaaacctcgtctctactaaaaatacaaaattagctgagcatggtggcacatgcctgtaatcccagctactcggaaggctggggcaggagaatcgcttgaacccgggaggcagaagttgtggtgagccgagatcgcgccattgcactccagcctggacaacaagagcgaaactccatttcaaaaaaaagaaaaaaagaaatagaatgtcaaaactgcaaatgtcaccagaaacttccaggcatctggtattggtatgtgacttactccacttgtgggcaaatgcgagtaactcatgggcttctccagtgtgaacttacctgccctattacaaatctaacccattcccaaatcagtctggttggtcccatcccttcttcccactaacacaaaaaaacaattacaaccagaacactcctatccctattcaatgctctaccagttctctttcttctgctaccccaagaccgccaggacagtctatgataacctacacactattacttgtaattcgtttgtctcactctcatttgtcgttctccaaccccacaaaaaaacccaccccatggaaaggttctaggatttcataaaaattcatcccaactccctccccctactctacccatagtaaggtaaaagaaacacctcttcctcctccctgctgaggccattcattttcaacccatttccctaaatactatttctaacacctcacatgaagatccgaaaatgatggggaaggaaataccccaggtatcccagcaggggaccagctcccaggcaaaaccagatcaaacagacaactgtttaatgcacagagaatctttttggattgttaccctaaacttcctaggggaaaacagaaccccatatgctttcctagagacctctaatgccaagctgaagagccagctcacatgctggagcccttatcatagccatttccttaatgttttttcttcccctactcataagttagtgactgtagtcaggccgctacatggtcctggcactggccctggctctggcctgccaacttcattggtattgctgccctgtccacttccacttaccctccctcccaggtcaccactggaatgtagagcagagagccagctcctccagctgcttccagaaccaccaagtcctctcgtcctactctcttcatagtcatctcccatgcctgtagctaaaagcctctacccaaagcttccataaaaataatgaacatttctagactatgcaagtgactcattcaagtcagcatgaactgacttcctaagagactgaaagtgttggaaggacatgagcagggctccttgccaattcaaaattctgcgccaaatgggtggtatcttctgggcctggggtaccctcaggagccaaaagcacaactctctcccagactgaaaaccacactggaggataaatgttgagaacagtcagccaggagactgagataaccctgaacccagataccaaaaggctggaatagatcctacattgacaagtgatcagctggctgtgggccagaaacaatacaccacagacaaactggaaaaaacgattttacagtaaatggactttttacaaaaaggggaggggcagtctgaaaaagtaaagtttaatttaaaaatcatatacataaagcttctgattcattttcagctctcccactgtgtctttcacaggcgagtcagtttcccattgagtggaggccagttaaagatgccgccacggtggacagtgagccagcccttcctcaacaggtgagcaagagcggctgccactcaggcttgaacaatgcccatgacctgagtgacttggcagagaggctggcttcaggcgaggttcagaaggctagcttcttcatcaggagataaactctggagtccacctcgaatccatgcaggttgttggcatccccctgcagcctcatgagcaggcccccataggacacgtacgcagagctgaaacagaaggccccatcccgtgattctggagcactgccactcagcagctctcaatctcagcctaagaaagagaagaggcatcttcctactgttgtgtcactaggaaccaaaattctgacaaagatcaatgcacaggtatgtgcaaggcactgttccatctcagcctaagaaacagaagaggcatcttcctactgttttgtcactaggaaccaaaattctgacaaacatcaatgcacagatatgtgcaaggcactgttctttatattatcgagggtggaaaacacctagatgccccaaatcaggggaatgttcaaatgaatcaagacatatccacttactgaaatgttatgcaactattgaaacgtttaagaaaagctttacaccggccgggcacggtggctcacacctgtaatcccagcactttgggaggctgaggcgggcggatcacgaggtcaggagatcaagaccatcctggctaacatggtgaaaccctgtctctactaaaaatacaaaaaaaaaattagccaggcatggtggtgggtgcctgtagtcccagctactcaggaggctgaggcaggagaatggcgtgaacccgggaggcggagcttgcagtgagccgagatcgcgccactgcactccaggctgggcaacacagcaagactccatctcaaaaaaaaaaaagaaaagaaaagaaaagaaaagctttacactaacatggggaaacatgttttacataatgttaagcaaaaagagcagaagaaaacataataaacaccacagtctccaagaaaaaaacagaacaccaggatatgcaaaaaagtctatgtaaaaggttctctctggatatggaattacaggtgacttttttttccttcttcacattactcttctgcatttcaaattacttacaaaaagcacatattgttttaataagactttaaagaaaagaaaaaatagctggacaggaaaaccaaggaactagggattgggttacagagtagccacacacacacacacacacacacacagccttttacagagtagcaaaacacacacacacacacacacacacacacacacaaagcctaacagtctaatcacttaatgctgcatttattcctggggaagcaagtctcctttgcactttacacagtgagataatcagtttctcatgtggaccactgggccaggagggcctgacaaagggcagtctacatttcagactggaaactgctcccagaactatttctttctagttcccacctcggtctgaggtgcctgaggagagggactcaacagaggaagcaggagcatagctcaaagtctcagaacatggaagaggaaaagaatcctcacaagattacgtaacttacaggcgtgttgctgcttcagtagaagtttcatctccctcaatcctgtacacttttccatacattacatactcaaactggtcagccctatggagcaatagcagcaaagttattcttaacagtaattaacaatataaaagatcccatttaaaaatggttactggtcagccgggcgtggtggctcaagcctgtaaccccagcactttgggaggccaaggcgggcagatcacgaggtcaggagatcgagaccatcctggctaacacagtgaaaccccatctctactaaaaatacaaaaaaattagccgggcgtggtagtgggctcctgtagtcccagctactcaggaggctgaggtaggagaatggcgtgaacccgggaggcggagcttgcagtgaactgagatcgcgccactgcactccagcctgggccacagagcaagactccgtctcaaaaaaaaaaaaaaaaatggttactggtaactaaatgccagcattataacaacaggcacattacaaacatgatgtcatttagtcctcatggcaaccccatgagctaggcatgaccatctctattttattgatgaggaaacaggctgaaggagattaaggttactcaacaaataagtggtagagctgagaaatgaactcaagtggggtgccaaagtctttccatcacaccaagctccctcccaagacacaagacccacatggcctaggtcactcagcagttacctcctcagccttcaaaaggctgcaactcacaagcatgtaatcactgttatagataaatacctggttgtttgaatttttttctttttttttttttttttgagacggagtctcgctctgtcgcccaggctggagtgcagtggcgggat

SEQ ID NO: 12591 - DNA, 22463 bp, Homo sapiens
tattgtgcagttagatagtaagtgctataatccaggaatatacagtgttgtgtgaataatgtggaatcagtttatctccagagcagaaaaaggtgaaggccgaagaaggcattcagagtgatactggagctgtgtagcaggggctactactgttccctcaaatcctttcttctcttcttcctgagtaatagagtcctttttcagctaggcatacagccatccaaaataaaaactatatttcccagcctccttttcagctaagtgtagccatgtgactaagttgtggccaatgggatgtcagtacaagtggtaatggcaatatctgggatgtgtctttaaaaggaaggaacatgtccttctccttttcctccttcctgttccctgggaggtgaacttggtagctggaggtgaagcagctggaacttggatatgagcgtcttgttgatgataatagtgcaacaagataaaagcagcccgagctggcctacatttacatgagaaggaaataagactccattttgtttaagctattctcttgcatatatatatacacatatatatcagctaagtgtagccatgtgactaacttgtggccaatgggatgtcagtatgagtggtaagagcagtatcttgtatatatatatgtgtatatatacacacacacatatatatacatatatgtatgcaagaatataaaatatacatgtgtgtgtgtatatatatacacacatatatatgtcccttgcagccaagtctaattctaactaatacaaactaactctaaaaaatgaatatatattcaccaggggataggctatttcaagcagagggaagcctgtataaaggctcagggaatgctgtggttttatgtggcagcagatgagactggaaatgagtcaggatgagccacagtggaggatgaattaaatgggcaggagtgtggtagaaagacctgttggaggctatgaatgcaatcaaggtgacagacaactggtgcaatgatggtagtggaaatggaggagaggggattgattcaagatgcatttaggaccaagaatcgggagcttgtgaacgtgtgtatgagtactgtagacggagtgggtgtgtcatcagagaagatctgagcatttgggcttgctctcctcagaggccctgcgagtggagttcagcttttcctcatggggcaaatcttactttcgctccagttcctggggctcagagtccctggcccagatgcctcttgccatctcatcttcaccctgcctggcttcccttgcttgttccaggattgtttcataaagagggatgtggttggtctttaaccctatgaatgctggctgaggatgcctgcggaacctgtagtgaagctttcaggggctgctcgggttctggctggtaggtgaacactgtccatcttgccggctgggacacagtgactctgggtagttgtgtaagagaggggcccttggcagacaaacaggttcttctctgttggtgggccagccagcaggtcagtgggaaggttaaaggtcatggggtttgggagaaactgggtgaggagttcagccccatcccccgtaaagctcctgggaagcacttctctactggggcagcccctgataccagggcactcattaaccctctgggtgccagggaaagggcaggaggtgagtgctgggaggcagctgaggtcaacttcttttgaacttccacgtggtatttactcagagcaattggtgccagaggctcagggccctggagtataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcagataatggcaagcatggctgccgtgctcacctgggctctggctcttctttcaggtgggtctccgaccctgacttcaacgtgggggtgtgggtggaggctggccagagggccctgtccaccctgggggaggagagcccaggccctgattacctagtccctctccacagcgttttcggccacccaggcacggaaaggcttctgggactacttcagccagaccagcggggacaaaggcagggtggagcagatccatcagcagaagatggctcgcgagcccgcgtgagtgcccaggggaaggggtgtaggcgaagggaggagacagctgggccatgccatgatgacctgcctctgctgcctcaacctctgtggccgctgctgggacagaggaaaggagcggtgctagctctgtctgcagatcccggccatcctgggctctttagcgccctctgcctgcagcccccgccttgacaactccgtagctgttgcccccttgctcactgaggcgcgggacctgggatcaatcgggaggacgcccgctgcagtccccagaatcaaaggatgatgtggcgcatctatgtttctttggagagtgttgtaggtctggatttgtatgggcaatgtgtttgtgcttcgtgcgtgagttgttactggccagggctaggacaagagccctcgaccctggggccaacgccctgcgtccttggttcccccagaggatcagtgcgcgatgacttggggacaaaggagatgatgggggctagcagtctgacggcctggatatctgtccccttctccaggaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcatatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaagtttgcctggcgtgactctcatttggaccatgtctgaaagcagtggcctcaccactatccccaaagcacacccatcacccactccattcccttgctgctctttctcatccacccactcccagtccaggtctgtcaaagggggtctggctgggctctgcttcagggatcctggctagacaacggctgtctgtcacacctggcaggagggcctgggttacgggcccttcctctgcacctgcactgttcactagcctgctcccccacaggacactgtgcatggaatgcaggctgtgtctggaagagctgtggccctggtggacctaagattcctgaggtgggctgcctcctttgttcctgctgttctagagtttgaatggcctctttttatgccggactctcttctggggactcccctcactcaggggcaccaatgctccctatagatcccctgggaactgaaactggggtgtggtggaggacgtggaaagggtaaacacagctccttgtctttggacttccctgtccggccccctttcctcccagctcagcctactgtccccgggttctcagcacctgcctgctccccaaccccatagcacagaccccacacatatgtaggctcatcatgcctgcaggctggtcttccctgacaccgtggattttgacaatgttggcaacagaactgggttgtggacccagcacctggagagaggaagtgctagaaaggtagaaataataaaaggtgtttttgttgttgttaggaaactggaaaagcataggtcaagggctatgatggggatgaggaggtaggagtgaaaatgagggctgtgtacttgaggctgggattggggaaggtagtgatgaggacagaatagggagtgggaagaacagaaagggacagagggattcagggattgtgagagaggggaagaggctgagccacccggaggggcgacctagcacgcaagcagtatgtggcccaacactggaaccaagcagcccggctccgggcgcaccttctcagggattcctcagggacaagtccagccccttgtcgtcaaggctcttgtagaccgacgtagggaccaatagaaccccgtgcggtggagctattgtgaaggagcaaaaaagtgccctggttctaagaggacgtcttaggggaagtgacggctgagttgaggtggatccggctggcgatgtaaggttcgagccatataaacccgggaaccgggagcccttgacgacattgttccccgagtgcccggagtctgcggctttttttggggtggtggcagctggcggaagtgacgggagaggggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgtgaggcgggggcgcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggmggtcggatcttaaataaatccccctatgtctcctagccttagtttcttttgtaaaatggtactggtgttgtcatcagctcaagtgagatamgatttgtgaaaatgctttgtaaatgttgtctgagggtatgaaatgagcagtagttgttatgaatagtattctcaccatttggacagcctggctcacaccacctgtactattcgaaaggagcagtctggaccctgtggagtggcgagagggagagacagctgggctgcggtctgatggaaggggacggtctggttattacttgaggagaagctgttctgcagtctctttgtactgaacgtattcytttcttcccaggacatgaacagagaagtggtgaagactgactctgctgccacaaggattcctgagctagattttgaaattcctgcctttagccagaaaggaggtaagtttaagatcagartatttgggctgttcgcatgtagctagaatcttaccctctttcttgcaaaaccccctggtgccaggtctagtggtttgtgtatgggttctaccatgtaatcattgtratcttcattagttaatcatgagtggaaagcttaggtaaaacagctcgagatggtagaaagtaatggtaataccatagtgtgtttattgtagaattttagcatcaytattatcagacatgaatggaaccttgcacctggccttctcattttayagatgaggaaattaagacccagagagttcaagtgaattgcccagggtcatacagggacttgatagcagagctgaggctaagtcacacttgtcttttgttcttgttcacaagctctgaccactgttgaaggattgatcacccgtgctatctctggcctggagcaggaccagcctgcacgaagggtaagctggggttttctgattgtagcagctcaaggaataattgcttatatagagtgtcccatgtgtctgaagagtctctgactaagtgttggaaacttgctgggtaagcatatggtggtgctggagctgctagaatgttgcatatgttataattattgtcttttccacttccctccctcagtatatattcaggcctcatcagacaatataacattacctctgaagagcctttcctaatccccttgggttatctgtgtttcctgagtattccactgcatcttatatttattatgacagaagtaatatattatagctgcatctttagttatttgtctccttaattggttggggagtcccatgagaggactgatatatatactattatatctctaacgtggcatgagtgcctgggctaaatggttgaatgagtgagaaaaatgaggctcacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtctttagcctgaacatcccatctgggagggctcaccctttgtcctcatgttgtgttccaggtgctccagttcagcacaaactgcccagaatgcaatgyccccgctcagaccaacatgaagctagtacgtatcttttgccaagcagttgggttgctcttcatctgactcaggcatgaagattataatcaggctgggagcatccctttcaaggaaaacacatgctttatacccagtgataaggaagatattatctttgattagactgtgtaccttgggttttgtgttcaaagagaaaattaggccatggtcactaggctgtgtgtgtgtgacctgagccatgccttcaaatgtgtgaacagggattgccatgggttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatgaggtgggtgggcgccattatttgggaagaagactagcttaagggtaacccccttttaactatcattcttcctaagtacttcagtactcgggggcagggggtgtagagtagcttgggtctttttcttaggtctagtgcagggtgatgagcccttgaaggaatgggaattagcctagagaagaaaagttagagattctataacttgtttaagacatattaaaggttgatgatatggaagagagaagtcttttgacccactcctcagaggtgtggaagttcagggaggcagactttgacttcacaatgaagaactcaatagagctgtctgaaaatagaatgagctgccttagagaattataaattcccttcccctgagtgtatctgagtataagctaattaaattctttaaccagaatattataaaggagacccacacattggatgcagtggatgaaaggactgcaataaatgcttaaaagtctctttcaaccccaaaagtcttttttttttttttttttaaggkaaattcagagtttattggcaatttgggataagttttggcacgttaccagggttgggcactgttcctggccagctcttggtgtttttggtttgggcgactgctgtttagaaggctmtttctttggtagctattaatgrccctaactgattggatgtccaagcctacactccaggtctcctgggtaccaagtgaggctcaggtcttctctctgttgctcctgactgttatcgatgcaggtgaaatctggaggagcagtagaacccttgggcaccaggatcaccctccacatcacagatgcctcagatatgaccagagacctcctcaaggtaacagtctgcttgggaaagtcactgttgtcctcataagttagataaactgtctctatctaggggaagttgtcttttagaaataaygttcagggacatgaggtatctcctacttccctggctttgaggacccctgagcagagggagttaatctaagatkggaattgcaggtttagaaggtgaccctgttagctctttctgatgacctggtagctttttggcctccagtgtctatctgggtcctcttctctgtctgtcccctagtgacaggatacctgacagctcgaagctatgactgagtttccctttattaagttggatctattcccgtggttcagatggacaggagtgagtctcaagctttaacaagggagtcagagaaaactgagacagctgcccttgtccgcagtctatcactgctggtattaattgggcaggaggcctctggttggctttctttgcttctgacttaaagcttaaactracctctcatttcacagtctgagacttgcagtgtggaaatcccagagctagaatttgaactgggaatggcagtcctcgggggcaagttcaccacactggaagggctgctgaaagacatccgggaactggtgagtcacttgagtagtgtgtaaaccacctttgagcaatttggctgtgtgaagagggactggaagacttcagacatcctaattttcggtgctggtaactgtgggtttctttgccttaaagctggtttaagagacttaaatattactttggatggtgaagacaagtttatgggaaatgttgaatggaaattccaggcctaactttgggactttatagttattttgtggtcttggacaagtcatttattttactgtaaagttaggggatgagggtccttctagcacctaaaacttcccaacataaaaaacatacatgtatgggttgacttagcccaaatrtttatctccttgatgaattatttcacttgattctctgttgggcattttgtatttgtaaattgtactttttctttgcatttcttctccaaattagtatcagagatcatattctaagaacatgtttcgattttgttttacattgccagttttgttatcttggcacattatcccatagactcctaggagtgactgccttggtcagaaaggtggtgtgggctaaatggaaaccaagtttccctgacagggcacccactgtcaccccctgcctagtttatggtcaggcctaacaaatataaagccagtattcacatagtttggattatcatttattgcaggtgaccaaaaatcctttcacactgggcgacagttccaatcctggacagacggagagactacaggagttwagccagaagatggaccaggtaagaggtcactggccagtcagtacttagaatcctggggctccagtgaacaggaggctgcatgctcatgtcttgccactttttgaacatctaaccatcatgttggggattcttcttctggttttcttttcttttttttttttttggagacagagtctcgttctgttgcccaggctggagtgcagtggcgtgatctcggctcactgcaacctctgcctcccgggttcatgcgattctgctgcctcagcctcccgagtagctgggattacaggcgcacaccaccacgcctggctaattttttgtatttttagtagagacagggtttcactatgttggccagactggtctcgaactcctgacctcgtgatctgcctgcctgggcctcccaaagtgctgggattacaggcgtgagccaccgcacctggccctcttctggttttctatattccatgtcttctttcttgtttttctcccttattttgttagagcatcttctccagtagcttcctgggaaaaagtgcatgggaaataaaatttctgggaccttccacatctgaacatgtctttattctrttatcacactagagtgattattggctgggaatacgattctaggatagaaataattttttatcagaatttcgaagactgcactatggtcttccagtttggtaaagacattgtactatagtcttccactttggctattgagaagtctgaagccatttgattcctggtcttttatatgtgacctagtcttgtgatctcttcgtttcctttgatgtgaaatttcagggtgtgccttggtgtgggtcagttttcatccactgggctaagcacttggtagatgtattttttcagtctggaaaactcatgtggttcagttctaggaagctttcatgaattattctattgaagattatcttttttctgattttttttttctgttctttctgaaaactcctgggttttagatattagacttacttgtctggtcttctataatttactctttttttggtcctatttttggtttcttggtttttttgttcttctttgggagattccctcaactttattttccaacccttcaattgaggttttcatttccactaaaacttttattttccaaggagctttttaaaaaatagcatcctgtcttaaggatgtagtattttttcttcttgaggattattattttttaaattttttcagcatgcagtttatatagcacttattgatactgatgttggatcttttttgacattttattctccttgcatcctttttttccccatttgatttcccatctttcagtgttaagggctttgctcagatgtctgataatcattgattgtcttcttacaagtagcgggctaaagacctgagtagggggtgagccttgttgacmtggggcttattacaggggaatttaacttagctgttttgctgaggtggcctccaatgccagaattgttaggtctttcctcttgggctagtcagacaaagaggctatgcctgccagacaagaaccaacccaatttatattacagaatcctccaaagttttaagaattggtgaaattaggtagctctgaaagtagaggggaaaggatctaaaataaggactgttagaaaagccaacatcagcaagctgtggaccagggggtgctggcccagttgaaggtagagggaaaggactcaagaacaaggaggttaaatgactgtggctgctccatttcctggcctgagggtaaagacttggctggcagtgttctgagagctgtgggaagggggctggggtgtgtatgtattctgtttcccataagcttacattcatttaacctacttgttcttgattcctttccctctaccttcaactgggccagcaccccctagtccacagcttgctgatgttggcttttctaacagtccttattttagaacctttcccctctactttcagagctacctaatttcaccaattcttaaaacttttggggattctgtaatataaattgggttggttcttgtctggcaggcatagcctctttttttaaaaatttttctttactttcatttatttcatttctttttttatttatatatatatttattatacttaagttctagggtacatgtgcacaacgtgcaggtttgttacatatgtatacatgtgccatgttggtgtgctgtacccattaactagtcatttacattaggtatatctcctaatgctatccctcccccctcccccgacatagcctctttttaccaggggttatgtaaaatttacttgctgtgttctctctctcctttagatcatcgaaggtaacatgaaggcccactttattatggatgatccagcaggaaacagttacttgcaggtatagtagaccttccctgatgtttcatagagatacattttctgatcttccttgaatatgtatcatttccctagaaactgaaagacttgattctaaatggactgctttttaccaaggaggcagaagttagaagatacataagggagaaaagaggggggtgtgggaggggattttttttttaagtgtatgtaaagaaggaaaaaaaaaggatactctgaggccccttttttttctgtagtcaagctcttgtcccagttctggagttttcattttgcaaatctgattatggattgaggagaaatggtaccttgtccggaggccaagataggaaactgataggctttaagttgactgaggagagagtctggtgattgatgtacctttaccatttattggatacttaccatgggtcaggcaaaactcttctaagttctttccaagattaagaccatttgtcatacttttcataagaaggtgcagatataacaaaataggtggattgttccctgattctggggctggggtcttctacccctggcccatgtgggctctgttgctacccactagttcagtctagccatgggaaattggaggccaataaaaagaaaaaaacccaaaactcattctgttcttgggaaggtgggaattggaagctgcctgcagagagggggagtggcacagcggcactgattgtctctccttgaccttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtytgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccytatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatsaggaaaacagtacatcrgatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaagatgttatcacaaaccttattgctttgtgttgcaaactttttttttttttttttggtagagacagagtctcgcgctgttgcccaggctggagtgcagtggtgtgatcttggcttattgcaacctttgcctcccgggtttaagcaattctgcctcagcctcccgagtagcggggactacaggcgcacgccgccacacccagctaatttcttttgtattttagtagagacggggtttcaccgtgttgcccaggctggtctcgaactcctgagctcaggcaatccgccagccttggcctcccaaagtgctaggattacaggcgtgagctaccgcgtccggctgtgttgcaaacttaactctgaagaatgagttagagatgatttagcaatcagacatctactctcgttgctctgttaaactactctcaaaggtcacaagtgattttccacttggaaagtgttatctatttctgtcacatttgatagtggaccatctcttcttaacccttcttttggctctcgagatactgtacccttggttttcccttcactttgaatatttcttatttggacactttgcctcctcccctcttactaaatttgtttctgagagttctgctttcagacatctctccatatcagattctttggcatcttactatcatgtgggactaacttccatacctgtatctctaatttctgtaagtgagggcgagagtaaggtgtttggagactcaggttagcaaatgactcattcaaactataaagcttcagtactttgggcaaacttctcacaggcaactattctaccctaagagattatctctagatatgtttccagctgacttgggaatctaagtttaccagacaaccctctgatctatcatttggtctcttaagtagacttccccatagtgtaggtgtgctctgttaagataaactgcagtatcaggttcattttccattgtgaaggaaaaaaaatggcactctggcttattactgaatctcttgtgagtttggttggtgtgaggcaatctcccagaatccacccagttcctaggaaatgatgacctgagtttctgaacttgaagactgaggaccaggtgccagactgggataacccagctaaggtacttcctgccctttgatgacaaggcattcttcagtttcatacccttctcttgaattatctttcagctcctttctcatttcataaagtgtgtcaggatgggagcttacatatagttaactgagtcttgctccacagcacccagcatatgacacatggttaataaaatctgttaaaatcctccatcatagattaaaccctattaggacactagggataacatctataggtaaaaagatagggaaagggtctcgctttaaggccagggtaggtgagtcaaagtgccaggaacatgtggattcagtttcacagccatgagtaacatttaagtggaaaaggtttgtgattgtgttaaaaaaggaaagtggttcatgcatgagggcacgcctcctactttcatgggtcaagtatgtgaaatgcagccatgttcggtcattagacgtgtggacgaacatacaggtaggtactgaatgtacatctgtgtcatgatgagtggaggaggggaggtgagtgttgggagcaagtatgaagggcagttgacttggccaactgaaaactttaatgatggcaacactttcattctaacatcagtatatttccttctttgtacacctgtggtatgtgcctgatgcacactgcagaaaatggtgtctctgcttacatttagggcagtggtggctaagactacttggctttattcctattaaaaaatgttttttacacacttctttttaaggcaaatggcagtgtttccaactgtggagagaaaaagctgcttattttgtgcgttcacctcagtttagtattggcacttccaatgcttgttttcctagtctgtaaaatggggataattaggataaacaaaattatccccattttacaggtgacaaaacagcctcagagaggttacttccagaaggaagcagagcttttttttttttttttttttttttttttttttgagacggagtctcactctgttgcccagactggagtgcagtggcgtgatcttggctcaccacaacctctgcctcccaggttcaagcgattctcttgcctcagccttctgagtagctgggactacaggtgcacgccaccatgcctggctaattttttttttttttttttttttggagacagtcttgctctgtcacccaggatggagtgcagtggtgcgatcttggctcactgcagccttgcctcctgggttcaagcaattctcctgcctcagcctcctgagtagctgggattacagacgcccaccactgcacccagctaatttttgtatttttagtagagatggggtttcaccatgttggtcaggctggtctcaaacccctgacctcgtgatccacctgccttggcctcccaaagtgcagggattacaggcgtgagccaccgtgcctggccagaagtagagcttctaagaggcaggtgtcaaacccatgccagtcagactctgaaacctgaggtctgaatattttaagctcagctccacaattactgtatttgttctattagatacaactgcagagagaggccaaagctcagagcaggccattggcacggcatctgatcctgcttaactgccctgcagcacagggtggagacacttgggccttgtcaggctaagggactggggtaggatgggtagcagtggaattgaagacaaagaaaacaaatgggcagaagatgggtgggtggaagttcagagggctatcctggcagtgttcactggagcagaagtgtgaggctttctgaatgcctgctgacaccagggtggggcagggctgtgtagtgtgagatgcaccaaattggacgagaagccaaggcaggcttgtgtatggggtaccctggggccctccgcctagtgaagccctatcttctcagcccagcgtcctcgtctcacaagccctcagagccccagcctgctttcctttctgggcctgtgctgcaaccccctcaacatggcccactgggtaaaaattcatgcttcaagactgatccccaagcctgttttgtattatataagtaaagaattttttaaacacttatccccagataatgtgtatttatttataaagtatagccctgtctgcttgactaatatattaaaaaagtgacctttttgactcttggtccaagaaactattgtttgcacttttgtgtagttgtgtatagcatcctgcaaattctgtcagaagtctgtgatttcagtaacactaaaacttctctctcaaatggtacaagttttcagttttaagacaagttctgggaatctaatgtacaacatgttgactatagctaataattctgtattgtttacttgaagtttgctaagacaaatttgcttaagtgcccccccaccgaactactacataaattagtgaaggatgttttacttaatttgattttggtaatcattacacaatgtataattatatccagtcatcacattgtacaccttgaatatatataattttttgtcaaataataaagctgggaagaaaacgataaaactgacaatctaacatatatgatgaggtaaaaagatctggtatttcaagaaatttggatgacctcttgcaccccacttcgctagcctctactccctagagtcatgttctgactatgtgaagttgagcaacttccttaatcttgccacgcttcagttcttatctgtaaaatatgataatgaaacgatttgagaattgtgagggttaaatgagataattcaggtaaagctctaaaccccctgcaaagaataaagtcttttctttccccccaaaacttgagtgttagaattcattctctctggtttctctcttttactatgctaaaaaatgatccaggtccgtccttctcattggcaagattgttttacagtttccttcaagagataactgggggctacttgtaatagaacactagaagagttacacaggtcttagaaactacgtttttcatagtaattatgttggtttgcacttcctggcttcctttcttggacggtaggtacctggaagcctagtggagcagattccccccacttaaagatacttataaaaataacgaacatagttccgatgaccatgtgcccaacaccgctctgcgcacttcacacagtaatatcatctcagcctgtgaccgttccgagttaggtgccgggattctccctgttttgtgataacttgcccgaggtcgtacagctagccagctatggaaccagtattcaaactcggctacgctgcagcccgtggccctccactttcttgctcgtgctctggagtttaggcggccgatgggggcggggtcctttgggtcaggttgtggcctcatagaacagcgcttgctgcggttggatggatgggtgggtgggtgggtgagtgaatgaagagaagaaacctggtggcgtcgtcccagggctgtggagcgccccgaaggtgcgcacgtccctggctagcctgcgagcgcgtcccggtggccgcacctgccagccgcgcgattcttagcactctccgccacttccggccgtggccccgccctgtcgggtggctggcgtccgttacgcgttgaggcattttgtccccagcgccgacccgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaaggggtgagttggtaccggccggggcggggcctgcgacgtctagccaccccttcccaactccgccctcggccgcccggcagttccttccctcttggcgggtctctcggcttctccgccgacccctgctcatgctcagggccccactcacatcgcttgaggccccccgccttgcctctgccgccccgcttacatctcgagcctctgagcagtagcgtcagtgcgttaaagccggggtgtaactttgattactcttttcccgccttggtagacttccgtcctctcccatagagaatgaatattgtgcctcgagaataatggagcggattcaaagcctctgtgcttggatctttagggcccggtacctgcctgtggggattcccagatcccaaggacttggttctgaatcagagacctttgatcacctcctgttactcttagtaatagtcctaacgtgagaagctaacatttatatagttatacttttcttgccaggcaccattataagaaatttaaacatatataagtttatttaagcctcaccacactaccatgaagtgggtattattttcatatgggacaactttgtggcccagtgtagtgggccctaccaaatcgttttccacccagaaccacagaatgtgacatttagaaatagggtctttggagatgtaatcagttaagatgaggtcatacttgattaaggtgggtgccaaatccaagatgactgtttgccttttaaaaagagggaagtatggatacagacacagcaacaaaggaaaaacgaccatgtctagatgaaggctgagattggattggatttatgttgccaaaagccaaggtatgcttggggctaccagaagctgggagaggcaaggaaagattctctgctagagactttccagggaggatggccttgcagacacctggatttcagattgctagcttccagaactgcgagagagtttctgttgttttatgccacgcaatttgtggtactttgttacagtaaccctaaggcactgagatacccagtgaagtcacattgttctaaagaactagtccaagttcttttctggtttggtgcttgccttattattgtcttcgtctttctg

SEQ ID NO: 12592 - DNA, 34981 bp, Homo sapiens
gacccttctccagccagtgagtgggcccaatgatgacagccagggctgtatcgagctctgccttgagctccctacgtgcatatctgaagatgaggagggagccagctgagcctcatgtttgcaagcccactttctggtggtgggtacccaaactctctaggcattctcaaagcaccccccaggcttccaaaaagggagatgagaataagaaaacaaccagaaagtgcaaaagaaaatggtgaacaaaacaagggcatcttttattaccccctcttcacatattctggaataccctaccttaaaaacaaaacaaaccgtgctacttggccctcttcccttgagttgttgtctaatctcattcatttcactgccaaactcctcaaatgcatggtgtacacccactgcttccacttcctgtccactcatctttttcctcattaactccctgtggcctggctttgcctgtgacactacacaagctgcttgctccaagataatccaagttcttttctctgtcttcctgatacacaggctttctttggcatctgacactgctggccacctgctcttcttgaaatgcttcttttggcttctaggaaactgcccatttctcactctccttagctgtctttgaatctccttctcttctctgcgggcttctcttccttctcccatcgctgtactgtgggtatctcccaggcctttcctcttctctccaacctcatggcttctttcacatcccccgaggtagtcagccctctttatccagttctgcccactggtctcatagctccagcttccttcaggaaagcaaaacatcttccattggttgccccactcttacctccatttcccccaaacggaacactgtccttcctcctacgtgtcccttttgccattattcccatccttgccgacatcgtgcagtcatgcctctcccttcctcatttcttgcgtccaggctgttagcaaggcattttattccttctttagaaaggccttccagccttgcctttccgcttcatgctgctggtctcgctttcctgccaacgttgatggctactgtatcctcctctcgggtctccctgcctccagcctctcttccgcaaagcacccaataatacccctgctaggcccatcaaactctggtttcaagacatcacaatgactgccatggtttagaactttagtcattcctcattgcttccagggtattatccattttgctgtcctgggaaacagggcagagtccgtagaaagccctttgagcaagacagacctgggtctgaatcccagtgccacgtttgctacttaccttgagcaaacatcttagcctctctgaaccccattgctcctccataaaacacaattaaagtgacacacaattgtgaacatgtgtgagatcatggtgtataaaacactgtgcacctggcacaggtggtcactcaatatgtatatagccctttcccctctccgacattggggccctacctttttttccttccacctatgtctccagatcccccatacgcatagcctcatcaggcatgtgtcctccgagtccttatgaactcaccacaccgttccccttccatgcctttggtcactctgtgattctcattgcccagaacatatcctgatactcagtgcttcttaaagccctcccctcaccaagctccactgtcatgtccccatcttgaaagcttattttattttattttattttgggacagagtctcactctgtccagactggagtgcagtggtgcgatctcagctcacttcaacctccgattcccagattcaagtgattctcatgcttcagcgattctcatgcctcctgagtagctgggactacaggagtgcaccaccatgcccggctaatttttgtattttttgtagagacggggtttcactatgttggtcaggctagtctcaaactcctgacctcaagttatctgcctgcctcagcctctcaaactgctgtgattacaggtgtgagccaccaacgcccagcctgctcctatctggtggcctgaccaatgtcaccacttggcctgggtcaactcctgctggacctcaggacacactggcttgtcatgagggaagctcagtgggcagcagtcaagcagtgatgcctatcccagctcagggctggactgtgggcctagactgagtctaggacagtctgagaaccttggcctcctggcatgacgttcccaagggcagtcacagtctgggtagagccgaccacaagactgcaggatttctgatctactctggtccagaccatcctttgaaccaagtggacttagtggggctgaaggaggtgtggggacaaagaacctatggcagggcaaccggccctcctgtctgcagcctggcttcctcaattttgtgttcctaacctaagagctgccattcagtgagggcccacagtgtgtctgctgtgtgtagactctgcttgtgcaatctctaatggcctgagtagccctggaaacaaaatgtggctatccccatgttacagatgacaaaactggctcaaagcaattatatgactgacgtagaccacacagctagaaaatggaatcactgggtttcaaagtggatttttgtgactgactccaaagctgaccagagtgctcatcctgtatgcttctgaggcctctggccctccagaccggtcactccccacaaagtctcccttttggtgagttgtgtccctccaaacactccctgaaggcaagatcaacctgccctaactaccccaaagtgaactaggccagccccaagcctgtctccggccctccatctctctctttgttcacatccatcagaaagcagagacctagagtagggaatgagagggggtgcacaagtacaaaagattttgaagccagcaggaagacaaaagaatgacaagaaggagcagctgtttgtaaagggaaatctgagacaggcagaaagctcagctccctaatcctaggctcgtgtggagccagggcagggtccccccaaggtcagggattctgggggcaggcggatgggagagtcagcctccactcctgggtggctcccctctgccctgtgcacaaacaacgagtgcctcattcctcccctgcaccaagtgccctgcctcttcctgccccgtttcttccttccctttgggtaccggagcttttttctgattcccctctctccatgctgacatcgcttctaattcgccctggtgtctccctccctcacaattactgggagtaattttagcaacttttcctctgaactaccgctggcgtgttcacagcaaatggcccctgttttggcttgacacttgatcagggtggtgacagagtgcagacaaagccggcacaatgcggggaggggaggacgggggacagatcaccttcctttcacttcaggccttatttggtctaccttgccgaagcggccctccttccagcctctctttatttatagcattttgctttgctctcctttatcttgctatcactttgtagcacactctgcacaatccccacccaccccagcatggtggggcccctggcccctcactctccccacaaggaatgtgcatgtgtgcaaagggtaggcctggatgccatttctacaaacagttgactaaagcagtccagagcagggatctttctttgggtcattgttatgtccttattgaccagaataatgcctggcacatagtaggcactcaataaatacttgttgaatggaggaatctgcaaagctgctcagtcttcagacagcagcaagcagcaggaagagaatcatgatgtaaccaagagcaggtgctggaggagctagggagtgagtggggatctttaaggacagcaggccctctgatctgtctgagctgtgaggcaaagcctagttagggaggtgagttctatctgcaatgagagggggcatgggtggagaacagtaacacccaaacaccaacagaccagagcctcccaaacccgaaaggagagaaacaaagtgtgattgatttcccaaatgcagaaaagactacccaagtccccagccaaggaaggaggctggcctgtggtgaagacactggctttgaaatggctcaactacgtcccaagcaccctttgtgcatcttaattgccctgggaaatcagggaggggtggcagtttggagcttggaaagctggaaggtggggacgaaaggagtttttgcccctcatcgccaatccttgaggttcctacagggaacctcagacaacagctgtcttaggggtttccttccagctccaagcagctgtattatctatagctttgagagggtctgtctctgtcaatggggctgattcctcagcacctggcagggcctgggggggactgccagagtctgttctgccgggcatgttagtagcacagactactgggataacctcagcaactgtataccttagcactgcagagctgcggtgttgtcagacacagcccttgcagttcgtggtctacccccacttgcctgcaccccccttatagctgctcaatgtcctcagactgtaccttagtgccttggttaccaagcaacccccacagaggcctcctcctggattttcccttccctgctatgcccaccccaccttcaaaatgtacctgctgcacccatcccccaggcctgcctcactccttccaagctgacagctaatcagatggactaatccgcatgcgcggaagagctgtgcttgggaagaagggggagatttcacaccaaatcgtgcagtggttgcctagacacggagccagtcaagcttgcatgccccgttgctagaagagcatggcatcggttgtgttctgtgctcgtaggctgggccccagctccctttcctcccctcctttgtggctgttcctcaggcctgcagaggggaagatttttcctgtcctgttactctgcctcacttgccagaacactagtcgcctccagctctggataaagctgaggctgggtgggccagacaacagctgtcttaggggtctccttccagctccaagtagttgtattatctatagctctgagagggtctgtctctgggctcaggcctttagtacctgtggggcagagccaggaacgtgagtcaggcaaaccgctccaaactaggaccaatgcagctgggtcctgctctctgcgcatagggggtccccacatctttggaatcccagcccacctttccaggctaccctccacaggccgggctccactcccatctgctgaggtttcccaccttgaatcctgctgccccgattagctgtataaccttaaagaatgcactgtccctctccattaaatgaagtgcttggatggattgctaaaggcctgtctggctcggaggcttggtgacctcaacacattgcctgctggtccaaggaaatcagtgcctgagccagagtccccatctctaagctccatggttattgttcttgccacctggctaggaaatgtccttccagctgccccagtctagctgcctcaccctggggccatgcccccaactctgtcctacccttctctgctgctgacactcagccccttcccagcttccagttggatacaggacctgggccaggagagcagggaggacactgtggaaatgcggccaggccatcaggggcctcgcagcaggggactggagggggagcagtgtccagggccagaagtgccctgcgggagagccaggacattggctgcctgtggtcttggtggtcgtggtcagttccctctcctgccagctgtggaatgtgaggcctggcctgggagatatttttgctgcactttgagccaccccgccccctggaactcagaccctgcacagtccatgccataacaatgacgaccacttccaattgtttcctagctggagaggcggggaggggagcactgtttgggaagggggggagcctgggggaaatgcttctagtgacaacagccctttctaaatccggctagggactgggtgccgttgggggtgggggtgccctgctgccccatatatacagcccctgagaccaggtctggctccacagctctgtcctgctctgtgtctttccctgctgctctcaggtaggagcgggagctggaggctttactctgggataagggggctccaggcttaggaagggattcctcttggaatagcaagcttcatgcaggacttcatgcagagtaccaggtccagtcactgggcacacatgtgcaggtctaaacatgggcgtatgtgccacaggagttcctaggggmagatatctgcatctgagcatatgggaccaatatgcattacagggtgtgtgtgtgtgtgtgtgtgtgtgtgtgtgtggacaagcctgcatagtctgaatgtgagaaagggtatgtacctcactgactgatacagaaatatcaagtgggagatgtgggtgtatgatcacgtctgtgaacgaggaggttcctttgcagggagggagaaagaatggtggagaaggattctaggaagtgtgtatgccttcatgtgattctgtgaggcctggaatgtgtagctacccctgtccatgcatgcagaggttcttgtctatgcctccacgagtmatgactgttatagtatctgtaccctctgcagaaggaactcacaggcacgggggtgtaggatgttccaggtctttgtgtactgaagaacacgcagtgatgtgatctacttacgtggcacacatcctsaaatgtgcacatttgctgttgaggcatatatggcaccctggggttggggtgcggattgaggtatgggaaggaagcctgtcytcatgtgagaggcatgcccaagcagcaggcatgagtgttcatcagagggcttgtggagggtgtttggctatgtgatgggtgtgtctgtgagaggaagcccacagtgtcttctctctgagaatgtccacaaagtctgacaacaaaatggggacaggatggaaaagaastctctttagagtcatcagacttgcattcaagycttggctctcccacttgttgtcatgggctcttggccaagcaasccatttaacctcgatttcctcatctgtcaaatggggtgaagactgagtaggagaaagtgcattgaagtgcttttagactggaaagtgccgaacaaatgtgaccattagttgtctctcagatggctcaaagaaaggtaccactagatgggtacaggcaggggtgggaccatctcgcaggagtgaagaggattagggttcaggttgagttgacaccaggaagctgttagaactagttcttgaggaaaaagggaatagggtttgaaaaacaagaaggatgggaccagagaagctgaccaccctttccaccttgttttggaagagggtggatgctgaagaacagagccagggagaagcaggaaggtgggactggtcaggttgggcacagcctgccctgacacagcctcttccctctctccaggtyccctgcaggccttggcccctttcctcatctgtagacacacttgagtagcccaggtaagaaaagctgaagctagagygttgaaaatctagtaagactgggcattagagccccaaagccagcctatggaactctagtttctgccatgtgctggagagaatatcttggctatcaagagctacttacctgtgaccagggggtccagggatagatgagggtcagagatggaaatagttagatttctgctcctacagggagctcagaatgctcttccttcccctaggagagccccagcttgaacaatagttwgttgttccttttaccctggcaggtttgctaggctgctcctctggttaaggggtaacctcaaagaggaagggactcactggtaactcctcttgactcttgagcatggtgctaggttttggggctcccactgaaggggagagcccagggagggaagggaagaatgggcagatgggagkgcagccagcttctgctcactccaggcacagccatgggagmttcggagatggcagtctttggggctgccgccccctacctgcgcaagtcagagaaggagcggctagaagygcagaccaggccttttgacctcaagaaggatgtcttcrtgcctgatgacaaacaggagtttgtcaaggccaagatcgtgtctygagagggtggcaaagtcactgccgagacygagtatggcaaggtgggtgtcaggctgatgtgagagtccaccctggccacctgtacacctgggtggacagagaggggtacacccatgccccatgcccatgcagacctgaggatggtcccattctccttccctytggggaagaatccagaccctccaaagagccctctccttcccaatatcccttctgtcttccctgtgagatcctggttccttctctcttgagcactattgccctgtcactcaccaactcctaaccctcttgaggaaggagggraagcccaggctgacaggagggcttgggtgggggctcttgcagacagtgaccgtgaaggaggaccaggtgatgcagcagaacccacccaagttcgacaaaatcgaggacatggccatgctgaccttcctgcatgagcccgcggtgctctacaacctcaaggakcgctacggctcctggatgatctacgtgagtsctgcmcctggccctacgttgggatctctgttcttgctccatccatgtccaccccaggagccaagagtgtcttctgtttgtgtctaggcagggttacactctaacctcgtcccaacatccttggttcaattccaacactctggggactggcattactcagattgagtgcatgcagaggttttcctttctcttctttctctcctgggatctttctctaactcccaaaatcaccagccctcccccttcrcaactggcaagtcactgctccttttctatccccagacctactcgggcctcttctgtgtcaccgtcaacccttacaagtggctgccggtgtacactcctgaggtggtggctgcctaccrgggcaagaagaggagcgaggccccgccccacatcttctccatctccgacaacgcctrtcagtacatgctgacaggtgagaggccctggaagggtcttcctgaagggaactgggataggccgggagggagagggagaaggaagggagaagccccacgagagcatcctgtgcagctcctracctttccyccccaccctctccccacagacagagaaaaccagtccatcctgatcacgtgagtgtagctgctactgtattccctttcagaatctccctgatcccagcctccagccccatcaggtgtcccaggccccgaggcatagactcagcctctttccccscaacctcgtgcccatctccttcttctctgaccattaccctgacccctctctttgctctccctcttcctttctgctttccatccccttcatgtttttcctctcccacctccttcacccactctccaactcatcacgcgtttatccagaagctcattatcgccatgtcttcacctctgcattttctttcccttcagaaacatttcccattcttccagccctaccaacttttcccaaaacagcccaggcccatctcccctgtttactttgcccagccaagcacaggctcagcctgcccaaaccagtgccttctggtggcwwccttcctggtgycagccctgacctctgtgcatcagaagacagttgtggattttgggtgtagataacctggcagcttcttgcccagggctcctactctcgggtaggcccaggcattctctcctgatttgaggcttgyyggtctccagtagtattgttcactgcccaataagcccctgtcttcacagcggagaatccggagcagggaagacagtcaacaccaagagggtcatccagtmctttgctgttattgcrgccattggggaccgcagcaagaaggaccagagcccgggcaaggtaggcctgctgccctccaaggtcctgtaccgcagaaagggagggagaagagctctcacctgcctccttcttggcctctgcagggcaccctggaggaccagatcatccaggccaaccctgctctggaggcctttggcaatgccaagaccgtccggaacgacaactcctcccgcytygtgagtggtccctgaccttggccttgggacttggactggtggaggaatggtctcagatatgagccttcccccaactcatcaccactctcttccmtctctccaggggmaattcattcraattcattttggggcaacaggaaagttggcatctgcagacatagagacctgtgagtgccatgaatctgctaggctcagcctaagctcacccttgctctagaccatctggtcttgacctctctctctctcccctccctccctctgtttttctcctctttaagtctctgtctgtaggtgtctctgtcttcaggtctacatatctgtctctctctgagacttcctctgcatctttctccatttctgtctctgcatggctaggtgtctttctctgggatttctctctgagactatttctctccttctgggtctctgtttccatctctctgtgtgatctctttgtgtctgtccaactagtctctctggctcttcccttccctctgccttttgcttgctacatttatcattaattttccttgtgcccaaaccctaacttttctttctctccttcttctccccacctgttcacagatcttctggaaaaatccagagttattttccagctgaaagcagagagagattatcacattttctaccaaatcctgtctaacaaaaagcctgagctgctgggtgagtcagagccaccractgagaccaactatctccatggcaacctggtcccctctgcttgtggctggactcagctggcatgccctgggtttcatggcactgctggattcaattcagtgggatgtggggccaagccaagccctgtcctgtgctcttcctcaggccatgtgctgtggcgagcagcctccatgagagccgggggcttgtgtcccaccctaaccatgttttttcccctagacatgctgctgatcaccaacaacccctacgattatgcattcatctcccaaggagagaccaccgtggcctccattgatgacgctgaggagctcatggccactgatgtgagtgtgtgaggacccagccagggggtgggaggattggcagygaggggcaaacagggktccaaaagcagagctaagackctggccattggttgtttaaagtggtatggacctcctgagagccagaatgtgccctgtgatcagggtgtactgrggaatggatgaggtgagacaggactggccagtatctggtgttctatcaaaccaggaagagctgaaasscatgagacagagagacacacaagccaagaaacaagcatcaccgagggagcaggacgaggagggaaggccatgcagacggcatggggctggaggggctgttaggtgaacagatgcagacaggtatggaaggccaggcaggaagcaagtgtagggccaggaagcataagtgggtaactcagaaaagctgtggccactgacactggggctgcggccaactgacgtctgctctgctcttgcatcttacatcctttgttttggagttccctgcatcttacatcctttgttttggagctccccactgggtatgggagtctcagaacccacagggattaaggagacaagttttctctccaacttacaagggatctcacttacccatcatacttctttttctggggtccgccaatatggggcctccctacagaaygcttttgatgtgctgggcttcacttcagaggagaaaaactccaygtataagctgacaggyrccatcatgcactttggaaacatgaarttcaarctgaagcagcgggaggagcaggcggarccrgayggcactgaaggtgggaggcagggattcttgggggcagctgtcaagtcatggagggccatgtctgctcagcagtcatctctcttctcttttttctttttttttttttttgagatggagtcttgctctgttgcccaggctggagcgcagtggcacgatcttggctcactgccacctccacatcctgggttcaagtgattctcctgcctcagcctcccgagtagctggaattacaggcatgcaccaccatgcctggctaatttttgtatttttagtagagatggggtttcatcatgttggccaggttggtctcaaactcctgacctcaagtgatccgcctgccttggcctcccaaagtgctgggattacaggcatgaaccaccacacctggccagcagtcatctctttaccaactttgctacttgccttttccttccagaggctgacaagtctgcctacctcatggggctgaactcagccgacctgctcaaggggctgtgccaccctydggtgaaartgggcaatgagtacgtcaccaaggggcagaatgtccagcaggtgggtccatcttcagatgataatgggtgggcagggtagggagactggcatggtgggatgagagttttcaagttcactcttcccaacaaccctgctcaatatgggtctctcctccaccttgcaggtgatatatgccactggggcactggccaaggcagtgtatgagaggatgttcaactggatggtgacgcgcatcaatgccaccctggagaccaagcagccaydccagtacttcataggagtcctggacatcgctggcttcsagatcttcgatgtgagttgggacccctgggagtgggagaacaatcactcactcgctcccacattcaacagctatttgcttagagccagctgtggaccagacatgggaaggcagtggggactgtgtggtgacagaggcagtcatttwctctgtcttcaggggaagccctccttcactgcyttgacatggaggggaccagccacgccctgctgggctcaggcacagtggacgggcacagccccaatggccactcacacccactttctgactgctcccacccctcatgccccctgcagttcaacagctttgagcagctctgcatcaacttcaccaacgagaagctgcagcagttcttcaaccaccacatgtttgtgctggagcagraggagtacaasaaggagggcatcgagtggacattcattgactttggcatggacctgcaggcctgcattgacctcatcgagaaggtgcctctttggccttaccacctgaattctccctgcacacccaacaagaacaccatagacaaaatagcagcccctctcccttctggggaatataaaaatagaaggggctgaaggatccgagcccttggttccagagcctatgttgtgctgagcacccaggacagggtggcaccagggacagctgatttcccaggggcttgaragtggacacatggaggatgggcacctgcatgatgacctccyacacctgcatgtttattgggcctggtttatgcatccaaggatcaggaagtgtgagggtggtgtaggggatcataagagtgcacctattttcaaccctagcatctcaggcatctgggtcgtggagtggtgtgtacagcatcgatagaatccatattcccagactttcacaaaggtccttctgtcatcagacaaaatcctccaccttgaaccggttccagtcagtagataactgtactcagagctgagcctactaccttaacacccaacatggcacctccacgagcaagtatattgaccatagagcagaatccatgtccacctgtgtgaaggacactcagtgatgctctctcctgcttcctcagcccatgggcatcatgyccatcctggargaggagtgcatgttccccaaggccaccgacatgaccttcaaggccaagctgtttgacaaccacctgggcaaatccgccaacttccagaagccacgmaatatcaaggggaagcctgaagcccacttctccctgatccactatgccsgcatcgtggwctacaayatcattggctggctgcagaagaacaaggatcctstcartgagactgtcrtgggcttgtatcagaagtcttccctcaasytgctcagcaccctgtttgccaactatgctggggctgatgcgcgtaagtagggactgaggctcccggtacagaggagcagggattctgccaaggttctgagccaggtcaattgctacaccccaccacttcaatgtcaggttgtaccccaaggtttacagactcagtgggatggaactgggtgaagaaactgaggcagccacattgaaggccctcacccaggggccaaatgccagcaaggatgtaaagaggggctgtgattctttactcacaccctacctccccacactgatgcttcttttgttgactctccttcctgcagctattgagaagggcaaaggcaaggccaagaaaggctcgtcctttcagactgtgtcagctctgcacagggtgagtgggacacagccccagccaacttggctccccatctgcccaaccccacccagccccacccttccctgccttgttcatcccctactcctcccgttccctgtctccttggtgcattcgggaccattttcactctgtcttctcttcccgtcatctcctggcctcttcacttatttacttcccatctcccttctctcctctttcccttctgtctcccaccctctctccttatccctgtctssccccagggccccttcatctctgtgacttctcgaattctctccatctctcttttccttccttcttctcctctcttcttcctgcatctctttctggcattttctttacttttctctattgcatttttggccacaggaaaatctgaacaagctgatgaccaacttgcgctccacccatccccactttgtacgttgtatcatccctaatgagacaaagtctccaggtgaggccacaaactmrggccaacccactgctgggcatwcaccgccctgggaacaggacctcctaggacatctccctacctaccaccacagtggtttccaaaccacattcttctcctcccatcccgcatgaggcctcccagggtacctccctctcagcgctaccttgcacttgcagtgtgtaatgagggtgatgtgtaaggcactctgatggacattacctcatcagtggccctacaaccccytggatagctggttgtccaagacagaatcttagttcaactttaaatttacctgcagaaccacttaakcccccaatgagacatattcaaattgttaatccatttttggctaattaggagacagaggctcagggacctgggttcaagacctggctctgttcttgatcagcttagtgaacttgggccagtcccrtaacccctctgggcttaatttactcatctagaacattggatatatctgttctggctaccacctatgataatagktgtgaatcatataaaaaaggaatgtgaaagccttttagttaaaaatgtggctagaagaaaatgaaacaaatgattattactaactgacttgctaagattacaagctaatcagtgacaaagccaggatcagaacccagaacttcagtccagtgttctcacagactcctcctacttccttcttgccacaggsgtgatggacaaccccctggtcatgcaccagctgcgctgcartggtgtgctggagggcatccgcatctgcagkaaaggcttccccaaccgcatcctctacrgggacttccggcagaggtgggtatgagggtgcaccagagctcatagaacagggggagccaggctgccctgatgggaatgggatctgcaggtgaccctrgaattctrtgggcagagcagatcactgcagagcatgggtgactctggacacttccctcctcaggtatcgcatcctgaacccagcggccatccctgagggacagttcatkgatagcaggaagrgggcagagaagctgctcagctccctggacattgatcacaaccagtacaagtttggccacaccaaggtgaggaaaggagactaattaattaaaggaagacatctcttttccattgactcctctgatgcttttcctgttgtaatcatcttagcaaaatctcttacctgtatgctacccctcccagtggaacatctagcaccactcccctcatcccagctccagctgccattgacctcctccctgcaatccttttctaggmtgttacccttcctaaggtaatccccaccatctctttccctcgtacccctccctagtcatggccaacacacaccttgcctgcaggtgttsttcaaggccrggctgctggggctgctggaggaaatgagggrsgagaggctgarccgcatcatcacgcrtatccaggcccagtcccgaggtgtgctcgccagaatggagtacaaaaagctgctggaacgtaggtgagagatctcaagaggaggtttcccgcttctctgaggcccaggctggttcaggggcagtgtcaggaaaaaaagctcagcagatcttcaaacacagagacctgcaggaggggctcatatgaacacactgcagtcacagggtcagaggcctcaggaagggtgggagggatgaaggaaatgggatattcccaaggtttcargacctcaggtaggaaggaggcaggaggctcagcactcctttcaatgggcccctgcagagactccctgctggtaatccagtggaacattcgggccttcatgggggtcaagaattggccctggatgaagctctacttcaagatcaagccgctgctgaagagtgcagaaagavagaaggagatggcctccaygaaggaggagttcacasscctcaaagaggcgctagagaagtccgaggctbrcyrcaaggagctggaggagaagawggtgtccctgctgcaggagaagaatgacctgcagctccaagtgcaggcggtgaggctcctgggctactgttggctcttccaccctgctctgccttcacttcccacaaccctgcacctccctgcacaggggctcactgtcttgttccttcagtcagaggactctgggatcaacacttctaaagacctccaaagaggtccctcaggaggaggaaagggcagagggaaaagagctgacttttaaaagcacaggctttctacttgggttcaacctagatacacagcttaattattttgtgaccttgggcagaccakgcatcatctttgagcctcaatttcctctagacagggaataaagctgtccatttcattaagccatcatacataagtgcttggcatcagcaaatgcaattcccacccttcgatggaggagaccagaggaagaggtccagatgaagatttctggttcctttcctctctgctcccctccccagtgttcccaagttatactatcctgaaactcttcccctccccatacttctgaagctcttgccaagtggggatatcctagagttaycctcctatttgagtgatgtgcctctccttccctctacstgcaagaatgaggaccttaccccctgaacagcctcccctctgttcctcaccttcaggaacaagacaacctggcagatgctgaggagcgctgtgatcagstgatcaaaaacaagattcagctggaggcyaaggtgaaggagatgaacragaggctggaggatgagraggagatgaatgctragctcactgccaagaagcgcaasytggaagatgagtgctcaragctcaaaagggacatcgatgatctggagctgacackggccaaagtggagaaggagaaacacgcaacagagaacaaggtaagggcagctccctttggctccagcccgggtctcatcaggactctcagaccatactgaccttgacccaggctagccactyggcatccagagagcagcatggaccttgacatggagctccccacagatggcaccaagctggtgacctttgaccctaaaggagatrggattcttggtcggcaggtgaaaaacctgacagaggagatggctgggctggatgagatcatygccaagctgaccaaggagaagaaagctctgcaagaggcccaccaacaggctctggatgaccttcaggccgaggaggacaaggtcaacaccctgactaaggccaaagtcaagctggagcagcaagtggatgatgtgagtagattgagagttgtggggcctagatatgccatgtctatctgtgcccagagctctgtgtgtgtgtgtgtgtgtgtgtgtgtgtgtgtgtgtgtgtgtgtgtttgtgtttatgtttakaggggggtagggttagaggatgttaacttttctgatatctttctagaaaggagctggggaatgaaaagtcagaggtggtgatcaattctgaattatgtatctaatctcactggtatgatcaataatagagatgagttttcttatttaatttaagtgcaatcccatatatctctgcctttgacacaagatttagagggtcatctcataagaacatgataaatttctttggaaattttgtgaggctccccaagtagaatttttgaaattccaatatttaaggcagaatctgatcattgttccctctgatgcacatatgtctgttgactcacttatcactctgtattttaattatttaagcttctatctcagccataagactacaagcttcctttagataggaacttagatctattcaatttggggactgcagtgcttagcacagagcctgatgcccagtaggtgtttataggatgctgaaagaatgaatacggcggccagccgcggtggctcacacctgtaatcccagcactttgggaggccaaggcgggtggatcacgaggtcaagagatcgagaccatcctggccaatatggtgaaaccccatctctactaaaaatacaaaaattagctggatgtggtggcgtgcgcctgtagtcccagctactcaggaggctgaggcagaataatcccttgaaccagggaggcggaggttgcagtgagccgagatcgcgccactgcactccagcctggcgacagagtgagactccataaaaaaaaaaaaaaaaaaaaggaggaaggaaggaaggaaggagagaaagaaaggagagaaagaaagaaagaaagaaagggaaagaaagaaagaatacggctttggggtttcatcccacagtcatttattcctttatctataaaatattgattcagcatcccctatatctaggcaatctcacagtcccctaataacatttggcccactctggggaaggtttcccaagtcctgaacacaaagatttaccaagtcctgaggtaactgaacaacaaaatcaccaagtcaggatgctttgcctcactgggcctggctccttctctctaccagctggaaggatccctggagcaagagaagaaggtgcgcatggacctggagcgagcraagcggaagctggagggcgacctgaagctgacccaggagagcatcatggacctggagaatgacaagcagcagctggatgagcggctgaaaaagtactgtgtcccctccctgctgcccttcckcctccccagcccataacagtacaagcagacccaakacagccatcctctgaggcaacaacctcacgcagcctccacaagtggaggygcaaaccatgggaaaaggcctcccaggcaagggctttcctcccctagtcccagatatcagggtyagttagatggtcctccctggcaaaaagtccattgtatcccatgagwcctttcttcttgttaggcactcagtgggaatgaaaataacagccttcccccttcatacacatctctctttggagaccagttccttgacatggaggaaggctccacatgagagcctcttaggaaagtccctttgtggcttttcacagagagcccacagggcaccaagaaatgccctcacattmaagaagtcaggggwwcagggccatttctttgttttgcttaacttgtggttccaattcttagtgtaagttcttccaaaatgtatagactttccagacttggtaaacagtgagcttgcagaacatattttgataattgaaggtcttatggtgtttcaggctcaggactttgaaaggctttgagaatcatcataatctacatcctcatcaagtttgtgtttgcacaggaatcttcataccttcccaggcacagaatgtgttgaataaatgaataaatacacgatcctatttgattctcaaaacaccttttaaggatggtatctttaatttcactttaccaaagaggaaaataagtttcagaaaggttagctgagttacccaaagcaatagtgacaaaattaaagaccatcagagctaaaaaggacctttgaaacaatstagtccgaccccctcattttacattatgagaaaacaaggaccaaagatgggaatgtcctgtagagcccaggccccatcaccctgtctacagcactcctcccattacattcttgttggatttcaatctcaccgcaggtgttacacttccagggatcctacatcacccccagaagctgtttttctaatgaaatcctactctttacctgtatcattaccattttcaaccactggtggaccctcctgaggccccacgagtctcccttacctcaccatccctccttccccacagaaaagactttgagctgaatgctctcaacgcaaggattgaggatgaacaggccctcggcagccagctgcagaagaagctcaaggagcttcaggtgaggtctggacacccacgcgggatgctgagtccctgggctggttctgtttcccctgccccctcctctagggtgtcctgttcacagcattacaggaactgattatgtgtccatggaggcaggcacgcagctatcacagtgtgcccatggatacatccaaaaggggtcaggtgatccacagagaccctgaaaaggtcacaggcctggagggcagaattcctggcttcctgtctcagctctgccttagttgggtgacctctgggagcccactccagatctctgggtctccatgccctcccctgttacatggaggtttttaagagtccttcgactctgmtggcatgactttcctccttactctagagcagaagctgtgttaggtctttagttgtctggtcagacaaatacggctctctcattttcaacttttgttatttttttatgactaaactgcttaaaatatccccagaacacaggtctctttgtccatctttaagagcaagtttcaaccactttccttccaataaagagcatgtagactgtcaggccctcgcctaaaggaaggctcttcaaactatcttccccaaatcctttaattcccacctctccastggaagagctaaactgacttgctgttccagagaagccgagagccttttagagccggggggattccagtggaggggtccaggcggtgggtctgagccctttgtgtctgaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaggctctgctcggcctcccctcctccaacttcctcctcccacctcccctttctgtccatgtagtgtctcttccttcatggttcattttcccacttcccttcctctgcctggttctcagatcccctccttcttttcacaccttccctcttcttttctccttcagttgcacctcttacaccccttcattccccccgcccccaacatccatcatataactctccttcccttctcaggctaacctggagaagatgtgccggaccttggaagaccagatgaatgagcaccggagcaaggcggaggagacccagcgttctgtcaacgacctcaccagccagcgggccaagttgcaaaccgagaatggtgagcctagagcaggggctccatggwtcccaccacagtctccccaacctcctgagccactccagcctcgggcacaagccaatacacgcacacacagacacagagtctctccagaaaatggggcctgagggctagaggaggaggtggggatagagaggagtgctgatctagaatggtgcttccccaggtgagctgtcccggcagctggatgagaaggaggcrctgatctcccagctgacccgaggcaagctcacctacacccagcagctggaggacctcaagaggcagctggaggaggaggttaaggtaagggctagactygggccacctggcccaagcaaggagcacactgactagccttgcatcaaatcacttcccttcccagcaataaggctggctgtggaccaacagttctccaagaattctaaaaagaaatcacagcccaaaccctgccacatgccatctactccccaggctgaggccctctgcttctgctgcatccctggacgggaggcagggtgtgagaaggaggagagaaaatgaactagggaggcacgagatggccttgcccgggcacggctaggggatgtagggactgcacaaatgggtcctgggatttgcagggccacctgaaaactggagaaagaaattcaactggagcctattcctagcactttgctggactcatgaaaaaggagaaagaacatgatttttaaaaaactccagggttcatactaacctgcctcttatagctcagtgatcttaggttagggaagtcccctaacctttctgagcctgtttccctctccccagccaggtaaaatggcggtgatgatgaccatgtctggtgtggggaggagctcagggccaatggccatgaagcttttcttaaatagttcactgctgtattggcattctttgttatcagcaaacagtaaaccatgacaggtccactgggggtttggacatagatgaggccaagggatgatgttgagattggggtgaggagaagggcaagggtggggttgctttatggagaaagctgarcccacctcctggtgcccacccctccccaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagtgagttctgagcagcctgacttctggctgaggcccctttgcaggcaggactcagcccagccccagcctcagcagatcccacacaggcgatgcttagctagtgtttgacaacacaggaggactctgccccggccccacctccttctcctctcagggaagctttttgctcgaattatgtttctgatccgaatataagacgwacaaaaggtttgtctgagggcagagtgcttccgtctggggcagggcactgtggcagggaaaggcagtggggagggctgcagaagcccatacctcctcaatgtccatagcgcagaggctgggccagggtcagagggtgcctgggtctccacgccctgctgggatcctctgcctgatgttctcggcccctgggacctgtcctcaggcttctccagctacacttctgaggtttcaaggattgtctttgagaaggttcatgttgtttcctcttkyccccatccacaccctccatcctccccaccctctgccaccctcccctgggcaggaagaagctggcccagcggctgcaggaagctgaggaggccgtggaggctgttaatgccaagtgctcctcrctggagaagaccaagcaccggctacagaatgagatcgaggacttgatggtggacgtagagcgctccaatgctgctgctgcagccctggacaagaagcagaggaacttcgacaaggtgggccctgggtggggsccgcagccagcatgcagggcaagrggrcatgaggggttcagtgagaggccagagccatcctccttggaggtgggggaggagggctgagcccaggcaggtcctgagacagaccctggacatggggctgaggctkgggggctgaagagtgagccttstccccgggcagatcctggccgagtggaagcagaagtatgaggagtcgcagtcggagctggagtcctcgcagaaggaggctcgctccctcagcacagagctcttcaaactyaagaacgcctatgaggagtscctggaacatctggagaccttcaagcgggagaacaaaaacctgcagggtgtgctgggggcccaagaggctggggaggggctgcactggcmgtgttcccatatggtgccacccaagggctccaagaggcgtctgggcaaagaggcrtgtccctccaactccactggacctcagcagccctcaaccgagttaccgtgttccccacacagaggagatctccgacttgactgagcagttgggttccagcggaaagacyatccatgagctggagaaggtccgaaagcagctggaggccgagaagatggagctgcagtcagccctggaggaggccgaggtgtgtgtgtgtgcagggcacggggtgcagggagctgagctccaggmttttggsccstgttctcatcccccgctttgtygttttgttcactgtcccatccccagagcctagracagagcctggcacatagtaggcattcagtgaagatttgtggagtgaatgaatgaccagtcactgaactctcttcayatarrcattttacccattgcatcttagctgagcttcccatttccacatacctcccggttcccacctctgcctccctctgttttcttttatactctatacctgattgcctctgtttccttggcaacacttttytcttcattttcctycttrtcttcatagctggctctcccctgtgagggcctgaatcactttctcttaggcttatttttattttctcttagattctcttttcctccaccttctgcttctttgaaccacttacaccactcttgaagtcacttcgtatccatgattagtgagcaggcccccaccctgccctgtgccctgactgtctgcctgcatcccctcccccaaccccttcccaggcctccctggagcacgagragggcaagatcctccgggcccagctggagttcaaccagatcaaggcagagatygagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggtactcacccagaggggactggcctccacgtggcctggcgaagcagtagtgtcttgatacaggcaccagattcctcctgcccctaggttactgcagggacctctgacaggtgcctttagtgaagggaaccgaggctggctccctgctcatgcccactctcctgatcctcaggacacccagattcagctggacgatgcagtccgtgccaacgacgacctgaaggagaacatcgcmatcgtggagcggcgcaacaacctgctgcaggctgagctggaggagttgcgtgccgtggtggagcagacagagcggtcccggaagctggcrgagcaggagctgattgagactagtgagcgggtgcagctgctgcattcccaggtgagcagctcccctgctsattcctgaagggagcacaggctggggctcagcaagcaaggcttgagagctatgcatagatgctcaatgcttttcctgctctgcccaaccctcccccaacccagaacaccagcctcatcaaccagaagaagaagatggatgctgacctgtcccagctccagactgaagtggaggaggcagtgcaggagtgcaggaatgctgaggagaaggccaagaaggccatcacggatgtaagtcccccactccaccgacccgatccagaccagtgtctctccgtgggctgggcagcaagtgtgtgaggacttgaccagaccatgtgccacctctctcctgcacacaggccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaaygcagagtcggtgaagggcatgaggaagagcgagcggcgcatcaaggagctcacctaccaggtgcgacgggcggtgactccaggcagagccctggcaccatagccacagtgacaaccagctgaggagwatgaagagtttgctcttagcctcttccagggcgaggatgggaatgcagcccccgtttcactttgcctagccctgccccactctgaatgtcccctagctcagaggtcagtctctgagcctcctggcctgggagctccatctcaacacccactcttagcccatcgccaggggacacacacagaattccagacaaagctcacccagtacagctcaccagaaagcaaatatgtagccagggtcacccccaaaagacaccaaaaacacacccatcccattcaaacaagcataadaactttttcattgcccagggcagtgtggactctagctttctgaggtgttttctagaatcagactctgaattagaatttgtttcttttccaatccaggatgtcactatcyctctaagcacactttgtccttaacttagattaagtcagtgttttcctggcctgcattgcagcccaggaaattccatcacactcatagccccaaagtcactcccagcatgtgccgaggtccagagcaggggacttcatccbgcatggggtccccggaccctgaaaaacctgctccctggagcactgcacacacacaattttgtgcataatttcaggagtcccactagttctttggactctttcctggtacagatcatttaaaatatttacacatatttggtaagaaattataaggagaattcaagtgtttagtgaggatcagaaagtagaattggstcaggatatcagatgaagcagggcagggcggaggggatgctaccttctatgactgtgccatcttcaccccctgcctaccctctggcccccagacggaggaggacaggaaaaacctgctgcggctgcaggacctggtagacaagctgcagctaaaggtcaaggcctacaagcgccaggccgaggaggcggtgagtgaccctgctggggaytaggcccaggrgaggcataggagagctcgtcccccaagccaggagtctgagaacccaggccccctctcacctcatgctcccacctcccgcaggaggagcaagccaacaccaacctgtccaagttccgcaaggtgcagcacgagctggatgaggcagaggagcgggcggacatcgccgagtcccaggtcaacaagctgcgggccaagagccgtgacattggcacgaaggtgggtccctcttttgggctttgctagtcacccccacagcaggcatacccagacagagcaccctcaaacccgggatgcttccttttcatttattccacacacttgagccacayggccccagaggccaaggtaatgcagttctctgtgatttcaaggattcttccagctctaactttttttttttttttttttgagacggtgtctcactctgccgcccaggctggagtgcagtggcacaatctcagctcactgcaacctctgcctcctgggttctcctgcctcagcctcccaagtagctgggattataggcatgtgctaccatgtctagctaatttttatattttagtagagatgcggtttcaccatgttggccaggctrgtcttgaactcctgaccttgtgatccacycgcctcagcctcccaaagtacgggattacaggcgtgagccaccactcccagctcagctctaagtttcagtggttctgggaatttcagcsttagggaggggtgccaccctagaagaccctaatttatatacaaccagtatatcccagtttccccccaactgctagtttccagttcccttccacctaattttgtcctgcaatcttgtaactmaaacctaaaatggacatcccagagaacccgggcctggctttgttctcrcccaggcaacttccctctgaccaaccccagaaccctaccctccagaacttgccccccgamcatcgatccctggaaacacatgtgctgctgccacaggggcttccacctgcccacamagcaggccccccaccatcagacccctctcacctttgttcccrtgccctgtccctgcccaataccatctctccaaggactgattggactttgtttcctttcaaaagggcttgaatgaggagtagctttgmcacatcttgatctgctcagccctggaggtgccagcaaagccccatgctggagcctgtgtaacagctccttgggaggaagcagaataaagcaattttccttgaagccragatcctgactccagactcttcttcactgccctgaggacccggggatggggtctggactaggggaggtggaaatgcaggggagtgggggcaaattcaaaggcctggcctaggaggccttcgtggagcagcactgaaaacccctttcacttcccccaaaccagccaaatgcagcagaggcgacacctctcctcccagccttctccctggtccagccaggatttaaaggagatttagggagacccctaaagttcacctagagcaccctgagcccatctactgtggacctgcaccccagcttccgtcaaccctgccccacccaccaccatggatactgcccagggctgggcaaagggcagcggttcggggtgtgggtgctggccagtgccctttctgagcccgcagaagtgtgaaccactgggccaggtgaggcaatggctgcctaagtgccagtcccaggcgagtctctgagagtacacaaggattcacagctgtagcctgcatccccttttaaatagagccaccaccctctccagccaccgccagaagccagcataccccctgcccaccacaggtgggagaaacacaccctcagcccacctgccgtcctcctcagctcctcctggtgccgagcccccttggcccagggtgctcccttcttcccactcatttcttcccattgtaattcccattaccaagccctttgtcctctgggcttgtgggaagatggggttctcctggcccatttatggcaagccatcttgaggggaggcagacagatgaggggctggggaaggttatgtgtgaacaggactctggggagagggagggaagggatggctcccgagagggccaggaggtggaggaaagagtaagtctcctccaactaaacaagttcagcccctttggagttcctgccacagctgggttgcttaggcaggcctgggactgtgggccacagaggtcaggggcttgaaaggcactggggctgtcggccccactgggaacctgggaagcagtggttcagccctggactggatctcccccaacccaccaacatacccactcggagcccactcctgctctgtacccagctctgagctcggagctctgaggactgcggcagccagagccaagggccctaagccggagaaggagaaaccagtactggacaatagcaggtgacagcagaggagaaaaagggggtagggaggggacaaggaaagacctgagggggtggcagtggacaaagagattgagcaaccacaggacaaggtaaccagaggaaacagagacaaggaaaaaagatgcaggaaatgaggaggccccagaaagatccgcaggcgccgccacctttctcctcatagccacctccattctccttccctaggccaacccagacagagctccctcaaaccagggatgcttccttttcatttatccagctcaattgaaccacacagccccagaggccaaggtaattcagttctctgtgatttctaggattctttcagcctttttgtttttgtttttgtttttgtgacggagtctcactctgctgcccaggctggagtgcagtggcacaacctcggcttgggccgagatccctagggccattcctctggctaggaacagacttggacagcaatgaagagataactagaaacaaaggagagaacccttgaaaagggagctatgcagagagacccagggcacctaagcaaccagagcaagagagaccgcaagagatacagatcctatgagaatggtcgggggctggatgcagacagcagggttgagagaggtctgagagccaagccagggagaaggaggggtgctgagggggatggggagagaggaaaagagagggagccttggagggagaagcttgaagagctgcgggtggtgatcccgagtgaaggaaagaatcctgggtcacttgcaaatgcaaggagagtcaggaaggcgcaaggagattggagaggaggaagagcctggagcaagatgtggaggcccagggcgagagaagaggccagctcggagagggcagagcctcatgttagaccctgagccgggtggagacacgggccagggagaatcggaggcaggccccactctgagatggagaagcaggcagagggaatgaaggtgagacagagacagatgcaacggggagccaggcagaagacaggcaacctgtgccagggaggccagccttgcctccttggcaccctcacctgtggccgaagcctccatccctgtccttatattccaggactcccagcagaatgaggagctgtgtgcaaggcagcttagggaggacggagagcaatatgtgagagcagggagagaaggagcctggggaagggagaggacggtacagcggagcagacgggcagggcctggggctgagtgaacaccttccttcctcctccttccacaggagcgggggactaccccccaccacctccactccccgctgccctgccaccaccacctataccaagtgaggcctgctcagagcacagggttccctgaggacaaagcctggtctttgtcacctgaccccgacccagactgacctggcgttctcagctccttatcatgtccccagagctatgggaaccaagcagtgacgcactggccatgggctaaccccccggctcgaattctggggcctcgagtaacctagagctggggacaggtggcctgcatcccctgggggtaatgatttggcataagcacctgcagaagatggggatgtggggtcaactaaggtccctccaaggacattgagaaaaggtccaaatgctctggaaagagaggtgtgttcctgagcccaggaatggggtggcagcgtcctagggagctaggggagaggccacatcttaatggaaagtgctcctacccagagaagctgacccctgtcgtcctacccacctccacaccctggagctatattgagaggtgacagtaaactggtgggaggggggctgggagggtgttcctgggtgtgagggtggggggaaggccagagcaggggagtctggctttgtttcctgaacacaatgtccacttagtcataacaggaacagcctgctgaagacctgacacctacagcctctgagagatggcagcattggaggatggggagcggggccttgagggcctagggtgcttgaggacacccacaaagaagggaatgtgagtataagccctggagggcttggaaaggggcaacaaaattctgcctggggagggggcaggtggcagagccccaccccgatggaatgcagtgcctggggaccagatggtgtaaatccccaggcctgccaggcacctgcaccctctggcagcccggtgaggcagaaggggacagcccctcacccacccccctcctctctcaggccctaggattagcaccatcttcttctgcccaccccaccccaggagcagagggtagcaggggagggcaaaagcctatgtgtgcaaatgcggatgtgcaaatgtgtgcatccatgtacacaaaagaaagtagaaaagaaatctgcaagcttgagtgggtaagtgtgaaaaatctgcatgtgtggctgaagatgggcacagacacggtcaagtctgtatgtgagagtgctgaactggggttctgtgtgaaaatctgcctgaggcggcagggagaatcactgccattgcgtgagcaggttggatgttggccactctatcaggagcattagggaaggggtggggactccagacgtgtccccaaaccagggtggcctcaagaccttgggagaacacttgtctgaagacttggggaacagaaggagaccaggcatggcacttatgcagactgaggccaggacagaatttcctgacaaaagaaaactgagccatggagatggacaacagatcccttccctgggcaccatactgcagcttttagtccctagcactgggggctccagtactaacagcaggaagatgctcccagcctgggactgtgtgagggaggtcagaatgggaaggagaggctggggaacaggggaggaaagcccatggttgggaggcggaggacaggcatttggcctgcaggagaaggtgaccctcacccatgttttcagttcacccttcgggttaaaaataactgaggtaagggccatggcagggtgggagaggcggtgtgagaaggtcctgtcttcccactatctgctcatcagccctttgaaggggaggaatgtgcccaaggactaaaaaaaggccgtggagccagagaggctggggcagcagacctttcttgggcaaatcagggggccctgctgtcctcctgtcacctccagagccaaaggatcaaaggaggaggagccaggaggggagagaggtgggagggagggtccctccggaaggactccaaatttagacagagggtgggggaaacgggatataaaggaactggagctttgaggacagatagagagactcctgcggcccaggtaagaggaggtttggggtgggatgccctgcagcccgtccacagagcccccaccgtgagggacctccttcaccaggagtggggtgcaggtcagttggaggcctaagggctctattaaaactgcctatctccaggcccagggaagttccccctgacacaaggaggttccacaggaaacccagaaacctcttttctccttctctgactctccatttctttctctgcatcattctgagtctcctacatgttgtctccatctttccatcttccttcctcctttggatggcttccttcccttgatcctggttttatcttgcctcttggtcttcatcgacacttgtcacaatcatgcttctttgtctctctcccttgtccttccttcttggcacgtgttctcacctccctgcctctctgcttctaaccctgtttccacaccccgtccctcgcactcatattgactcggtgccctttcttttctgcctctgcgtctttccctttctgactccctggtctgtcctgcctgtctgcgctctggggctgcctccatccccgggtggcctgcctctgttgttcttcactctcctcatctgttcttctctctgcccggctctacctctgttgttccttgctccacccacggtccagattcttcaggattctccgtgaagggataaccaggtgagaactgcccccattttctctgcagagactggggcatgcttctcctgggagccggattgctggaccaggggtctgctgtcccaagcactcagcgccaacccttagcatactccagccaatgccaccccagggaaaccccttacagagattgtccttcagcatcacctcagagggcaggagaagcagagccctgagtaggggagggtgcaacagcaggtgcctctcccagggtggaggagaggagcgggggtagggaggggggctgcagaggacaaagccactcgctggagcctgggctccctcaggagtaacatagccctcctgtctctgacccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaaggtgagtagggcatggcgccggggcagaagggaaggaggtctgggaaagaagatgcagaggtggagccacttgcagggggagctgagagggctggagaaaagccaaggccagtggggatgccaggacatgctcctttgaggagcccagaatctgatccctctcaaattgacctgagctggtgcaacaggtgccacccagggccatgttccccctgccagagaggatgctgaggaagaagaacctcagtgttcgcctaagaggggtcttgtagataaagagggcacaga

SEQ ID NO: 12593 - DNA, 14969 bp, Homo sapiens
ctgaggttctgattggtgagagcgagacccataggtatccagctcttctgaaacggcactgcctcctaagatcctgttctgggattgaggttttcccaggagcacgggaagccaccttgaggccatgtctgccagacaaaaggctaggaaagggagctagtgcagtgaatccgaacagcagggctggatacctaagtgggcagacacaccctgtggccctcagcaggtgcagttgaaacttgtcccaacccaagcccaggtgagcaggaaagcattcactgtggggctccccttccattcacagccaactaggggtaggcacggtgtggcacttccatgccaggaggttacatgtggaattggtcagagctggaatgggaaaccagctcagcctctttctttgtgatcttgggtaagttactaaatttccttgggcctcagtttcctcatctgtaacatggggataatagtttccatgtcatggtttcattgtcgggataaaatgagatgatgcatgcccagggcttagcaccatgcctggcacatgtaagtgcacaggagctgaggccagcaggatatggaagggagaggacgtctgcgagtactgggggcagagggtgaggcagtgagagtggggccatgatactggcctcatcactgttcctgagtgcccctgctttcccagccaccacctgcttcttctaagtgccctccatcccacagttccaggtgccccaagactcatcagagcagagcagtttctcccaattttccagattgccctttgacttcatcacttctctcttttggggctgctttgccctaacgcattggaaagattcctctcactgcagtttaagttattcctggttccctttgttgatttcctagtccttggttactagaggagtattttctaagggaaagcacatgcaaatcaagccacatcattctaggggcaatgtctgtgtatgggtatgttgggtgcgtatgggggatgaggcaggccaataggcaagcatgaagagaaggacctggggggaaggacacactggcccactctcagcacagtgtctcccaagcaggctggacccggctgacctgtgtctttggggtcaagcccaactgtaagcctttctggggcacacatacaccctcctggctaacagtggcccatgtttctggacctgctgaggctgagtgggctcacttcatggcctgaaagcagtagctgaccctgtcatgggcttggtccccaaggctctgtgaatgagagcaggttggttcctggaactgagacctccttcctgttgggtcttaggtgaggctgtttcagtttccctcctcttccttgcttcaccttctcatttgtgcaatggggacactcacccacagcttcttccatcagaccttgcccatccagccaacaaacttaggaagtcagggtcttccagcagccctgtgagggtaggcttgtatccccggtggggggcagtgactggcgagggcaagggggagttagggagtgggtcatggacaatgggggagaagtcatagctgatgggggtcatagaattttggggtcattgaaaatgtggaagaggtcagagaacaaaggggatgggagtcaaaggatgtctaagggaaaggaaataatcacgaaggtggatgatcagagggacacctgggaagaggggaatggtgaaaccagaccctggatggggggagcagggatcatggaaacgaggcctcttgaagggaggccacaagacatttcctaattttggctaccaaaccaaccagggaaatcccgctaatgccagttcacaagaatgcagaacagcagactgttattgctttgaccccatggccagaaaaattcaaagagcaaagtttacccaatcagctaccaggcatataatgatggtcatcacaacttccatgagtattgcattttaagcagcctttggaaatactttcagagtttttttggttttgttttttaacctcaagtcactccctaaaaagacagtggaaataaatttgaataaacaaaacaggcttgctgaaaataaaatcaggactcctaacctgctccagtcagcctgcttccacgaggcctgtcagtcagtgccccacttgtgactgagtgtgcagtgcccagcatgtaccaggtcagtgcagagggctgcctgagggctgtgctgagagggagaggagcagagatgctgctgagggtggagggaggccaagctgccaggtttggggctgggggccaagtggagtgagaaactgggatcccagggggagggtgcagatgagggagcgacccagattaggtgaggacagttctctcattagccttttcctacaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagtgagtctgctgcccctcccgaatgcctgccctgtgtgtgctggccagggtatgcgtgagggaccagggcaattccagcttactttcccattttgatctcagaggggctgtaaaggtttgggagttagacaaggtctgtatttgagtcctagctctgactctcattggatgatcttgagtcaattcaagttttcaaaactcagggtttttttttttttcacctgcaaaatgatataatgccccataggctaatgtgcagatcaaatgaaatataatgtatgtaaaagtctgtatttatgttggttctctccttttcttttaaaacatccctataatggcccatgttttttctgggtaaaatattagggaataatggcatgatacaggcatgaagcatcccaataccaattgatactgccctggccatgaatgggttagttataagcatactaaaggagtgaaacccttaacttttgggggcagctggctggctggagctgtggactggatatctttgatcatgatcatgggtactgtattctttcactcagtgtgccacataaatattatagttctctatttgtgccatgatatgaaaaatattaggaagtgctgaaatatgaatgatgaagcaaaatattaaaaactagggtcttagggattccagacatgtgatttcacttcttccttctagttctgtcttagcattggctttgggggtagatggagaagttcagtggtggggagggggtcagatctaactgagattggatctagtgtggacactacaggtcatgactctttggagtggtctcagaagctggctgggtcctgggccaaatcagatggcatgggagcttcttaggggaggcgggtgccagaggttaactcagctgtcttccagaccccttgctgggagtctgtgaacccgagaaccactcaggtggctttccccaaagtgtgttctgtgcaatgctcatcccatgagctgcttctcagaaaaaagtgatgccaggtaaacttgggaaagactgctgtatctcctaccccttggagattcatactgtcattgtacattaaagtctgcaagaagtctgtagaaagtaaaccgttaaactggtgtttcccaaattcatttaagcacccaacaggtgcaggtgatttattagggaacccactttgggaagtgatgtgctagctaattccatttgccagggcttgtctgtgtggggaatggtcccacaagctggagactgtcgcctgccagactaatggagtcgcagacctgtgggacatctacttttcagtgtttttcatctttctttctttctttctttttttttttttgccatgaaatcctttcagaataagtaaataagtcttcccatgcactctcaagtatgcttataatataagcttgcacagcgtctggaagaatgtgcaggaaatagttgaggatagcttcttctggggagtggggctggtagggagagactattaactttcactctttatactctttaatacttggatgtcagagtggtttttacttttgcaataatgctataataataatagaaacaccacctaaagtccggcccggtggctcatgcctgtaatcccagcactttgggaggtcgaggtgggtggattacctaaggtcaggagttcaagaccagcctggccaaccatggccaacatcatgaaaccccatctctactaaaaatatgaaaattagctgggtatggtggcgggcatcaggagaatcgcttgaacccaggaggtagaggttgcagttgagccaagatcgtgccactgcactccagcttgggtactccgtctcaaaaaaacaaaaacaaaaaatcaaaaaacaaacaaaaacacctaaagtgtaatcattacaataagaaacctcatgctgagtcagatagaagcagtgctggtcaatggaggctaaggcaggagcctgctcaccctcccctgcctccctcacggtcccaggaccagttggaaagcactctgtcacctgctaccctcatttacagtggggaaaatttaataaaggagggaggtgacttgttcaaagttacacagcaagtgggttcagaactgagacaagaggccaaggccccagacggaccatttccttcttctggcactcccatgccaccccaccctctctgtttccggcccatctttccaaggcctgacaagtgccgcccccacaggttggacagagacttgaaccggctcccccaggacctgtaccacgcccgttgcctgtgcccgcactgcgtcagcctacagacaggctcccacatggacccccggggcaactcggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaagcctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatgattctgaggaggaagctgttattgaatgtatagagatttatccaaataaatatctttatttaaaaatggcctaatctgtatttggcatccgtggtgcctgaacatctcgcggtctcccagcctgtcccttctcctttccaccattggccctcacctctgtccaccctgccagctctctccgccctccagagtttccgctgcaccctcccgtcctctcccatctctgtctccctggcccatcccaaacaccagggtgggggctaggccgcgctcccggcatgctggagagacagaggcccattgaggcattgcagcaggcacagagcgcccccttgtcccccaacaatccgcctttgtcctccagtcctggctgctgcagcttggtcctgggggtgctgcctgggctgggctccagctcacaccctccctaaaaggaaatgggagaaaggaccggccaaacaagagggttaaggttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccakcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtaacagctgcctcccaacctggtgcctccatctccctgacccccggctcctggccagccttatgccagcccccagctcacccttcagtakcctccttccccargccctctggacacctctcctgcccgcagctgccccttcttcgtctcctactctgccttcttgctgcctctccacccggagacatttacagcaggtttcagttgcagcaggaaggactgcagttagacagggtgactttttgggacattgaggaagcttgagacatagggatgggacaggggcaatgacagcctctaacatggccacttctcagcacgtccaagaagtctaactatcaaaaagggcagacttcctgcaactgcactttatctgtggtctgctgcccagaaacatctcttctcaggaaaggatcttcccctggttacttagcaagaccacagtgtagagttaaggcctctgcacgtatgccaccctaggtcatcagagctaaaggggctcccagaaaccactgggcagcatctgccttctctcttggcatggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatytgcttcacggcctccatctctgcctacatggccgcggcgctactggagttcttcatcacacttgccttcctcttcctctatgccacccagtactaccagcgcttcgaccgaattaactggccctgtctggtgaggaaccctgacccctagcccagtttggggcccttccctctcctctaaatgatgcattttcctttcctccccgagcttctttccatttccacaccacagctgggctttgtcccatgctatgccctgcactcaaaggtgtgctttgactcacactgatttcacagctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgtgagcgctctgtctcttgaatgtgcttcatattgtgtgaggggtatcctatggaggggttcagaatccctcagggtcgggctgctggctagcctggaaaacttcagggtaacgccccctgccttctgaggtcctgttaaccctgcacccctggcccccaggacttcctgcgctgtgtcagtgccatcatcatcttcctggtggtctcctttgcagctgtgacctcccgggayggagctgccattgctgcttttgtgagttcagccctgcaggactccttagcccctcaagagctcaggctggtgcttgcacactttctgtatcagaagccacagccaggacttggggttctggcttgcacctcaccctataccttaacccaatggccctatagcctctgttttgccatccccactcccactcccacaggtttttggcatcatcctggtttccatctttgcctatgatgccttcaagatctaccggactgagatggcacccggggccagccagggtgagtgcctgtgctctgtggagaggagatgccctccccaccctagctacccatcctgatgtgggtccctacctggctctatcctcacaggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctactggtgagtctctttcttccccagaaattaggcaggtcaggaatgtcaaggagtattcatgggaatgttgccagagcaggtcgtggtctgtctctgggactgggtctgagcagtgaggatgtgggggctagccagaagaagctgaagacatcctccaacacaaaacttctacgctacacctctgtgtgcacggccactttgtggtgtgcctggtggctgggcatctggagttctgtgtctgagaaggcacagccttcctcatgggagcatgcatgcaccaccacacctgttcccgcaggttagtgggctggaggccaggcgctcgcctggggcgtgtgcagagctcccccttgtggtgtggggaagacttggcccacaggacgcagggagagggcagcctgaggtatcagaggagggagagatttcccaaaatgcgaatgctgggagagccgttgattatcagctggtccaatgccctcatttcacataagagaaaacaggcccagccaggggaggtgaactcatttgtgacagagctagggccagaacgcagctcttctgacacctaagcgagtgttctggatactgtactgagcctccttgtagctcagaaaagaatggccaactcttccctccactgcgggtccaccctcccagcttgccagctcctcagcacacatttcctgagcatctcccatgcacactgtgctgggtgccagggcctcagaggtgacggggggcctgccctttagcactcacaggctgggaaagagacaagctggtcaagagctccccacagtgaatgctatgggaaggctcaggggagtttggagcagacactgccacagcccgggagtcagccctgctgggccgagacagacagatgtgcagccagacgttcctgcccagcccgaggagcccagcatggcctggctcagcagctccatcccagctgacgtgctatctcctgtcgctgatgtgtgtgtgttcccgccctgagatacaatccttcttctggagcgctccttccagctgcaggccccagctcccaagtcctgcccgaaccctggatcttgaactctggtcagagcgctctgcttccttggtggcagccactcctctctcttggtctttttcctgcctcctgcttcctgttctcctatccttgtgtcctggctcaccatcagaactggcagcctctcctgggctagaaccaacaggattttgtgtttctctggtcactgctcacatttctcagggctttatgcacagtccattctcatggtctcagaggagggatagaagaggctccacttggggagtcagggagatggggtgccaggtgaacggttaaggaggcggtcagcagagcctggctgcaaagcccagtggggagtggggatttgctttgtgcagaacggggtcaggaccgggcctgtcccacaagcagctgtgtgatccaggccagactgtccccagtaggagcttagagagagcagaaatgtgaccacagtgtttccctgtacaggcacctgtgccatctgtgtctgtgtgagaaccaacatgaaatgagcaatgcccaggcttggtcctcatggcatattggtttgggctcagtgttgattggccccagagtctcaagatgccctcacggtgaggtgctgaatcataggaggcagggggagacccctggggaagacagggagggggctccctgggagttacttcctaggggctgactagaatggaatctctcccatctcctttcccataccttaattctcagccagctctgagccttttctggcattggtggaaaattcatttcagaaagaatgggtgtcctaggacacctttaatcattgcagcctcaggggtggggtaggtggagagtggcttcaacttcggcaccaaaattctatctcgtagcatcttggactggctcaccattttgatgccattgttttcttcacttttgaaatttctccctctccacccttgtgtggttgactgagcagaactgggactcacagctgtccacgtcaggcagaacacctcactcctctgcacctcggtctccttccttgtggatatgggatgccttggctctggcagctctgatacaggggctgggggcctccctcctctcaggccccctactgccctgatccaggatggacagctggcaggaaggacagatgggctcaggcagagtttggcactcatatttattacaggttggcaagagtgaggttcccgaggcagtgtcactcctcatcgtgcattttttgctgcaaaaagaataagaggtgtgagggggcagctggcaagagggagaagtgtgtggggacaaatccctggggctttcagaggcctaagggagatgcccttggagggagaggcagggccccagggatcctgtggtcccacgttagaggcacttgtggtttagggggatggaactggggatctctgcagaagttccagtcagtggggggctgttttgagcaggagagtggattctcaggttatgtaagctatgggaccctcagaactgcctacatatagggcaagcagtgcccactctgaagggcacccatatcagggggcatgctaatgtggaagtgactagtgaagcccaggggagggacccaccttggcaccaatgtcacggctcttggctcgaagcttgttgacctgggactcagcgatgtccgcccgctcctctgcctcatccagctcatgctgcaccttgcggaacttggacaggttggtgttggcttgctcctcctgtggtgggacagtggggatgggtgaatgagctggagatgggctatgggattctcagcctctcaacctgaggttccagctccctgtccctgaggcacccatgcctcatgcatattcctgcaacagccttcccaagggtatcctgcaactgccttgcactcttctcaaacatgtccagcactcagagtccttcacggccatccactgccccagacaaatcccatgctgcccgatctgggccccttcagaatcctgttttgctgcacctgtcccggaccccagcttcctgtgcaggcatgctaatcagcaactcacatccacccagatgtcttccccactgccctgtggctagctgggtccccttctaggcccaattccaccgccaccttcctgccttcagcttcggctgccccacgtcctgcactagcatctacactgccttctgttgggttatggtatctgaattgtaagcagcttgtaggtggtgcctttgttaattcagaacacctgacagctctgagcataccagatgtgtcaaacaaatgtttgagagttaaagtttatagcaaactctttgtccaggcccctctgtaggagatattcattggttctcacaaatagtaggtgtgttgatgagaaagggaagaaagctctgaactcaccgcctcctcggcctggcgcttgtaggccttgaccttcagttgcagcttgtccaccaggtcctgtagccgcagcaggttctttttgtcttcctctgtctgggggtgggagggtgggagaagctggtttggagggggagcaaatgcaatcacctttccctcctccatcattttactcttctccccttgcctttgctgcccctccctgcaatgatccaggtcaaagaggtggtggggaagattctctgactctatcgtaggtcaaaggggcaatgcaaggttgtcagtcagggatccacagagcaatgaaggctgaagtcataaagctagaagtagggggaggggctcagaacctaatggaattccctaatgtggtaatataaaagcaccaggtctgttccagctccagtatggtggataaagctccaacctggacttacataggttctcttggccagtagttcttgaccagaaaaagaatgcagaaagaagggggtattatcataatccagattattctacattctaatatattgtactgggccagaattcaggcatcgggatcactggctccaacgtcactcgatcattcctatctctttatcattgtatgtgccaggatgccatttctacttctgtccacaaatcactctgtggttctgtatctgtaacctctttcttgtgcctctggtatccatctatcaaatggactgacaccctcgtctccttggccttttcttcccaggtacactgaaaataacgggccaagggcacagctctcagctatgcaagtggaggttttagagcattctagggtcctctttctctgtggccttctctttgtgtgccagaagttctatggaagatttccgggtcttttcccctcccctgactcttatccccacagtcgaaggtggaaggattctttgaactgttctgaagtcttcatggtagcacttagagttattaaaaaaaaaaaaaaagaaagaaagaaacctggggaaagactagttagaagagttttcaggaagtagaagtagattcttcatttgctggaaaaactcatagactcaagtcaaactgactgcagagcgtgagaagaacgttaaatctaccaacagcatctcaaggaggaggtgagaggagccctgtgagggcggggcagtggggccagagaagaaacttccacatctactcctggtgtctggcgtccgccgcacctggtaggtgagctccttgatgcgccgctcgctcttcctcatgcccttcaccgactctgcgttgcgcttctgctcggcctccagctcaccctccagctcccgcacccgcgcttccagcttctgcagctgcttcttgcctcccttgagggcgatctgctcggcctcgtccagccggtgctgcaggtccttaatggtctgctccatgttcttcttcatgcgctccaggtgggcgctggtgtcctgctccttcttcagctcctctgccatcatggcggcctgtgtgcaggagagaggtggcaaggaacatgggccaggggccggggccttttgccccccaaggatctcctttctcccatcaggccctcaaatccacagaactgcagagttggcttggtgttacagcacagtggcctggcctggacccaaggccttgtttctgtctttaggggaggcggaaggtgggcggtcacttacatccgtgatggccttcttggccttctcctcggcgtttctgcactcctgcactgcctcctccacttccgactggagctgggtcagatccgactccatcttcttcttctggttgatgaggctggtgttctagacatggagagagaaaaatgatcaaatatatactacactttgttacctgatttcataccctttctccagaaagaattaaaggtggtcattttttttttaaaacaacaagcccacttttagactattgatcgttttgtacctgctttcccttttcctatgaaagtgcatacattctagacattgtatctaagattactaaactctgaaaaaagacttcaaatagcaaaaggtctgcagtattaccctggagctctttagcaacatgtttacgtaggagcatgacaatattccaaggaagatggaaacaactttttaccaggacaatattccagagatgtttatagctataccaagaatgtagtggggtaaggaagaggggatgaggtaagtggatgatgtcattctcacacatactagattaaagaacaaaactccacagggcactgcaaaaggtgagcacaaagtctcattgcagagtataactgaaaacagtgtgggtgggattgcagaaaatggtgttctagccagcttggtttgcaagagatgcagttatgcttctttaaactcccaaactctcatctttacagagcaagccggaggctgtctttcagatcaagaatatcaaataacaggatacattccactactcccagatttgtggctttggcaggtatcagcaatcaatcatgaccctcttagcttctaagtagagaccgctttcttaat

SEQ ID NO: 12594 - DNA, 13622 bp, Homo sapiens
gtagtggcgcgatctcggctcactgcaagctccgcctcccgggttcacaccattctcctgcctcagcctctcgagcagccgggactacaggcgcccgccaccatgcccagctaatttttttgtattttcagtagagacggggtttcaccgtgttagccaggatggtctcgatctcctgaccttgtggtccgcccgcctctgcctcccaaagtgctgggattacaggcgtgagccaccacgcccggccagtctccatgttttcacaactctccaattcttctttatcagtgcttccaactatccacttattagttagcctttgatggatgtctgcttccctatgggactgtgggcaccaagagggtaggaaccagagtgtttttgctcattaagacaactcaatacttggcacagtgcctggtacattgctagtgcacagtgaatatttgttgaataaatgaataatcagtaactttcaaagggggttcttaggtggagctttaatgggaagcgtcagtgccattgcctgggctctgggggcagctgtgagtccagatctcatggcttctgttcagggcctggtccacatccagcctctgaccttgtgcccaaaggccattcaggcaaaaagaggtggaagagtcttctcctagagggaggtagtgcaaaggtggcattagagcattaaggtggctcggatccagaatcttctccccacttttccactcctccaacctgagtttgcaaaagcactaccttccactgcccccatatcttcttcttgtggcctattcttcttccctcccagaggtttccttcccctcaaaatgtgccgcctcccttgagctgtttccaatgttgtgctcatgaacttgaacatcattctctcttacctggtaaagcccccaggaagagacgcccttgaggcttggcccagaggttaaggaggggagccaggcctaagggaggcagggcaagggccttcatcttcgacccttggctcaagaccaccctggacatactcagcttcagctgaagagggagtcccaagaccaggggcagatccagccctggccccgacccagaagacaacaccaccttctgcagagtgtgtgggaaagggacggtagagagagagggaagaatgagccgggcctactgcctgtggcctcacccctagctgccttaattctgcctcttcgctatgcctccacctactggccattctcaccacttaaatcctgccccaattttttttggcttgaccctttttgaaaccacacctgccccaagtaaatatgcagtctaagtcaaaactgtttgcttgctgtggggagcttcaagatatgtccctcgcccctaccacccacctgagtgccatccataagccttatttttatttttatttttttgagacagggtctcactgtggcccaggtcagagtgcagtggcacatcatagctcactgcagcttcaaactcctgggctcaagtgaacctcctgcctcaggctcctaaatagctagggcagcagacatgtgctaccatgcctggctaatttttttttttttttagacagaggtctctgctatgttgcccaggctggtgtcaaactcctggcctcaagtgatcctctggtcttggcctccagcacctgggattacaggcaagcaccaccatgcctggctaattattaatgaaaaacaattctgtggagccagtcttgttatgttccctgggctggaaaccttcctaatattgacatgttggactcccctcttccctcattgctccaggctccactgaatacaggcaatgccccactgtccccctttacttgatcttggaggtggagactgagccaagatgggttctctggtgtcccaagagcaaggaggtggcctgagcctgctgcctgcttgagtcccaggtccaaagagaaggcccagggctctgcatgaggctggggaatgtctgtggggagaaatgattatcctgaggcctcaaagctggggtctcaaggaggaaaggggccagtggtagagggggacagaggcaggctgagctggccagggtgggaaaaatagactccgaggaaatctacctcggagattgaattctgcctgagtccctggagggagaaatatcccgggatttgattctacatcacagcttctgaggctagtgggggcagatgctgagatctcggcctgtttgtccagccaggaatcccggcgcaggcagccatccagggcaggaaccagctggagtgtgacagagataagatacggggatgtagaaatcagggcatcggagccgcagtcccgacctccctgccctcagttgactcccctctgagcatttggcctcccccttgcagctctcaacccttcccttctccctaaaagtgtggacttagattcccacggccagccacccagcagtgctttaccaagtcttggctagggttccacccctggggtgtagttaccggcaaccgaaggttggaagcggggaagagcagccccccaagcgcaatcctcatgatgggatggcgtttgctggtcaggggcccagagacctgtctcaggcgcagcacctcctccccatccacctccagcagcacagagtccccctccatcttgacttccacctgcaggaaggtgggaagcaaaatcagaggcccctgggatctgtttctgccaccttcctgtgaggcagcctagtactatagtggaaagaacatgccttaaagaagcagctagcatccttggccttgggtcactcagctcttgtcacttatatactgactgagccttagaattcccatcagaaaagatggggccaagaatagctactttgtgggggttcgtgtggattaaacgagatgacagtggtaaagggatgcccaataacttggttttgttccctttcctcagaccagctccagacatccctcccctgaggaccagagctagcttacctggtgccatctcccatcatccagccgtggtccagcacccaccgtaagctgggcccagtgattgtgcagttggatctcaggcctgccgtctcgaagtcccagcataaaccagtcatccttagggttggtatccccataaaaaatcactccctctgggtcccaggttcgaacctcaaaggaggaggaggttctggaaggacacagaaggaaagattgtgtatgtcatgtgtcctttgagaaccagtgtgggtttgggggagatggtgttcacagataaggaaaggaagacagggaaaagagaagagctgatggagagagggcagaaccaggggactgggtcaagggctaggccaaccccatactttgtgatcttggtgaggtcaaaggtcatgacagcgataggctcttgtcctgggccattgctgaggtggacagccggagggtcgtgggcactctatcagaaagagaaaacaaacaaagctgagtagggacatgtcagagacagacagagggagaggccctgctacagggccagaggagagaagggaagactgcatgagctgagtgccctgtcccgctcctgcacctgggtggggagaacaggtctcagggcccatccctggcgggtgtgacgcagtagtagcaacagcagcaacagcagcaggcgcgaggtagccagtgggcctctgctctccataatcagccactgtccactcggcggctcagacaactcttgggagaatgtgtagaggcaggcagccttgcgtgtgggcggtggagggttaaaggttgcccggggaggagggggtaaaggaaacaggggcactgacccttgacccctgcccaggggcccagtcacaagactcagctatcacccctctggggatcaatggggtgaaggacagagtcccctccactatcatcctccactgccgagaaagtttctgaactgggagaggatattccatctcccctctcctcctctagggcctgatctaggtcctccaagatttctgtccactcggggagcctgcattcacaggcctgaggtctagaaacagtcctcccctgcgtcccaagtagcatcctgtatcaggactagaaatgagataatggaatcctaaatttctagctgagtgaccttgggcaagtcacttcacctttgtgcttcagtgtccttgtctgtaaaatgaggaaaataatactttacggggtgactgtgaaagagggttcattgagaaaatgcaggcacagtgcctggcatctggtctgaactcctcccccagtcttttcccaggcctctgaggcctgtctcccaagaaggtattgtctgtgtgtatgattcagtgaatattaagaagggacctgccccccgcctctcagttatcttcccttatccatttattacagggcctaaacagtctagcagtagaaatcacccactccctgacccattttattttattttattttattttattttattttattttagacagagtcttgctctatcacccaggctggagtgcagtggcgtgatctcggctcactgctgcctctgcctctcgagttcaagcgatcctcctgtctcagcctccttagtagttgggactacaggtgcacgcaccaccacgcccagcaaatttttttgtgtttttagtagagacggggatttcaccacgttgcccaggctgatctcgaacctctgacctgaaatgatccgcccacctcagcctcccaaagtacctggattacaggcattagccacaaggcccgaccctccctgacgcattttattttatttatttattttgagatggagtttcgcttttgttgcccaggctggagtgcaatggcacgatctcggctcactgtaacctccacctcccaggttcaagcgattctcctgtctcagcctcccgagtagctgggagtaaaggcatgcgccaccacacctgtctaatttttgtatttttagtagagacggggtttcaccatgttggtcaggctggtctcaaattcctgatctcaggtgatccgcctgcctctgcctcccaaaatgctgggattacaggtgtgagccactgtgcccaccccatgacccattttaaaatgcaaatgacagaccgggcttggtgggtcacatctgtaatcccagcactttagaaggctgaggcgggcagatcacttgaggtcaggagttccagaccagcctggccaacatagtgaaaccccgtctctactaaaaatacaaaaattagccaggtatggttgcccatgcctgtaatcccagctactccgagggtgaggcaggagaatcgcttgaacccaggagggagaggttgcagtgagccgagatcgcgccactgcactccagcctgagtgacagagtgagaatccgttaaaacaaaaaaaaagagaagaaaaaagaaaaaaaaattagccgggcgtgccggtgcgcgactgtagttccagctactccggaggctgagacaggaggatcgcttgaactcgggaggtggaggctgcagtgagcagagatcgcgccactacaccccagcctgggcgacaaagcaatacaccatctccaaaaataaataaataaataaatataaaaataaaacatttaaaaaatgcaaatgcccccaagaggtaacacttcatgctactcaagagctgcaggaaacagctttcagagctgagggtcttaaggcttacccagggtctgggcgggtgagtgagcctgaggctaaagcaggttatcactgcatatgtcaatttaaaaagcactgcgggggagcctttgaaccgcggggtatctcgacccaggttgggacacccacacaaccgcaaggaagccgcttcactccaaccttgaactctacccaggagcccagtcacaagatccagctgtcgggggtggggcttggggggggacgcggccgtgcctgttctccaagctgattggctgacagttgtgccccctgctgcgacagaattcgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggagacaatcctttctatcaytgtttggtagcagagattcttccagcgcccgggaagctactgggtaagagcacctggcccttagaagtccacctctccagccggcctcagaggtctccccacaggcttccagaagccttactccccttttctctctctcagggccctgcgtggtgggctatgggatatactatttcatctacagtacatggaagggacgcaccatttatctggaggatatctatgtgatgccrgaatatcggggtactgggcagaagctgaggctggggtgggagcaaagcaccccacagaccccactgttatcccctgtccccagagcccagccggtgtcattttctgatccccttcagctcaaasaatagctattttttgcctctttctctccacaacaggtcaagggattggttccaaaataatcaaaaaggtggctgaggtgaggagatgggtggggcgacaagtgaggacctgaagaagcaagggtatatggaggggggacccgggttgaaagagggagtgagaaaacctttttcttttttgaccccagaaaagttagtgttgtcttctcccacaggtggccttggataagggctgctcccaattcygcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctgatgtggtgttgggtctttcttttatttctttttttttttttttttgagacagagtctctgtcgcgcacgctggagtgcagtggtgcgaactccgctcactgcaacctctgcctcacgggttcaagcaattatcctgcctcagcctcccgagtagctgggactacgggtgcgcaccaccatgcccggctaatttttagtagagacggtgtttcaccatactggccaggctggtctccaactcctgatctcgtgatccgtccgcctcggcctcgaaaagtgctgggattactggtgtgagccactgcacccagtccaaagtctttttttttttttttgagatcaagtcttgctgttgtcctcaggccagagtgcaaggagtgcaaaggtttgatcttggctcactgcaacatccgcctcccgggttcaagtgattctcctgcctcagactcccgagtagctgggattacaggcgcctgctaccacatgcggctaattttcgtatttttagtagagacggggtttcaccttgttggccaggctggtctcaaattcctgacctcaggtagtccgactgcctcggccccccaaagtgctgggattacaggtgtgagccaccgcgcccagcccacagtcttttctttttctttttattttttttgagacagagtctcgctctgtcacccaggctggagggcagtggtgagatcttggctcactgcaagctttgcctcttgggttctcaccattctcctgcctcagcctcctgaacagctgggactacaggcccccgccaccacgcccggctaagtttttgtatttttagtagagacggggtttcaccgtgttagccaggatggtctcgatctcctgacctcgtgatccacccaccttgcctcccaaagtgctgagattacaggcgtgagccaccgcgcctggcctgacagtcttcattttcaatctggtatgccctacaaaagctcatgcctggccgggctcagtggcttatgcctgtgatcccagcagtttgggaggccgaggcgggtcgatcatctgaggtcaggagttcaagagcagcctgaccaacacagcaaaaccccatctctactaaaaatacaaaattagccaggcgtggtggcaggcgcctgtaatcccagctactcaggaggctgaggcaggagaatcgcttgaacctgggagatggaggttgcagtgagtcaagatcatgccactgcactccagcctgggcaacaagagcaaaactccatctccaaaaaaaaaaaaaaaaaaaaaagctcacgcctgtaatcccagcattttggattttgggaggccggcaaattgcttgagcccaggagttcaagagcagcctggccaacataggaaagcaaagtctcgtctctacaaacaatacaaaaaaagccagcacgcaatggcatgctcctctaggcccagctactggggaggctgaggcatgagaatcgcttgatcccaggaagtggaggttgcagtgagccgagatcatgccactggactccagcctgagtgacagagccatacccagtctcaaaaacaaaaacaaaacagcaacaacaaaaatctcaacactttgagaggttgagggtggaggatcacttgagcccaggagttcaagaccagcctaggcaacatgggcaagaccacatctctacaaaattaggccgggtgcagtggttcatccttataatcccagcactttgggaggcaggcagatcacttgaggtcaggagttcgagaccagcctggccaacatggtgaaatcccatctcaactaaaaatacaaaaattagctgggtgtggtggcacccatgtaattccagctacctgggaggttgaggcatgagaatcgcttgaacccaggtggcagaggttgcagtgagctgagattgtgccaccgcactccagcctgggtgacagatggagactctgtctcaaaaaaaaagaaaatggccaggcgtggtggctcacgtctgtatcctaacactttgggaggccaaggcgggtggatcactggaggtcaggagtttgagaccagcctggcgaacagggtgaaaccctgtttctactaaaaatacaaaaattagctggtcttggtggtgcaagcctgtaatcccagctacttaggaggctgaggcaggagaatcacttgaacctaggaggtggagtttgcagtgagccgagattgcactactgcactctgggcgacagagcaagactctgtctaaaacaaacaaacaaacccaaagaaaacaaaaactaaataaataaaatttgcccaggtcagtaacaaatgcctgtagtcccaactactcaggaggctgaggtgggaggatcacctgaaccctagaggtcgaggctgaagtgagtcacgtttgtgccaccacactccagcctgagtgacagagtgagaccttgtctcaaaacaaaaaaaaaataataggttgggtacagtggctcacgcctataatcccagcattttggaaaaccaaggtgggtagatcaatagagtccaagagttcaagactaacctgggcaacagggcaaaacccggtcactgcaaaaaatacaaaaacattagccgagcttggtggcaaatgcctgtagtcccagctactggggggctgagatgtgaggacggcttgagcctgggaggttgaggctacagtgaactgagaacctgtcaatgcactctagcctgggtgacagagcaaagccctgtctcaaaaaacaaactttaatcactaatgcagaagataaaagagtataaactaggaaacttaatacttccaaaattttgtttgtttgtttgagatggagtttcactcttgttgcccaggttggagtgaaatggcacgatctcactcactgcaacctccacctcctgggtccaagcagttctcctgcctcagcctcctgagtagctgggattacaggcatgcgccactacgcctggctaattttgtgtttctagtagagatgaggtttctccatgttggtcaggctggtctccaattctgacctcaggtgatctgcccacctcggcctccaaaagtgctgggattgcaggcgtgagccactgtgcccggccaatacttccaaaatttatcttgcccccatcttgttttgtctttggttttcagagtttactttttttttttttttgagacggagtctcgctctttcgcctaggctggagtgcagtggcgcgatctcggctcactgcaagctctgcctctcaggttcgtgccattctcctccctcagcctcccaagtagctgggaccacaggcgcctgccaccacgcccagctaattttttttttttttgtatttttagttgagacggggtttcactgtgttagtcaggatggtctcgatctcctgacctaatgatctgaccacctcggcctcccaaagtactgggattacaggcgtgagccaccgtgcccagcccagggtttacatttttaatgttattaccctcaccttggtcccagatcttactaatattcatagaatatctttgcactccagtatcactccattttcacaaccacccccatgtctacatccttgggctccagcccattcatcacttcattagccatctataaaatgatcctggccaggccaggcgcagtggctcacgcctgtaatcccagcactttgggaggccaaggtgggcagatcacctgatgtcaggagttccagaccagcctggtcaacatggtgaaaccctgtctctactaaaaatacaaaaattagctgggcgtggtggtgggcacctgtaatcccagctacttgggaggctgaggcagcagaattgcttgaacccgggaggtggaggttgcagtgagacaagattgagccactgcactccagcctgggtgacagagtgagactccctcttacaaaagaaaaaaaaaagtgatcctattaggtgttggggctgattggagtggggtgaaaagggcctgggttctgtccattctaagggaaacagagtggagggtatttaggctaatggctttttaaagggagaataaagaaaacttgggctgggcgtagtggctcacacctgtaatcccagcactttgggaggccgaggcgggtagatcatttgaggtcaggagtttgagaccagcctgaccaacatggtgaaaccctgtctctactaaatacaaaaaaaaaaaaaaattagccgggcatggtggcgcatgcctgtaattccagctacttgggaggctgaggcaggagaatcgcttgaacccaggaggcggaggttgcagtgagccaagattgcgccactgcactccagcctgggcaacagagcaaaactccatctaaaaaaaaaaaattaaaatgtctctcaaatctgtccatagctctatccttacttgcaaagttctcactctttgaaaattgccacaacctccttactggtctcccagcctccttctgtaatttctcccccaattccatgggattttttttttcacagatatacattatgtactttattttattatttaaatttaatttatttctttattttgagaccagtttatgcagctggttttttttttttttttttttttagacggagactcgctctgttgcccccaggctggagtgtagtggcatgatcttggctcactgcaacctctgcctcccaggttcaagtgattctcctgcctcaacctcttgagtagctgggattacaggcgtgcaccaccacgcccagctaatttttgtatttttttttagtagagatgggttttcaccatgttggccaggctggtctcaaactcctgacctcagatgatctgcccgcctcagcctcccaaagtgctgggattacaggtgcgagccactgtgtcaagcccataatttttgtatttttagtagacatggggtttctccgtgttggccaggctggtctcgaaatcctggcctcaagcaatcctccatccacataaatgataatacatttgcccacgtggcgatcaaatccacaaccttggtgttagcacctggctctaaccaactgagctaactggctattgcaaatcttgatttttttttttttttttttttttttttgtgacagggtcttgctctgttgcccaggccaagtgcagtggtgcgatcatggctcactgcaaccttgacctcctgggctcaagtgattctcccacctcagcctctcaagtatctgggatcacagtcaggtgctatcaagcctggctaatgaaagcaaaatttttgtctgggcacggtggcacatgcccgtaattctagcactctgggaggccgaggcaggtggctcacctgaggtcaggagttcgcgaccagcctgactaccatggtgaaaccctgtctctactaaatacaaaaaaattagctgggtgtggtggcacatgtctgtaatccaagctatttgggaaactgagacaggagaatcacttgtacctgggaggcagaggttgtagagagccgagattgcaccattgcactccagcctgggtaacaagagcaaaactccgtcccccaaaaaaacaaaaaaaaaaattattaatctgggcactgtagctcacgcctgtaatcccagcactttggaaggctgaggcgggtggatcacttgaggtcaggagttcgagaccagcctggctaacatggtgaaaccccacccgtctctactaaaaatacaaaaattagccagatgtgggggcaaacggctgtaatccaagctacttgggaggctcaggcaggaggatctcttgaacccgggaggcaggggttgcagtgagccaacatcgtgccactgcactctagcctaggcaacagagtaagactctgtctcaaaaaacaaacaaacaaacaacaaattttttattggagactaggtctcactatgttgtccaggctagtattggactccagagctcaagcaatcctcccactttggc

SEQ ID NO: 12595 - DNA, 13818 bp, Homo sapiens
gaggctgagatggaaggattgcttgagcccaagaagttgaggctgcagtgagctatgatggtgccactgcactccaacctggatgacagaacaagaaactgtctcaaaaaaaaaaaaataaaaaaaaaaaaaaggtcaggcacggtggctcaggcctgtaatcccagcactttgggaggccaaggtgggaggattacttgagcccaggcagtcaagaccagcctgggcaacacaaggagaccctgtctctaaaaaaaattttaaaaattagccaggtgtggtggcacatgcctgtagtcccagttactcaggaggctgacaagggaggatcgcttgagcctgggaggtcaaagctgcagtagccatgtttgtgccactgcactccagcctggataacagaacgagaccctgtctccctgtctcaaaatattaatgtgtgtgtgcgtgcgtgtgtgtgtgtgtgtgtgtgtgtgtgttttggtctccatcctggctcctggccagacctcctaaagcccttgtaatttcctaaatgataaagtgaagggagcttttgttattcataacaagctcttttcaaccacaactgagtttatgttagtaagttgacttttagaaagcccctaaggttggggtttgttgccaaggtaggcaactgtgtgattagagagttagaacttttagctccaaccctctgacctccaactaatggctattgaatcaagtatgcctgcataatgaagcctccataaaaaaaaacaaaaaagatgagggttggagagctgccaggttgatgaacacatggaggtgcagggaggtgcccagagaggacaagaaagctccaaatcccccttccccgatactttgtccggagcaactcttccatctgactgttcctaagttttatccttcataataaactagctaacataagtaaagtgtttacctgagttctgcgtgctattccagcgaattactgagccagaagagggagtcataaaaacagttaggaggcctggacttgtttgtgattggtatctggagtgggggcagccttgtagaactgagcccttcaacttggggattagataactggtaattatgggtagagtgtcagaactgaattaaactgcaggactcccagttaatatctaccaagaactgaagaattgattggtgtgggagaagtctccacatgattggtgtaagaagtggtgttcttggccaggcgcagtggctcacgcctgtaatcccagcactttgggaggccgaggcgggccgatcatgaggtcaggagattgagaccatcctggctaacatggtgaaaccctgtctctactaaaaatacaaaaaattagccaggcatggtggcgggtgcctgtagtcccagctactcgggaggctgaggcaggagaatcacttgaacctgggaggtggaggttgcagtgagcagagactgcaccactgcactccagcctggccaacagagcaagactccatctcaaaacaaaataaaacaaacaaacaaaaaaaactgagattctttgcaaagagcctggaataacttccttttagtcctggactataatgatgatgataaatatacctcgatgtaaccctgagatcccaagattcactagcccttgaataaaaaaaaggaaaaagaaaaaaacagtatattttttcgttttgcaaatcacagttcccttattaagatggaattgctgccaattacagagaagctatttgcctaagccaaaaatccatgaggttcacatggacttatagttacacaaattagaaacaaatgttatatttaaaaccatagagaaatgcccaggtgatgaaagctggggtgaaggagtctgcacattcatttcaaactgttaaaggatttgtgggccatgcaatggtcccttgcattagagaagtcaaagagctttgtgcaatcctctcctgtctgtgatctggaagacacgtgctcatcacagagctccagctgctccgagactttactcctttcttcagctgcacgcactgctctctcgcttttgttaggaattgactaattcctcctcttcctcttcctcctcctccttgccatctctaggcccagtcagcatctcttgttcatcctctgatcccatgtccagctatggttctggattcaacactagcagcaacagtggcgctgactccactttaggatcaataaatatttttctggctaggcgcagtggctcacatctataatctcagtactttgggaggccaaggtgggtggatcacaaggtcaagagatcgagaccatcttggccaacatggtgaaacctcgtctccactaaaattacaaaaattagttgaacatggtggtgcgcacctgtagtcccagctacttgggaggctgaggcaggagagtcgcttgaacccaggatgtggaggttgaagtgagccaagatcgcgccactgcactccagtctagcgacagatggagactctgtctcaaaaaaaaaaaaataagtatttttctttctagccgtatatccaccttacatggtccctcaactccccaagcccactctgcctgccccatctcctccttccacatcctctcctcaacctagcacttggttggcaatgccttcctcgatcctctgccaaagaccctctagccagtgcttaccctgtctgttctctctctttacccaaagaaatacataaagtttgaccagaatggaaacagagatatcagtgaaaaaaggtgatttggggaagtgtgcaggcctaggaagacagaggcttgttcctttgcttgcttaaaatctttgatcaaacggccaggcgtggtggctcacacctgtaatcccagcactttgggagggcgaggtgggcgaatcatgagatcaggagttcaagaccagcctggccaacatagtaaaaccccgtctcactaaaaatacaaaaaattagccagctgggcgtggtggcaggtgcctgtaatcccagctactctggaggctgaggcaggagaatcacttgaacccgggaggtggaggttgcagtgagtggagattgcaccactgcactctagcctgagtgacagagtgagactccatctcaaaaaaaagaaaagaaatctttgctcaaatatcactttttcagagaacgcttctctaaccactctatttattttattattttattgtattttttgagacagggtctcactctgttgcccagactggagtgtaatggcacggtcatggctcactgcagccttgatctcctgggctcaagcgatcctctcacttcagcctcccaagtggctaggaccacaggcgtaagccaccgtgtctggccagaccaccatatttaaaactggggacaagtcaggctcacacctgtaatcccagcactttgggaggccaaggtgggaggatcacaaggttaggagttcaagaccagcctggccaacttggtgaaaccccatctctactaaaaatacaaaaattagccgggtatagtggtgatcgcctgtaatcccagctattcgttaggctgaggcaggagaatcgcttgaacccgggaggcagaggttgcagtgagctgagattgtgccactgcactccagcctgggcaacagagcgagattctgtctcaacaaaaaaagctgggtgcagtggctcacgcctgtaatcctagcactttgggagtccgaggtgggtagatcacctaaggtcaggagttcaagaccagcctggtcaacatggtgaaaccccgcctctacaaaaatacaaaaattagctaggtatgatggcaggtggctgtaatcccagctactcggaaggctgaggcaggagaatcgcttgaacccaggaggcggaggttacagtgagctgagatcaagccattgcactctagcctgggcgacagagtgagactccgtttaaaaaaaaaacaaaaaacaaaaaacaaaaaactggggaccattggcaataatactcctatgtcccctcttccctactttgttttcctccataggcacctggcgccttttttttttttttttttttttttttgagacggagtctcactctgttgcccaggctggagtgcaatggcgcgatctcagctcactgcaacctctgcctcccgggtttaagcgattcgcctgcgtcagcctcctgagcagctgggattacaggcacgcaccaccaggccctgctaatttttgtatttttagtagagatggggtttcaccatgttggtcaggctggtctccaactcctgaccttgtgatccgcctgccccagcctcccaaagtgctgtgattacaggcgtgagccactgcgcctggccacctagcacctttaatatacttatttatttgtattgtctgccttccccaattagatcaaccatgaagacaagagttttcatttgttgggttctctgggcctagaggcatgtctggcatatagtaagcattcagtaaatatctgttgagtgaacgtatgaataaagaagtgagttcctcccagcaggcactgagaacattgggagtacagggttgcagctctctctgcagcaggagaatgtagctgcaataaagggaagtcaagaagccagagtccagccaggtgcagtggctcatgcctgtaatcccagcactttgggaggctgaggtgggtggatcacaaggtcaagagatagagaccatcctggccaacatggcgaaaccccatctgtactaaaaatacaaaaattagctgggcgtggtggtgggcgcctgtagtcccagctactcaggaggctgaggtaggagaattgcttgaacccaggaggcagtggttgcagtgagccgagattgcaccattgcactcccgcctgggcgacagagcaagactccgactcaaaaaaaaaaaaaaaagcagcagcagcagccagaggccactccagcatctcccctacctggcttgggtcagggagagggcagtgagaagtgaaaactcccagctacagaaaaggaaatatgttggggggaagggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgcgcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcrgcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcrgactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacamcctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtagaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttaagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttac

SEQ ID NO: 12596 - DNA, 17797 bp, Homo sapiens
agcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccatagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgatgtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttacagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaaaaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacgaacaaagggatcaataaaaagaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagtaaacgtgctactaagttgcacgacttgtcaagaaaagaggcgcttccgagtttgagaattgggagcaaatggagtccgagtggacagaaagacaagaccctgaccgtggggaatttaaaggccggccagcgtgcttccgaaggccgggggtggaggcattacckcctctccgtgccctcttctcttaacctgccctgggccaagggcctcggccccgcgaaactgcgagtcctccagaaagacacatcgctgttggggtgtccaacctttctgggattcgtagtttatacccaggtcctggttatattttagttaagagttctaataagcagctgtttaatgagcacttgtgccagcccatatactacgggttttgtgtattattttaaaaagccttttaacgagcttttaacattttttaagtgagtacacttagacgaacataagtgtcagaattgacaaatccaggcctacaggactccagatcgagcacttgtactttactgccccaataaaaagctgttaacattttagcttatttttttgagagagggtctcgctttgtcgcccaggctggagtgcagtggcgcaatcacaactcactgtagcctctgcctcccgagcccaaccgatcttcccacctcagcctccctagtagggaccacagatgcacaccaccacacctggctaattttatttttatagagatggggtcttgctatgttgcccagcctggtcttgcagacttggcctcccaaagtgctgggattataggtgtgagctactgtgcctaaccacattttagctttttattacaaaaattttcggccgggcgcagtgactcacacttgggaggatgaggcgggtggatcacgaggtcaggagttcaagaccagcctggccaaaatggtgaaaccccatctctactaaaaatacaaaaattagcctggcgtggtggcgggcgcctgtaatcccagctacttgggaggctgaggcagagaattgctttgaacccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcggcaaattttttgtggcagtccatgggatataaatttatcaagctaggtgtggtggctcatgcctgtaatcccaacactttaggaggctaaggtgggccgactgcttgagctcaggagtttaataccagcctggggcaacatggtgaaactccgtgtctacaaaaaattagctaggcgtgatggcgtgcacctatacctcctactcgggaatcatctgagccggggaagtcaaagtcatgcctgggcgacagagtgagaccctgtcttaaaaataaataagtaaataaataatctatcgaggaagatccatctctcacagcattaactgctccagtcacttggtgctatccaaggacaacctatttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctrtaagattgatgatttgccaattttacagatgaaaaaacagacatagcagttaggggttggtggtgttttgtttgtttggagacagagtctctgtcgcccaagctggagtgcagtggcacaatcagggctcattgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattacaggcatgagctacctgccctgcctgtagttagggtttggacacattctgcctgacaccaacatctatcctctctaacagccagattacatagcctctttgtagtaataaatgttgagtgaatgtgtcagtgaacactgccagggtatacatatttttctaattgtaaactaaagagagcaatccaccgtgccccagcacctgcatcatacctgttctaaagcatttaccaagttgtattgcaatggtttgtctacacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgttgtgataatgaaagcaagaagaaaaatatcagtactgtggccatcaatgcagaggcatggcagaattggggggtggggtggttacccaggttgactggggaggggcaaagaggaaaagtcatttaatgactctttgtcatggatccaatccccagttggaaagaggaaggcagccaacacctctacccctaaatcttgctgttttgactgatgaagaggttgaacccatcctgtgctggaacccaccctcttttgctcccttcattgtctctccagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgtgagtggtaaggaggcagaagcatcactgggttcagtctctgcccaaagtgtgagaatccacccaccaagagctggcctcttagctggtatatctactatgcttggcccacggaattcagtggctgtattaattgccctctggagaaagatgtgcctaaccaatgcttggtagcttgaaacccaaggagagctgggcttcaataacaaatacaatggagtaaatagaagccgggacaggccagacgtggtggctcacgcctgtaatcccagcactttgggaggctgaggcggacagatcacgaggtcaggagatcgagaccatcctggctaacacagtgaaaccccgtctctactaaaaatataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgagtttggttctgcatctctgttctcatacttctcccacctgccttgacaggccgccctgacatgaagactgagctcttttccagctcatgcccaggtggaatcatgctgaatgagacaggccagggttaccagcgctttctcctctacagtgagtagggatacaaggcaggaagggttggagggaaacaagggagggcaggagaactmctcactctgggtcctatgayaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggkgttaaaatctcataaaacaggattaggactcacmaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaataactgacctgtaacttcatctaagtccccagatgggtacaatgggagctgagttgttggagggagaagctggagacttccagctccagctcccactcaagataataaagataatttttcaatcctcatctcattctggggtttgtctccagacgtcattcccactcctcccatttcaacattccccctggatcctctaccacctaaactcccagctggacggtgtcagtaagaacagagtggcagtaactctcactttgtagtggtatatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtctgtctatcctgccctggtctcctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacaccctaaatagttctgttctctcctgtgtatgaaggggggccctgcaccctcgtactcgggtttcttccccatccctgaggtccctatgcttacaatttgggtcatgcctcacacttttctcctaaagcccacactctcttcaccctttgcccccaccccacggtcacagcccctttcccgggtctcccctctgctcctcaccttccctctccaacccctcactctcccagtcagtggccgcctcatccccattgggctcccggaggctgacagccagcaccaaggcctgcaggagaccaaagaggcaggcgaagtgcaaagggtgggcagtaagtaggctcagaacagcatggagcccatgcagggcagccaggaaggacagtaggccatgtagccagaggcccagcggtccacgcaggcccagtgtgtccaaggctgcccgcagtggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccacttgagggaatccattcttttgctccctagctgctcaacttggggctcctccttgcttggttcggaagcagccctagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgcttcctcttcagttctggggtaaaggggggcatacccaaattcattcaccatccacacccccacaatctgagattccaagaatctcagatctgacaaggcctgggtcaccaccagagagtcctctctgcgtttccggatttccttcccagcaggcagcaccccaagtttcactcaccaaggccacaccccaaggtgtcccagaaactggggaggcagtgctccatccaataaagcgggcaggaaggtggccccaggtcctaggtgctcctggatcgtgtagtctttaactgctgccccaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggccgcggccttggggagccgccgggagccgcgaagcccggaagcagctgcaccaggactggaaggacccgcgggggcggtgccgcagctcatggggcggaccctgcgaatagaccgcccccgtataccccgcgctgtctgtgcgcgccggaccgccaaaccgagattagcaaggaccaggaccttaatataaacccagctccccattttcccgggtttctcatgcttccctaaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaaagaaaaaaattgataacatggcactttccctctccagctgtgaactctttgagggttgggaatgtctttacctgtattcttggcacatagtatatggacttatgtttgtgaaatcagtgaattggctgtagtcagggaactcctcctgggggaagtgagacttgcacgaagctgggcaattcttggtccaggggggttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgagcagatcccaggaaggggaagtcaaagggcccaggtcagaggcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgggtatcccaagctgggaaatgtgtcactcggggctggggtgctgatctgtagcctagtccttcctggtccctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagttctcgcagtactggagggagggagtaggagacctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcctcagcctcccaagtagccgggattacaggcacatgccaccatgtcccggcaaagcctgctttctacaaaaaatatgcttgagcccaggaagcggaggttgcagtgagctgaaatcacaccattgcacaccagcctgggcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacaattcttactacccccatttctaagatgagaaaactggaacatgtagacattaggttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctg

SEQ ID NO: 12597 - DNA, 12770 bp, Homo sapiens
acactgctgctgggagtgcacatcagtacagccattatgaaaaacactatggatgttcttcaaaatattcaaaatagaacaacaatgcaatccagcaatctcatttctgggtataaatccaaaggcaatccaatcagtatgtttaagagacatctaggccaggtgtggtagttcatgcctataatcccagcactctgagaagctgagatgggaagatcgcttgagaccaggagttagagaccagcttggacaaaacagcgggaccatgtctctacttaaaaaaacaaaaaacaaaaaacttaggaacttctgccccctcatgatcactgcagtattattcacaacggccaagatatagaaacaaccaaagtgcccatccaggaatgaatatgtaaagaaaatgtgtgtgtatatatatttatgtatgtgtatatatatatatatatatatacagagtgtgtgtgtgtatatttatataatggaatattattcaaccataaaaaagaaaatcctgccgggcacagtggctcacgcctgtaatcccagcactttgggaggccgaggcgggtggatcatgaggtcaggagattgagaccatcctggctaacacagtgaaaccccgtctgtactaaaaaaaaaatacaaaaaattagccgggcgtggtggcgggtgcctatagtcccagctactcaagaggctgaggcaggagaatggtgtgaacccgggaggcggagcttgcagtgagccgagatcacaccactgcactctagcctgggcgacagagcgagcgagactctgtctcaaaaataaaaaataaaaataaaaataaataaaatcctgctatttccaacaacatggatgaatctggaggacattatgctgggcgatataagactgacacacaaagacaactactgtatgttctcacaagtagaatctaaaaaagtccaattcatagtaataaggcggaacagttgttaccacaggatgctgggtggggaaagtggagaaatgttggtcaaagggtacaaattctcagttataaaatgaagaagttctgaggaatctaatgtacttcgtggtgagtttaccgcactggacgctttaacagtttggaaagtttttgaaaaatctaataaattatggggtaaaagttaaaaaaaggcaatattgagaaattaatgacatcagctgattacaggatgacatcaaatcttatttcagaagttagtaattatagaagaaactgaataaactaaaatttaaatcaagcttccaaaataacaatgaattaactgtaaagcaactacaaggaaaaaagtaaatccattaacaaaacaaaaaaccaacactctcaactctccttcaaagacatacattgtaggcctgtagaggtggttcacacatgtaatcccagcaccttcaggggctgaggaggatggagtgcagctgagaggctgcagtgagccgatataattttaccgcactccagcctgggcgacagagaccctgtctcaaaaagagaaaaaacaaacaaaaaaccaaagatacatcttgtagtgacagtcagtcatttcttgcctatttctctcctcctccatcctctactccctccctggaaagaagagttacaaaatgactgaatcaagtcactgccctgtggctaaatagggattccaaatatcttttgatataaacaaatacaaaatgcacaagccttgtagaaaagagtggtaattttcatcctcatgagtacaatttaaagaaacaaattttaaattagagtataaagtcacaaatcaatacattaaaaccaccatccatatccaatcaactcacagctcatctgggtggggtcctcgcccactctcttcactactatgtgtttcccgctctcattctgcacgtcttttttccctttgctgtttttctcccctttctttattccctcttttatgtctattctgcccaatgcttcgaaatttatttcacctcttgttgctctttctccccaaactttcccattgtccccagccgccacgtattcctgcctcttttcccccatctgagctccctgtctgctctccctgttaaaatccctcttccctgttaaattcccttttccctgttacatctcctttgttcccactctctagcacccccaacttcctaggcttcctccttgctgtggttctccctctactctcctttgttacccactcccctctccttcagtcccagcaccacgtggctctgtcagccgcggctccgactcttaccttttccgccccccgcgtctgactgcagtgcctcctcctttgccgcccctctctattttgctgcccttcagctccctgaagctctcccttttccctaatttctttatgtgcttttctccccgtgctactttctccatgcgtcctcttgcactcttgctctctttgccagtacctaaattatcatccattttgccgtgtactcattcttttctccccagtttttctttctgtcccgtcgctccccctcttttcctctcctgatccctctcacccacacattcaggaggaaaggggaggaatacgatgcccacctcccggaagagcacattttccagtggagtaaaaatttgggaaggaacgacagtgggtgtcacaagacagactcgggtgacctcctgcaacgcggagtcaggaaaagcagtggctgtgaaggggcagcctggggaggggaaggacccggcgtgaggaggacactaggtggcgcgcggaggacactaggtggcgcgggggacggtgtctcaggacagggagggtctgcagaatcccaggacctgggagaagaagcggctccttcaggagctgggcagcgggcgctcccctccaggcgtcgacaagggcgaagctcgggggtctcgactggtgggaatccacctcgcgagggaggacttgacttcgcccggggccgaagcaggggtcaatgagagttttaagcaggaacacgacctgaatggggttatcgacatggttatctacatggcagaaaggcagggggcaaggaacagcctgagagagattttaaaccgacagggaagcaattctcggacttacgtggggagaagtgcctgttgcaggggcgaaggggctatgggtattttaaggtccgtagcgatccccagatcactggtacggagaagtgaggactgcaaagtgcacgtttaatccaggcagacggagcgaagtaatgtttaatccacgtagactgaaacacacacacagcgataaggcctttccctggcgcaatctgcttccgggagtgacggaaactgctagcggagagaaaaaactgggaggccagggggcggggcctgggcgagccgcgaccagcaaggggcgggtcggaaagaggggcctgactcggggagggaccctgagagggtggagccgggccggagcggcagtgggcgtggctaggtggggcgggacggagccgcggcggaggatggggcggggtttcatggggtaagcggggccgaaatagagcctgttatttactctggttcacaggcagcatgtctttggttttctgactacttcttgtcctgtgaagcagcgttgctgcctgcctattttaagttaatgtttcaaaatttaaggttaaagcttaaagttgtggtccacttatattagaaactaagatgatttcttaacaagttgaactaagtcaaaaccgatttttacaagcttggtggactccatccactcttgccgatgatgctgaagctactcaatagtcagggaactaggatctcgctggggatttgatgtggagccgtggctggatccaggaacccggaagacattatgccaagcgaaatatgctagacacagaaagacaaatactgcctgtgcttttacacgtgcaaagtacaaacgtcaaatttacagtaacagattagaagggtggttaccagggctgggggatgtatcctatgcctttatcaccattatattttggaagcagataacttctctggcctcacagattcacagctgggcagaaattttgcctcaggatgaatcacaccttgattctcacccatgtgtggttcagataatatttagggggtattctgccctaagagctgatacaggaatggattaagacttttgagagttgatactgaaatggattaagtcttttgagatgggccagcagttttggaggcccaggtgggcaggtcacttgagctcaagagttcaaaaccagcctggacagcatcgtgagacccccatctctacaagaaatacaaaaagtagccaggcttggtaatgcactcttgtagtcccagctacttgggaagctgaggtgtcagaattgcttgaggccagggatttgagatcatcctgggcaacatagccagacctctctacaaaaaattaaattatctggacatggtggcctgcacgtgtgggcccagcaactcggaagggtaaggaaggaggatcatttgagcccaggaggtgaaggctgcagtgagccatgagaagaggagatttggttgggtgcagtggctaacgcctataatccccacactttgggaggccaaggtagcagggagctaacttgcattcttctgttagctgaggcgtttgatgataaatgaaagcagaaagtttgtgacttatttacgttctttccacagaaaggccatatgtccttggccataaagaaaaagagacctacagcttatctgcttcctctatttttttttatatgttctggaccatgaagaaagatttatagcttatttgctttatctctttgctttctcctggtcctttcaggctgactccttttccccaattagggctccacagactctaccctcaaagggcatttttttctcaccctcctataaaatccctcccacaaataaaccaggatcctatttcccagcatgaaaagtttgttggaaaaaaaactgaggctgcatgggaccttctttctcttcttcaaaactacttcacctcttctctcttttgtctctctcttcctaactgccctgcacaattctaggtccccagtgaatccttgggttgacatgcaagggaagaacccatagggaaaggaaatctctggctttcagagataactttttggatatctggatgcattcataaccatccttgtgttaccagaaaggggtcctgatccagaacctgaaacttccattgcacaattataactgagaaaattattacagtgaaagagatctgacctaatcaactccatcttgcttttaacctccaagctgctcttgttcattcctgggcataggctgaactaactttggaaggaacttagtttatagtttgaaacaaagacattaacagccctttcccaaaacaaacccccttcctgcttggggactagactgcctttgtaagactaacaaattaggcacaaggtgagagatgatggtttaggagtcatgtagctggaggctacaagattctcacccttcccagattgttcctggggataacattactattataaaacctaagatcagtgcttgagatattttgcattccctgcacttgatggatcacctgacaccaacccagatccataaactggctcatctggtcttgtgaccccacccaggaactgactcagtgcaaaatgacagcttcagatctctatgatttcgtctcctacccaaccaatcagcactcccgactcactgacacctacctatcaaattatccttaaaaaccctgatccccgagttttcagggagactcatgtgagtaataaaaaaatttcaggttcctgtacagccagctccacatgaattaaactctctcttgcaattcccctgtcttgatgaatcagctctgtctaggcagcagggaaggagaacctgttgggcagttacaaccaaaagggagggttcttggatctcatgcaagaaagaattaggggtgagttcacactgtaaagtgaaagcaagtttactaagcaagtaaaggaacaaggcagggtgcagtggctcacgcctgtaatcccagcacattgagagaggctgaggtgggcagattgcttgaacccaggagttcaagagcaacctgggcaacattacaaaactctatctctacaaaaaatacaaaaattagccaagggtaatggtgtgcaccagtagtccaagctagttggaaggctgaggttggaaattgcttgagcctgggagaatttttttttttgaggcagtgtctggctccggtcacccaagcagtagtgcagtaatgccatctcggctcagactctaattcaacacggaatgttgagcttctgagcgtgatatagcggaagtgccttctcttccggtctctctggtcttggccgcagaagccagatgacgaagggaacgtcattgtttggaaagcgtcgcaataagacgcacacgttgtgttgccgccgtggctctaaggcctrccaccttcagaagtcgacctgtggcaaatgtggctacgctgccaagcgcaagagaaagtataactggagtgccaagkctaaaagacaaaataccaccggaactggtggaatgaggcacctaaaaattgtataccacagattcaggcatggattctatgaaggaacaatacttaaacccaagagggcagctgttgcagcatccagttcatcttaagaatgtctatgattagtcatgcaataaatgttctggttttaaaaaatacaaaaaaaaatactgaatgtttactcctgaaacttatgatgcctaggttgagaaagactcaattttcctcatgctaaatactttatacatgtcctttattcatgcatacataggacactttacacaatataattgttgaaagtgcttctgaaatactgttcaaattgtctataatatttttacacatgcactataaaaattaaatttatcagacaataaatattaaataatttaataaaattgcatttttcaaaggctctaacaatgcatatttgagttatcatattaaacattgtattctatgatttttcaactgtaatataatttttttttgagatgggatcttgctctcttgcccaggctgcagtgtggtggtgcaatcacggctcatgcagcctccacctccccaggctcaagtgatcctctcacctcagtttttgtgtttttagtagagatggggttttataatgttgcctaggccggtctcaaacttctgggctcaatctgtccacctcagcctcccaaagtgctaggaatacaggcatgagccacagagcccagccaaaactacattttaaaaataattttttatcattacacactccactagaaaccatttaacccaatttatggacttacatttcttccattgaagaacttgaaggatccaaaaatcgaggtgacattctcagatttgtgtggcaaaaaaagaatagaaaaataacagatgcaaagaatgtgttccaccaatatgtggaggatcccttttattttaagttcagggaaagcattggaatgatacaagaaaataaactgaaattgtataatgtggaaacaagagctctgttgctaatatgcaagtttatcactgagattttaacaacacaacatgctaattataccttaaaatatgtttctcccagtctgggcaacatggcgaaaccccatctctacaaaaaaatccaaaaattagctaggtatgctggtgtgcacctgtagtcccagctacttgggaggctgagagaagaggatcacctgagtccaggaggtggaggttgcagtgagctgagatcgcaccactgcactccagcctgggtgactgagcgagaccctgtctcgaaatattacaatatgtgacagcgcagcttccatcagaaataatttgttcctcttttgcccacacaaaatattcacctccacttcctctaacatttttttttaaaaaaaaaagcccaaacataactttcagttgcaagcaaggatctcatgacagtctcatgacacttctgttcactgagagcccaatagagtcctcgtcactcacgacatttcatggtggaacagaaaaataaaacctgaattaaccctcacattcagaaaagggaaacaaagaaggtactacccagtaggtccatagcaaatgtgcaattttgctgagaagatgagttagggcctggttccaggaggtcaggaatgaataacagtacttttcatggctacagttctcctgagaataggtttccagtccactatattttgtcgttcttaacttcacccgatgacatccctcatgcagtatcagaaagtatgccctccttctgcagtaagcatctttccccagctacttcttttccacttcaatgtaccatcccaaagactattataagtctaaatttaattttgtttttataaaatactatggactgatagaagtctcaaaagtataacattatgaaaagtataacaaaagatagcattttatctgatgccatttcaaaatagagacattttcaaagctaaacccatgactttagctatacccacgagttttaggaacccttccttagtttcagaattttattccagtgcttttgaacttcttgggccacagtctagtttctatttactacacttgccatttcatccactctcaaaaaacaatttcacaagagttaccttaatcaactggcaggttatttcaaagaacgttagggctatggccttgacttggactttgttataattttaacttgctgttgcccctcaaaccacttctcaaatgtgagttttatcagttgcagatgagctactgctgcagacttaaacattgcttgaaaatcagctaactcatttttgaagaatttacaaaatattgtgtcaagtgcagttgaaagccatatggcacattagcaccttctgctttctttttgtttgttttgttttgttttgagatgaagtctcactctgtcacccaggctggagtgcagtggcatgatctcagctcactgcaacctccacctcttggtttcaagcaattctctgcctcagcttcctgaatagctgggattgcaggtgcctgccaccacgcctggctaatttttttgtatttttagtagagacagggtttcaccatcttggccaggttggtattgaactcctgacctcgtgattcacccacctcagactcccaaagtgctgggattacaggcgtgagccaccacacccggcccaagcaccttctgctttcttgatctctatactggcaggtggtatttccaagaatgatgccccctctccaggaaacgtttgcacatgtctggagacatttttgattgtcacaattggtggtgttgctggtatctggtggtaaggaacagtgatatgtgtttcctccaaatctcatgttgaaatatgacccaaattgttgaaggtgggccgagtgaaaggtgcttgggtaatggggttgggtctcttctgaatggcttggtgctttctccatgataatgagtgagttcttagtcttagtacactcaagacctacctgtttaaaaaagactagtggcctggctggtggctgaagcccgtaatcccagcacactgggaggctgaggcaggtggatcacaagatcaggagttcaagaccagcctggccaagatggtgaactctgtctctattaaaaatacaaaaagtagccgggcatggtggcgggcacctgtaatcccagctactcaggaggctgagacagagaattgcttgaacctaggaggccgaggttgcagtgaactgacattgtgccactgcactccagcctgggcaacagagagagactctgtctcaaaaaaaaaaaaagaatccttcttctagtacacagatgcattttaaaggggtcttctctactgctttttctctcaaaatcaatttcagtttggcctgtctgttcacatttacatgaggatccaaattgttgttttcataggtaaatgagtgactgagtatcctcagcttcgaacagaaagagcattttgctccttgcagctgataggcacccctaggtgaccgggggcctcatgggagtatctgggaagttgacccaccgtgatgtgtagtggctctacagagaacccccacaaaattagttttaaaaagactaatccaggaggtgcatatgggtgctagtaacttgtgctttgagccctcctggaggtgcttagacctccggaggagaaactgagacacataggagggcggcagtgactcagtggtaacacactgcggagtctcttttgcaagcagcacatactttgacctactccacaaaaccctaggccacatctccttttctccttttaaggaaacaaacaaacaaaaaaagtgggaaccaaataatctaagaacgaggagaaaaccagaagaatgacgcccctttcaggcactcctttggttttatggcacctcttcttgcaagtgtttgtgtgacatgaacttatatggtctttttgtgcagaagtacatgaaggaaaattcagagcccaaaggtcagcctgcaactgtaaagttcccaagttctctctctgctttcttttctgcctgcttgaagtccactgctacttttctaatgagataaaatccactgtttgcaatttctttttgaaaaccaatgagtttctactaatacctcatgattaaagttctgaagtaaaagctacatgatctttggttatatgagaatgtatgtgtgtgctaatgtgtttgtatacgtattttgttgtgttttggacacaaggcgctaaattggcttaaagagtcctcgtaaattaaataataagccaaaatgtttctcaagttcacatgacttaagtaaaatctttaataagttagctttaaaagtattggtaaaataggccaggcatggtggctcatgcctgtaatcccagcactttgggaggctgaggcaggtggatcacctgaggtcaggagttcaagaccagcctggtcaacatggtgaaaccccatctctactaaaactacaaaaattagccaggcatggtgttgggcacctgtaaccccagctactcgggaggctgaggtgggagaatctcttgaacccagggggcagaggttgtggtgagccaagatcacactactgcactccagcctgggcaaaagggcaagactctgtttcaaaaaaaaaaaaaaaaaagtattggtaaaataatattagaaatgtcttaagaattgccagcatacatttttgtttgcatttattgatcaagcaatttcatagttatccctgccaaatactattgaggcaggaaaatagcagagggaattggagtttggataaagggtggaatgagtaggagcagaagaaaggtgaagaggtgggtgcccaagcctgtcatgaatggtctgtgtaagtcattaataagaggatttatgaaaaaaaaaaaaccttttatatttcaagttgtatataaattaaacagaaattataatggtctttctagtgactgggttttgatccttaaaaaaaccacttatagactaaataattggatcaaaatacaaaattttcctaaggtattgctttactcttaatatattattacaagacactataatttttttacacaaagttcaacttttattgtgtcttgctgttttcagctttctctcctcttttaaaaggcctgaaataataactctatccttcaactaattttcagctcctgtaagtttttctcttttagtttctaactgttgtggcctcatgccaacatcaacaaaatgttttatcctagaggtctaaaggaaatgtttcctttcaatgtaatattccccataggaaacagcagttgcactggaggaggtcttttcttttgcctttagataactggcctaataaacagatcttacactttatcaaaataattcctatgtcattattactaagtttggtttggttagaaaaaaactgaaattaaaaaatttttttttaattaaggttatcacatccatgtattttctgtatgtgcttttttttttttttaaagagagtctcactttgtcactcaggctggagtgcagtggcatcatcttggctcactgcaaccttgtctccaggttcaagggattcttgtgcctcagcctcccgagtagctgggattacaggcacacaccaccatgcccggataatttttttgtatttttagtaaagatgaggtttcgccatgttagccagcctggtgtcaaactcctcacctcaagtgatctgccaccttggcctgccaaagtgctgggattacaggtgtgagccaccatgcctggcctgtatgtgcttttaaagtccttgtgtcactaagttacagagctttgacgtctgggtctaaaaaggacaccaagtcctgctaaatcttaaacactgacagcagttaaagcctcattttcagacctaatagaagatgccaatcaaaataaactgtgttcttgagacgcaggacaagaaagtaaaactattcaactcctcaaggcccaggggctattacagaagaggtgggcacatgaaattgcaagagcttacctggagagataaaataagttcagtttctctataaattaaccattgatgtcaaaggcacactgatgcaagaccagcatatgagcctctttgtcagattaacaaggttttcttggagcattgacccactccataataaagattacaatggt

SEQ ID NO: 12598 - DNA, 23436 bp, Homo sapiens
  misc_feature (1)...(23436): n = A,T,C or G, or insertion/deletion polymorphism (see Tables 1-2)
aagcaattctcctgcctcagcctcctgagtagctgggattacaggcgcccgtcaccacacccagctaatttgtgtatatttagtagagacggggtttcaccacgttggccaggctggtctcgagctcctgatctcgtgatctgcccgcctctgcctcccaaagtgctgagattacaggcgtgagccaacgcacctggccaaggagctaattaaggttaaatgaagtcctaatgtgataggaccaacagttttcatgtgtctgctgcacagttaacagacccatgatgctcagacagcagggtttgcagcagagaaagagtttaacaaggcccaggtgaggaggtgaaaggagacgtctcctcaaatacatctccctcaggagttctgagctaaggtttttaaggggatcatggaaggtgaggggctggaaaatgggggtcgctgactggccagggtaaggaggatgattcactagaatgtggaaactgcattccttgctgagtcagctcctgtggggtccttcagagcagctggcatcagtactttcactggtatgcagggcctgaaagaatctcaggctgggcgtggtggctcatgcctgcaatcccagggcttcaggaggccgaggcaggatgaccgcttgggcccaccagttcaagaccagcctgggcaacagggcaagaccccgtcagtatttaaaaaaaaaaaaaagccagatgtgtgtgcctgtagttccagatacttcagatgctgaggcaggaggatcactcgagaccagaacctcaaggctgcagtgagctacgattgtgccactgcacttcagcctgaacaagagtgagaccctgtctctaaaaagaaaaaaaaattaaaataaaaaaaaaatctcaaagggaaaagttaaggtttcataatgttcaagttgttatctctggagcagttaagggtaactgtaatcttataacaagagtctacctgattctgaggcacgaggcgccagctcagaggggctcaccacatgactggtgctgcgtgtgctgcaagctcggttattccatttccccctcccctcttccttgattaattttgtgtttttagtgacggttttctttttttatatttttttaaaaattgagacaaggtctcactctgtcacctgggctggagtgcagtggcgcaaccatggctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatttattttgtagagataaataaatctccaaataagtctatgttgcccaggctggtctcaaactcctgagctcaagcaatctacctgcctcccaaagtgctgggattgtaggtgtgagccaccatgcctggccagggatggtttcaataagggtgcaaccctaatccgatagggctggtaccctcatgagaaaaggaagaggtaccagagcattctctttgctatgtgcaactctaaaagacagcccgtaccaggcagcaatctgtcgggcaccttaatcttggacttccagccaataaatgcctattgcttcagttccccagtctaaggtagtctgttgtgacagcccgagcccactgatggtgagaaagactttattccctgtgtggtggaagttgcagcacactaagaaacagggactagcaaaagagctttcctgctccttcagtttttttgtttttgtgttttttttttgagacagtgtctcactctgtcacccaggctgcagtgcagtggcatgatctcagctcactgcaacctccacctcccaggttcaagtgattctcctgtctcaacctcccaagtagctgggattacaggcatgtgccaccacacccagctaatttttgtatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaggcaggtggactcacctgaggtcaggagttcaagaccagcctggccaacatggtgaaatcctgtctctactaaaaatacaaaaaattagccgggtgttgtggcgggcgcctgtaaatcccagctacttgggaggctgaggcaggagaatcgtctgaacctaggaggtggatgttgcagcgagctgagatcacaccactggactccagcctgggtaacagaccgaggctgtctgggaaaaaaagaaaaaaaaaaaaagcaagcagagaacctaatgaacccacgaacccatgtgttcacctgcatctttctgcaattatcagcctgtggccaactccatttcacctgtatctctgaccacacagacccagcatcccaccatttcccctataaagtggatgtactcacctatcaggcctccagagtcttgtggagtgactcttgctcccattgctcctggacagacagtgctggaaatcaggcctgaggctgtcagtggcagtacgaaggacactggatgctcagccacgcagaccctcctatgcccacgccagggctgaggtcagcaggctggggtgtggcagtcatcctttgatcacgcaggaacaccaagagaactgctaggatgtggaccaacctgatgtcactgagtcacgggagcagctcctgcctgcctaacactggacttcatgtaatgtcagatgattaaatatcttaatgctgtgagccacaggaggctggctggtattctgctacctgtgctaaaaggtatcctaagagaggtacaccatgctggaataggcaaaagcaaacctgtttcttgtatcttagtaacacacttcaaggtgcttatgtgcttgagcaattcctgcagtcaaatgggccctccaccccccagtacacaaggcccagccagccagattccctccatcttcaccctcctcccccgtcccaggggagccaggaaagccatgcatccaccaaggcggatgcgctgtgtccctctgcatcagcctgctgagtcctcctggacctgatgagagacagtaccgcagccttgcccagccccgggaaggtggtcttccttcctacaatccccttcatcctctggaaggtggtcttccttactacaatccccttcatcctctggaaggcaacaagatggaattttataaggagacatcaatcagaaaaaaggatattacttttattacttatctatgtaagggaatagtaagtactattcttagtacttgtaagcgttcgctaggttgtgctgtggtaacaaaggatcccgaagtctcagtgactcgaaatcacgatggtttacttcttgctggtgctgcccatcagctacaacggctgtacttcatgggcctttgttacaggatctggggtgaaaaaccagccctcactgtgcacatgctgtgttcatgctgggggcagaaggggagggaccaaaccacaaaacaccctttaaagcttctgcctgaacagggcacatgacagcagactactttacattaccatttggaagtctcaccactaagcttgacgtaaaggaagaaagggtaggccaggtgcagtggttcacgtctgtaatcccagcacttagggaggctgacgtgggcggatcacccgaggtcaggaatttgagaccggcctggcaaacatggtgaaaacccatctctactaatacaaaaattagctgggcgtggtggcaggtgcctgtaatctcagctacttgggaggttgatgcaggagaataggttgaacccgggaagtggaggttgcagtgagccaagatcatgccattgcactccactctgggccacaagacagaaactccgtctcaaaaaaaaaattaaattaaaaaataaattggccgggcgcagtggctcacgcctgtaatctcagcactttgggaggctgagatgggcggatcatgaggtcaggagatcgagaccatcctggctaacacggtgaaaccccgtctctactaaaaaatacaaaaaaaattagccgggcatgatggtgggcacctgtagtcccagctagtggggaggctgaggcaggagaatgggatgaactcgggaggtggagcttgcagtgagccaagattgcgccactgcactccagcctgggcaacagagcaagactccatctcaaaaaaataaaataaaaatacaaaaattagccgggcgtggtggtgggcgcctgtaatcccagctactcaggaggctgaggcaggagaatagcttgaacccgggaggtggagggtgcagtgagctgagatcgcgccactgcactccagcctgggggacagagcaggactccgtctcaaataaaataaaagcaataaaagtaaattaaaaaggaagaaagggcataactggtaataacaatataacccatatccttccagaaccccaaactgaattggggaggcttcagtctggaaaacataaagctactctaggtatgcaatgataatataatcgcgagcttacacaaatgctgggagtaaagtccgggaaattgttgccaatgacctcagcccaaagcactgaagtgggtggtggtctcaagagctcatggggaaaaaaccaatgcaaactcaacacttagaaagctaccagcaatttcttggtctacatcagaggcaggtggttctgaaaacagagaacagctttgaatttcatctatatttctggctgagggtgcctcccaagaataatcgcctcgaaaggtaagagtgcctcgtctggtagactgtaatccagggctacacagatgattctgggaaatgcagttcctaccatttcttctgctaagcagagaaagtgatgtctagctgacaactgacaatatggcacatatagatagtagtattttagatatctaaaataacaaaaagtctcacctgagaaatgtccaggcagcctgatatccctaagataacagcaaacactactgagcgctttctagataccggggacacttcgcgggactttttccacctctctatggcagagacagtttttcctattatcatcatgacccacatttcagaggagttggaggcatggaaagaggaaacaacttgcccgttccctctccgtgctataatttgtatacatcatcttttaaaacggacttttcggccaggcgcggtggctcacgcctgtaatcccagcactctgggaggccgaggcgggcagatcacgaggtcagatcaagaccatcctggctaacacggtgaaaccccgtctctactaaaaatacaaaaaattagccgggcgtcgtggcggccgcctgcagtcccagctactcgggaggctgaggcaggagaatcgcttgaacccgggaggcggaggttgcagtgagcagagatcgcgccaccgcactccagcctgggtgacagagcgagactctgtctcaaacaaacaaaaacaacaaaaacacacacacggactttccagagccctgcagttttgcgcttcagggacaacagtgaacatttatcgatcccatggttctcctacaattgccacgtggccagcgtctacacagccccctatcctgcccctgctgtcaaacacagcgtttccagaacgcagtcgtgctgggctccaggtgagctttgggaggagccccggctgagcccctgcactgggccccgcgcttcgggaagcatctcgctcgttcgtctcgcgcgccgcgtgaccggagccctcacgctggcagcgggcaccgcagggccctgagagtcgggcccgctgcgcgcagccaggggccaacgagagccgacgctgggcgggcagcgtccgggagcccctccgaccctgcgctcccctcgtccgcgccctgaccccgcgtctccgrccgtccagcccgcgccgygtcacctcccctcccggagcgaagggccctgctcgcccgaggacggaggcccgcacgggacacggggccccagttyccgccccggaagcccaggacacggctccagtggcggcgcggcccagggcgcaggcgcgggtgtcggtyccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccgggtgggtgcgcgcggcggggggtgcgccgcggccttcggtgcctctgccttcccaggggctctttgctccgcttcgttgtctgcggctggcgtgctgtgaactgtgcgatttttattttgaaagacgggctttcgctgtgtcgcccaggctggagtgcagtggcgccatctcggcccacggcagcctggacctcccgggtagccgggaacataggcgcgcgccaccgcgcccggtccacgctgcgtgtctttaagtgcggggtatggtgatgactgacgtgtaaacccgcgcgaaaccgtggtgtctcccccaaaagtctcctccagctcttttgtaatccatgtctcgtttttgtgggtttttctggtgttgtgttttgtttgatggctgttcgcgctttcaggggttttatagcatatatttaaaagttttcaagtgaagcattgaccttaatctttggccacccagtccacaaattttataaatgctttctttgaagtctctactttctacccgagttcttttttcctaaagcatttttcatcccagcttgtttgcagattgctgttattgctcagagaaattcctttggcttccgcagaagatccaagcctgtctagagawttagtaaagtaaaattcaacgtgagacttgagtccgggagaaattcagtccaaactatattgtaatatagagggaaagcctgatctcacttgcattttgtgtgtttctctttttttctagaaagatcaactgaaatcggcaaacttctgagttcctacttgcaaaagaaaagtgacgtggaggatcactcggtgcacctgcttttttctgcaaatcgctgggaacaagtgtaaaaaccattgcacactgctccctctgcccttgccactttccttcctcctgagattcagtgaacgcagcactcgattctgaatgacagtgacagtagtgctgggcctgatgttcttctgtttagcagtcctgtgggcagaggtggtgaagcgccctagttcccaaagggcgctaatgaatgctgtttcgtcctcctgctccccacaccccataactaatagacttcagtttttcgggtttttttagacggagttccgctctgtcgccaggcagaggtgtgatctcggctcactgcaacctccgcctcccaggttcaagcgattctcctgcgtcagcctcccgagtagctgggactacaggcgcgccccagcatgctcagctaatttttgcaattttaatttactttatttttaaatttaatttttgtatttttagtagagacagggtttcaccatgttggccaggatggtctctyttgaccttgtgatccactcgcctcggcctcccaaagttctgggattacgcaggtgtgagccaccgtacctggcccttttttttttatttttaagacaaggtattgctctgtggcccaggctggagtgcagtggcacccgatcatggctcactgcagcctcaacttcctaggctcaagcagtcctcccacctcagcatcctgagtagcttagggccataggggcatgctaccaagcccggctaatttttttttttttttttaatgtagagtcaaggtctcaccatatcacgcccaggctggtctcaaacccctggcctcatagacttaatgttttaaagatagctttaggtatatagaaaaactgatcaaaaagtagagtatgtagagcgctccctacatactacccctgccttccccccttccccattatttatgtgctgtgttatgttacatttgttaaaattgataaccaatattgatacattagtaactgagtttatatgaactctcctaccacctttttttgttttacatcattgtagtaggtttcctcttcattcaacacttaatgttgatgtgtgttctttcaatgtttttatttacatttatatacatatgtagaaactactatagttagaattttgttttttaacataaatgaggtcataccatacaaattatttggcagctttctttctaactctgccttacagatttctgcacttacagatcccctaactctgcccttctcattctctttaattgtcgtcgcattgtctctagaaccacggtacgtgtagccagttccctgctggtgaatcttcagtggttcctcatcatccgtgttacatgaaacactgcattactctcctccggcttagctttgtgtcttgcttggaaaggctgtccccactccaagtcttaaatgaaaatgagaccatttttaataatctttttaacacatctagaatttatggaggcaattgttcttctgattttgctttttgtggctttgtagaaaagtgatgaaacacgtatatgcccaatttaaaatgaagaataatcctgattttactttttagataataatcttatcccaggtacccagggctacgtctcttgtgtccatctattctcctacaggttacttgtttccctaatagatatttaagtttcctctatgtctaactgtggcttgatagtttttttttgttgttttgttttggttttttttgagacaagagtctcgttgtgttgctcaggttggagtgcagtggctcagtctcggctcactgcaaccgccgcctcccgggttcaagcatttctcctgcctcagcctcctgagtagctgggattacaggcgcgtacgaccatgcacagctaatttttatgttttagtagagacagggtttcaccatgttggccagggtkgtcttgaactcctgacctcaagtgatcctcccacgtcggcctcccacagtgctgggattacaggcatgagccaccatgcccgaccaatagttcatgtcttttttgccctaattaatagtcccttgtttggatgtaccatagttcattacctactaaaggacatctttgttgcttccaagttttggcagttataaatctgttataaacatcctggtgcaggattttgtgtggtcataagctttcacttcttttgggtaaatgccagggagcaccactgctttaatatgtggtaagactattaatttttgtgaagaactgctaaaccatgggtatccagtcttttggcttccctgggccacattggaagaaatgtcttgggccacgcataaaatacactaacaattgctgatgagcttaaaaaaaaaaatctcgtaacgttttgagaaagcttaacaaatttgtgttgggctgcatgcagcctgcgggccttgggttggacaagcttgtggtgaactgtcttccaaagtggctgcagcatcttgcattctcaccagcagtgaacaagggttgctattgctccagaycctcaccagcatttggtgttgtcagtgtttggatgtttgccattctgataggtgtgtgtggcatctcattgttctagtttgcatttccctgctgacatatgatgtggagtatcttttcatatgcttgtttgccatctgtgtatctggtttcgtaagggatctgttgagtgctttggcccactcttttttttgggacagggtctcaaccaggctagagtacagtggcacggtcttggctcactgcagcctctacttcccaggctcaagcgatcctcctgccttagcctcccaagtagctgggactacaggtgcatgccaccakgctaagttttgtatttcttttttgttttcctcgagacagtttcrttcttgtcgcccagactggagtgcaatggggcgatcttggctcactgcaacctacgcctcgcaggttcaagcgattctcctgcctcagcctctcaagtagctgtgatcacaggtgcccaccaccacgcccggctaatttttctattttttagttagtgatggggtttcgtcatgttggccaggctggtcttgaactcctgacctcaggtgatccacctgctttagcctcccaaagtgctgggattacaggcacgagccaccatgcccggccaattttgtattttttgaggaaatgtggtttcaccatgtttcccaggttggactcaaattcctgggctcaagtgatgagcctgcctccgcctcccaaagtgttgggaatataggcatgagccattacgcccagccttggcccactttttaagggggttggttgatttcttatttttgagttttaagaattctttgtatgctttagataacagtcctttataaaatgtgtcttttatacatattttctcctaggctgtggtttgccttttctgttttctcactctctttctctcttttctttttttagacagggtctctgtgtcatgcaggctgagtgcagtgcgcaatcacagcttactgcagcctcgacctcccgggttcaagtgatcttcccacctcagcctcccaagtagctgcaactataggcacgttaacacacctggctaatttttgtaaaattttttgtagcgatggagtctcactattgttgcccaggctggtcttgaactcctggacccaagcagtcctcytgccttggtttcccaaagtgctgtgattagaggcatgagccaccctgcctggccttatttttttttaggagaaatgtcttgctctgttgcccaggctggaatgttgtggcatgatcacagcttactgcagccttaaactcctgggttcaagtgatcctcctgcctcagcctctggagtagctaggactacaggtgcgtgccactatccctggctaatttttacattttttgtagagatggggtctcactattgttactcaggctggtctcaaacacctggcctcaagggatccatcccgccaaatggcttccaaaagtgctgggctcacaggcatgagccaccacgtccggctgtcctttccttctcttgacagtgtctctcacaaagcacaaagttattattttcgtgaagtccatcttaatcaattctctcatgggctgtgcctttggttttgtatctaaacagtctgccaaaccccaggtgatctaagttttctcctgtgttactgtctaggagttgcatagttttgcattttacatttgggtctgtgattcattttgtcttttttttcccccactttttgtggagaacggggtctcactatattgcccaggcaggtctcgagctcctgggctcaagcaatcctcctgcctctgcctccttgaaagctgggattacaggcgtgagccaccgtgccaggcctgtgattcattttgaatttatgttcgyggagggtatacggtctggtctagatttattctctttcatgaggatgtccagttgttccagcagcgtttattgaggaaaatgcctttgcaccattgcatccctctgctgctttgtcagaggccagttgactccttatgtgggtgcccctgtgatttgaaggccccagtgagactggctgagtcgaatgaatcggacttttctttctctgtcttgagcagtgcttctcactagtgtcaggccccgtgtctttgtacatctgtgatcttggcagctgtagggatgatggtggacttgtggtatttggctgagaacatccttgcagtccaggctaggggtcatgagcatggatgagtcacctgctggctgtgcccacgcttcccccgccaccatcctctgctctcttctttgcctgtgctttcttcttcctcgacaggrtagagctggcctctctgmccaagacagctgacagtgcatctcctttcccctgccgtgtttctggaacattgaactttaccagttgtgtttgttactatttagtaaggttatcttctccatgttgggttttgctggaggtgtgggtatggcatcttctagagaagatccagacctttttggattaaaagtaaggttacaaatcactgtgctgtacttgttgtcatatgagatttctgagttgtattgttgggataattttctttttctttttttgagatggagtctcgctgtgtcacccaggctggartgcagtggtgtgatctcggctcactgcaacctccacctcctrggttcaagcaattctcctgcctcagcctccygagtagctgggattacaggtgcctgccaccatgtccagctaatattttgtattagtagagacagggtttcaccrtgttagccaggatggtctcgatctcctgaccttgtgatcygcccgcctcagcctcccaaagcgctgggattataggggtgagccactgcgcacagcctgttgggataatttaagcttgacagttcaaggcctatgaaacaggaccagggctcaggagcatcctctttttcaggccgttaattaaggaaaagttgagccagggcgtgaccctcgtcgtggacagatacgcattttctggtgtggccttcaccggtgccaaggaggtgagtgccacttggcctcctgtcaggcgagcacagatgtgtggacccaggactgcccttgaatgcgagtacgagtgacatgcctcagattactctgcagagtttcgtgattcttatattccttttatctctttgctagattaatttggttttatcaataagaagagcaaacatttatgtagctagagattgtttcacagatagaaccatagttggtatttggattatattttccacacgcttttttttttttttttggggagacagtctctcattctgtcacccaggctggagtgcagtggcacgatctcagctcattgcaacctctgcctcctgagttcaagcgattatcctgcctcagtctcccgagtatctgggattataggcatgcaccaccgtgcccagctaattttcatacttttagtagagacggggttttaccatgttggccaggctggtctcaaactcctgacctcaagtgatccactcatctcagcctcccaaagtgctaggattacaggcatgagccactgcacccagcctccagatgcattttcaaagatggttcatttgtagtacttttttcccccgttttttgaaagagggcgtctccctctgttgcccaggctggagtacagtggaacaagcaaagctcgctataacaactcttgggcccaagtgatcctcccgcttcagcctcccaaagtgctgggattacaggcdcgagccaccgtgcccggccacgccctcactttttaattctgccatttcttcatgtgttagcttgagtccttcccctctgaagtattacgttgtataataaggaggacaagactcatgattcctttgcttcttcctgctgtgcggatcagctgacagagccgcaggctctgtgggaggttctcgtggacgccttccctcagctcattgtgctgttgtgtgatgtgtggcctgcagtcacagcctttctggtcctacctttcctccggaaacaggacagcatttggagggagatgggatgagtaagggagggagagagggtgctsgcacagccctggcaagaagggccagtggatgagactaggctggcacataacaggctctaggagtgcctgtcttcttcctgctcttccacgggagaggagaccctggcgtgtgtgtggcagaaaagacactgccaaggacctcgtgcctgtgtccggacccagctgctctgtgctgcaggcgtyctaggccgggggtctccaggggytctgtacatagactgtttgctcctggccagcaggcctgtagctgygctgggagggcctccatggggcctgggctgtgggtggcrgggactggcagccgttctrtctacctacttttctgtccacttgtctgtttacaaaggaaaaacaaaggtgacactggagaaacsgacacrtttgaggttctaaaaattaaacgagccacaatataaacagtctcacrtcttggtacctcaccaaatgtcccctcattttttcctgtttttacgactttcgaaacaaaaacctagactacactaagctttaactgttgggttctttcttggcagaatttttccctagaytggtgtaaacagccagacgtgggccttcccaaaccygacctggtcctgttcctccagttacagctggcggatgmtgccaagcggggagcgtttggccatgagcgctatgagaacggggctttccaggagcgggcgctccggtgtttccaccagctcatgaaagacacgactttgaactggaaggtgagaatcccagaattgcacactaggaagcgtggagaagtggctcaggatgacaccgtggtggctggcacagtcgtgtcagcaaagctgctgccgtttccgtctggtcctcccagatgtggagccccgggagtagtcgttcaggggttctcggtgccagcaaattcttttttttttgagacagaatcttgctctgggtgccaacccaggctggagtgcaatggcacgatctcagctcactgcaacctccgcttcttgggttcaagtgattctcctgcctcagcctccrgagtagctgggattacaggcacgtgccatcatgcctggctaattttttttgtagagatggggtttctccacgttggtcaggctggtctccaactcctgacctcaggtgatctgcccacctcggcctcccaaagtgctgggattataggcatgagccatcgcgcccggccagtgccagcaaattctaacccgatgagttttgctaaatgttgacatttggcgctttgtctggtgggtcaggtgagagtctgcgcaatcctccacatcctcagcccctcttcagacacgagcgccagcctgttcctgccactgtgtcctctggtgcggcctctcgctgggcatgggccctgcagcagcacctggccatctaagttcaggagggtgctgtgtgctgcctctcccttcagtcctgcctccttcaytctcagcagtcccaggtctggctctgctcccaggacgctggactctcccctcccagtggactcgcaggctggccgcctctgctcctcccgaccgcagcccctacctctctcccagactccagtcgcccgtgcccaccgctgcccacgtggcctctttccaggcrgcagccagggcttctggcacgtcgggcgccagcactgtcgcttgtggccacggcccgcrgagcttcagtcccttgagctcctcctccagagcagggccgagggtctcgccccagcccgactggctgtgcctgcagatgatgctggtcacgcagcttttcgtttcccggaacgcaggtgggatagcagtgcccttttctggcagtgcggcattctctctggcagtcattccgcccggagaggctcatcttgggcggttctgggcgacagctgtgtggctgcacagtggccagtgagaggcatctgggaaggtggcccttgtgtagggagtcactctccttccgtcacggtcacacctcatgaaatggttagattcttccaagtgccttctacgcccctggcagattttctagaatttgcygtcccagaagcttgagaagkgtccggtgccacccgacagcagaagccgggatgccgctgagaygccagcgcttctgagtccctctcactgcctgccttctggtggagagaaggctgtcctgcgggcttatgccctccccacgytcctcgcaccgttcacgccattgtgcagcacagctgttaggaccaaattcatcttccccgcaaggacgagtcaggcccagtgttgcactggtcctgctgtctggcttctgctgcggaacttcctcaccttccaggcagggcccaggagccacaggagcgtgggcrgggcagggtctgccctctgtgcttccgactcgccgcttgygagctggagggacagtcacctcgacctggtgggctgggtgggyctggctgtgctgtgggctgtgcctcactcctgcaagtgggcactcagcggggttggggtcacgaggctgaggtcggcttaaagcaggagtgggcagttggcacrtcatgtttctcctgcatcagggctgtggcaggaatgccgggtgactaccgtagacacttgtcaaggytgaggttcagagaaaggtgtggggtatcccggaggtcaccacagtgtgccaggaggttcaggttggccttccagagcccggcctgtgtgaaatccccacgagcacagaggacagaacraaacatggtgttgttttgaracagggtgttactgtgtcacccaggctggagtagagtggtgccacattttttgtagagacggggtgtccctgtgtagcccaggctggtcttgaactcctgggtacaagcagtcctccctcgtgggcctcccaaagtgctgggattacaggcgtgggctcccgtgacyagcctggaacrtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcrgaaggcccygtccccagcrgagtccagaccccacaacttcaggagctctttcccggcagcagagatctgcaggctgcctcttytgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaamgacctgaaaattgtttgtggaacgcttcacttttcttagactgaggacggagctggctttgaatgggaacctccatcccaggagagaagagccttcattgggcccagtagggccttcctggaccctggttcctgcctagttgagggagtcccactgtgggtctgaacagttgcagccatgccctgggctcgctgggtccagccaggctatatccgagtgtcatcacagcttacgtcctgaactcacctaagttaactctgctattttcattgcaaccctggagcttaacttctcatcctatcctttattttttatttttttggaaacagggtctcactgtcgcccaggctggagtgcagtggcacgatcgtggctcactgcagccttgacctcctgggctcaggtgatcctcctacttcagcctcctgagtagctaggcctacaggccttcactgtgcctgggtaatttttttgtggagacaggatttcgctatgttgccagccaggcttgtcttaaactcctgggctcaagtgatctacctgccttggcctccccaaagtgctgggagtacaggcatgagccaccatgccgagcccattgcatccccttttaagtgacacttagaaggaatgatttgacactcctggcagaatctgtcccacagagcacactccgcatagacagcagcatacagtgtgctggagtagaaggcaggcagggtcccccatctgtgggggcagcagctgtgggtctcagcacccttctgtggccaagagacaaacccaggcaaaacaaaaggatttcactcttgggtaagcattgccaggggctgtgggatgggcctgggtgaggaaccttcagatgagactttcctggactatccaggtgggcccagtgtcatcacaggggcctttttttgttgtcttaagactgggtctcactctgtcatccaggctggagtgcagtggtgcaatcttgactcactgcagcctctctttcctgggctcaagtgatccaccttagcctcccaaagtgctgggattacaggctggcgccaccatgcctggcccatcacgggtccgcataacagggaggcaggcggtccgagtcaggaaatgagatgccaacagcaaaagctggagagatgccatgttgctggctgtgtggttggaggaaagagccatgagccaagcagtttctggcatccagaagctagaaaggcacagcaacgttctcccctagagcccacagcacgacatggctgtctgccctccgggtctggaagaggctgtgctgttccaggcactgaatgtgatcatcttttagagcagccacaagaagcgaatacgagcatcggagaggccacaagtcctcagccacctcaccggggacccagcagggccccctccggtctggctttgggcccttcacacctataccagggctgcccacagggatgcactggccagagtgagcaatgtcctcaccaagccccctgctgtgccccaggcatggcctcccacaggccaggacagtcactgcgcacttggggaaggctttgctatgattcaaatcgaggcaaaccctgcaactccaggcacttcctgtgacttcctcctgctgaagatgggaaccgccattttactttcctaaaatcctattttccttgcactttttccttctagggttgtatgaggtggctgatgccacggctggtagagagccaggctgcaggcaggacaggccccctgccagggctggggacacacctgctcagggccccacagcccgccacgcaggcagccacatcctttacgtgtgaacgggctgaaacattcacttattttttttctggaactcacattcaattagaacttaaggaaaaaatagacacaaggtttgttttctactgaaacttattatttgccattaagaattgcaaactatactactaagaatgaacaacattctcttcattaagcctttttcaaaacacacgagacaaagctcccctttggtcaaggtgtcccacacattcccactgcagctcccagcacagcggcgcaccatgaactcggacgcggagcccaaggaatggagatcgcaccagccttccctgcttccccaccccaactacacccaagggagaaaggatacgaggaaatacactatgtcttcaatgcttggggggctgggggtgtcctctgctaccaggtgggccggtcagtgccgactgtccggcgcgcgtcctcggggatctccggctccccgacctacacaagcagcagcagcagcagcgagtcctgccaacgccgcagtagctgctcatgagaaaagtgcccacgctccccaagccctcctgtttacatttcctagtggggcaaagctactttcccaggacaggcagcagagcagtggggcagagtgcactctgggacccgggacagcaggttacacagggtcaggcggtggtgggtgctggaatcggggctgaggttctggaaatgccaccaggtgatgccaccctgtggtgtctgcccaccacacaccacaagactcaagtggttttccccttttggccctaaaccacctaacacctcagcggcatgggagggcaattctcagcaaggcaaggacatggggaaggctcctgggagaggcacgccgtccaccctcaagcctgactgtcacaggtggaggccccgccccccccgtcaccacacctggggaagctgccacagaatgccacagcactggaaagggacactctgagggcaggctccagcagcagctccaggacagccagccgcccttctgcccaggccgcccacgctgtgtcctgtgcacgccatcttcaggtttcccacacacccacttcctgaatacttttctccccaaagcaaggaggaacctcgccttcgttcctccaacctcatctcccactgaggtagcccttggtaagccaggctgggcagagaggacacagcggtgggcgcgcccccctcgagagcagcccagtccttgggcgtggggccgcagtgtggctgccgctcctctcacgccagcctgcacaggtcttctgagactctgactcagggagcgccccagaaattcatgtctgtgtctgacaacttcaaacaggactttaattccaaaccaaccacagaaccggcgcctgggagcaagtgggactgaggcccaggtgctaacacggggctggcagtgtcgagagaacgctctggaagctcctaacagacggctccgcgtgcggatgcacaggccctgacgggcactctgagctgggcagtctgacaccaagcagtaaggcctcccgggcagcgcagcctcagtccacgagcacagcgggtggccctctggggggaggcagcacggggcgcagccctcggcaggcgagcgggcgggatggatgaaacgcagcggcaccaggagccccaggctctcacaggtgccacccccgaccccaggattttcaaagggacaggatttcaaagtcttcatcttctgagtcgaagaatctttccagtcgctctacatcagaagaatctagaaggaacaggacatagcgcatcaggcatcttgggtgggccacctgggtgtgagtcaagggcccttggcgtggggcagactgagcagtgcctgctctgcagcccacagacagctgtccccatgcgggtgtgaacaggtccgggggttgtgcagacctgcgaatatggggggagggagcagagaagaggagcagggcagggtgaggagggcagggggcggccggcacaatctcaggcctgaggggcctctgtcccgcgtctgaccctcgtggtcatcaggagtggttccattgccattgccttgtttgtagagtttcccacagggagacagagatgaggaggacgcgctcacggccactcacttcactgcacgagcccaggccggctcctgcggcacgctggccatggtccgaggggtctacgccacccatggccagtggtgcccaagtgaaccagtcccccacccaggactgcgtcaccacagagcctgcatgttctgtctgctccagacccctgaggactccatggtagcacgcccagctccacagcgcccgggcaggcagcgctggtggggaagacgaggtgggtcctgggctgctgggcgcaagcttggaggaggggacgctccactccatacctggtctcacaggcgaaccactgccaagtgctcacggctcaggctcacacacaccttaatggtcaaaaccaagggggccaggactggggaagcaagggcacagatcgtacctccgagggaccccacctggacttggcagctctcacctagggacaggttcaggacgtcggggcaggccagatgtgaaggctgctgctccaccagctcaaacatgggcagggcacctccaagcagagacagctgttagtgagacatggccgttaggtgcagcctcaccccagtgcttgctgcggccaagagaaaggggccagccggccacagccagcggacaaacctgtcatcccatctcactgatgagaaaacagaggcagctccacactaaaggctacacgagaacccagtgtggtgatcaacacacagcacagtctgaccaccacggcagaggggggtgggccacacgcactcggccggcgtagctcagcaccccatcaccacccccatctcaacaggagacggatgaggacactggaaatcccattctaaagtcaacacgcaacatccgtccccagggttgttaactgtgttgccagatgggcaatccaggacgccccaccctgctcagctacatagctgtgccaggcgggacaaagctccccacggcccagtgaggctgcctgagacctggacgcaggccttcgacccctgcacgccccactgcctgtctccctgggtggctcagctcggctgtgggtgtggggcggctacaaacctttttgacttgctggcaccaatcattgaagtcatcttcagtcttacagaaaaacccctaaaacgaaatgacgatgagcagaacacgacacccccatctgcagtcggctaagaggtgggggcttccattcccactgccagtggcgcagcagaggcccccagcatgcaggtgctggacattccagcctgccttggctcctgtggccaggaacggagctccgagggtgccctgtgcatggtcccctgcaccagtgcccggctcccctcaggctccactgcgttgctgtgccttgattcgcccacgagatgttacgtggtgtgcatctctcaaacctcaccgagtgttccgggattggggcaggttatgagttagggccaagtggggagctcttctctctgtgactgtgaggcagggccgctgggtctcagccttcgcccagcagctccctggaagcttggcggcaaaggccaccgagaactgcccaaggacaccgtgacacagggagcctcctgctgaggagccaggagacaggggaccggccaagggtcaccggcaatcacatccttaaagctgccgcctgtaatgacagtcactaggaattctcaacgctgccagatgcgcagatgttaacacaaaaagaaacgaaatggggggagaagctcaaactgggcactctcttcccctgaagacaccattctgccgcctcggcgctggtgtaggagcactctcccccggggacaggggacattcctcctcctcacgggtgaggacagttatcccaccaggtggcccctttggtctcaactcaacgttcacgcgtccactcctctgtctgcggtggctggctctctagcctgacctgactgttagagtgccaatcactgtaagccaccaagctgcgtttacagtaacaaacatacctaattctagttcgacgaggaattcgtgactaggttctggtaagaagtgtgcgccaggctgcgcgcagtggctcacgcctgtaatcccagcactttgggaggccgaggtgggtggatcatg

SEQ ID NO: 12599 - DNA, 40000 bp, Homo sapiens
ctcccagactgaagcagtcctgcttcggcctcccaaagtgctgggattacaggcatgagccaccacgccaggcctacttaaatttttttttttttaattgaactgcacaaacagaaaatgcacaaatgataaatacttagtttgatgaatgttctcaaggggagaacacacctgaacccaccatgcagatggagaattaggagaaggaagagtgctatgtcctgtaatgtgatggagcgataagttatcatcaaggagaaaaaggccggggcctggagcgggacagttctaagggtgctgtttgaattggtcagggaagktctctttagcaaatgatggtgaagcagaggagatggaacagaggcaagggaccctcattctgtcatcagagggaagagaattctaggcagaaggaacagccagtgcaaaggcccagaggcacgagcaagcttgtgttggaggaacagtgaggatggctgctgctccataaggaatctctgcggctttaatccaacttcaagtttggggtgaacttgaagtttaaagaggaaagaaagatgagaaagtaggggaagaactggtttctcctcctggctgtgcctttgtctcccttgtgtgtggaagaggtcccaaggcagggtaaagtcgagaytcagctctggcacactcttcctgtcttcatctcatgcccagtaagaagccctgattcaagccaccagcccaagcccaggcctctgtcccgacataataataattttagctaatgtttatcaagcacttactatatgccaggcactaccctaagtgctttacatactataactcattttcatctcacctgagccctatgaggaaatagtccaccattctcatccccattttacagacaaggaaactgaagcacagagaagtcaagtaactggctcaaagtcacacagctatttagtgacagagctgggcttcggacccacacagcctggatccagacccatgaccttcaccatggggacaaacacacatgcacttcctactccactggtctttgctgatctagtaactctcctccactacccaccatgacataaataagcctcagctgttcttccctgaacccaccctctgcaggattgtccctgtgcagaacagctcattcatagatcagagccttccctggaaggggagttgtcttttcattttgaaggctgtcttggaatctcggctaaaccacggttggctcctgcgtctgtgttttgacctgctttcatactttttttttttttttttttgagacggagtttcgctcttgtcacccaggctggagtgcaatggcggaatcttggctcaccgcaacctccgcctcccgggttcaaacgattctcctgcctcagcctcctgagtagctgggattacaggcatgcgccaccatgctaatttttgtgtttttagaagagacggggtttctccatgttggtcaggctggtcttgaactcctgacctcaggtgatccccccgccttggcctcccaaagtgctgggattacaggcatgagccaccgygcccagccccttaatgctcttgaaagaaaggaggaagaagttctaggacaggagagacagattagtgaagcaacatttaaatatttactttttgaatatgtcatacattcacatggttctaaaaaaggtatgtggtgaaaagtcttatcacatcctgtcccccaggtcccctcccctgcagagttattagcagcttataaatcatatctcgctttctatcctatggaccagcactgcccggtggaactttctacaatgatagaaatgttccttatccaggctaggcatggttactcacacctgtaatcccagcactttgggactctgaggcagatggatcacctgatggcaggagttcragaccagcatggccaacatggcaaaacctgatctctactaaaaattcaaaattagccaggcatggtggcaggtgcctgtaatctcagctactcgggaggctgaggcacaagaatcgcttgaacccaggaggcagaggttgcagtgagctgagattatgccactgtactctggcctaggtaacagagtgacactcttgtctaaaaaaataaaaagaaagaaaatggttcttatctgtactgtccaatccagaggccactggccacacatggctacagaatgcttaatgaggccagtatgactgaggaactgaatttgtcatttaatttatcgaaatgtaaacaacctaatgkagctagtggcttctggattggacagcgcagctctgcacatatacaggtcaatttgcatgtctgtatktttaactttaatttttaactttatttcctctttctgccccgccaccccccacccccagcaagcagggcagcctagtgtacacgctgtttttgtttgtttgtttgtttgttctttgagacagggtttcactcctgtcacccaggctggagtgcagtggcacgctgttggctcactataacctccacctcctgggctcaagtgattctcctgcctcagcctcctgagtaactgggactataggcatgcaccaccatgcctggctaatttttgtatttttagtagagacgaggtttcaccatgttggccaagctggtctcaaactcctgacctcaagtgatccactcaccttggcctcctgaagtgctgggattacaggtcggggccaccacacccggcctgtacatgctgttttgcatcttgctttatacgttggggagtgccagatgtcaccatctttcgttcttcctctggggctggtcaaatccccctgagaaaactcctctggcctcctggcggggggtgaaggccaggctgccagggccaggctgccagcttctgggagctgcaggggcagaggcagggagctgtcaggcattcagccagcaagacgcactcagtacccacttggggttcagaatccccctccctcatcttcagatgggccagatgtccccaaagccagcggcccctttctgtttcaccctgtctacagaataaacccccagtcactgggggtgggggaagagtaaggggagaggggaaacgagatttggaggtctagctgctgctgaaacagccctcagttcgtctttattttgccttctgcaaaactggcctggtgttgccagctccttttgaggactttgctaccggttctcagcatccctcaattgctggcttaggattcatgggtttttaggggtggggtgggattagcatgtccagctgctttccagtttccaaagttctgtccctatcatattgcctctgatttaaaaaaaaaaaaaagccattttaaaaaaaagatgtaattgaggttcaagagagagtgaaactagagaggtgttcaatccatcacttttacacagaaatttcacctttttttcacttataaaatctaatgaaagagttctatattattatgttaataatacagtagtaatataacagtataatgtaatagataattaatatattatattaattatatattataattawatattatattatatatattatatattatatattaattatatatattatatatattatatattatattataatatattatattatatatattatatattatattataatatattatattatatatattatatattatattataatatattatattatattatatatattatatattatattattattatattataktatatatattatatataatattatatatattatatattatatatataatattatatattatattaatattataatatgtaacgcataacatgtaatattgataatataataggtgcgatggctcacacctgtaatctcagcactttgggaggccgaagcgagaggatcacttgagcccaggagttcaagaccagcctggccaacataacgagcacctgtctctacaaaaaattaaaaaaaaaaaaattaggcatggtggcatgcatctgtagtcccagctactcaagaggctgaggcacgagggttgcttgagcccaggagcttcaggctgcagtaagctatgatcacaccactgtactccagccttgacaacagagtgagaccctttaaatagatagatagatagatagatagatagatagatagatagatagatagacagacagacagcaagctttaaattttcatcccaagcctaggtcaagcaacaatcagtctttccacttcccagcagtcttccaaaggaaggattatttgtaaaaagtgcctgcacttcctgagttgggttgctctcttgatctttggaggggatcagacaagaaggatgcgcccaaagccacaaggcatgatttaagggcaagactggggggcgacttcacccagggaggtgttaatacctttttttttttttgagatggagtctcgctctgtctcccaggctggagtgcagtggcgcaatcttggctcagcacgacctccatctcccaggttcaggtgattcttgtgcctcagcctcttgagtagctgggactacaggcgtgcgccaccaggcctggctaattttgtgtgtgtgtgttttagtagagatggggtttcatcatgttggccagaatggtctcgatctcctggcctggtgatctgcctgcctcggcctcccaaagtgctgggattacaggcgtgagccaccgcacccaacctttaacaccttttatcacctgccctgcctgatgatgatgggctttggggtccagtcacatctccattccctcacttgtggcaggcaccagggtaaccagcaagcaagccctgaaaagagagaccttgcccggaaacgttgcagcgttctcttacgtgtatgctttgccttctgagaatggcgagcattgatgcaagtgtatcccttttaagaatactcaatggggccaggcgtgatggctcacacctgtaagcccagcactttgggaggctgaggcgggtggatcacgaggtcaggagatcgagaccagcctggctaacatggtgaaaccccgtctctactaaaaatacaaaaaattagccaggtgtggtggcaggcgcctgtagtcccagctacttgggaggctgaggcaggagaatggcgtgaacccggaaggcggagcttgcagtgagctgagctcacaccactgtactccagcctgggtgacagagcgagactccatctcaaaaaaaaagaatactccatgggaagctggtatgatctcagtggagggcaatttagcaatatctatcaaaatgacaagaacactcacccttaggctcacaatcccactactggtgatttmtcctgcagatgtagttgcacagctgtggaaggacttacttacaaggttaatcattgttgtttgtgaaagcagcagattagaaacaacccagactccaccaacgggtaatggttacataacttgtggtatatccatccatggattactacacagcactaaaaaagaatgagaactttgggaagccgaggcgggcagatcacaaggtcaggagatcaagaccatcctggctcacatggtgaaaccctgtcactactaaaaatacaaaaaattagccaggcatggtggcaggcacctgtagtcccagctactcgggaggctgaggcaggagaatggtgtgaactcaggaggcgtagcttgcagcgagccaagatcgtgctactgcactccagcctgggcgacagagtgagactccatcctaaacaaamaaaaaaaaaagaataagaacaagtctaggaactattttgaaagatctctcaaacacatttttaagttaaaaaagcaaaatgcaaaactgtacataatatgctgtattatctataaaatagagcaaataagaattataggtatgcttacttgtactcatataaagaaactctagaagaataccaagaactgtggatgagggtagaatagtgaatggaaactgactgattagactaaagaggtgggagtaagaccttttatgtatcgctttacattatttgactttaggaccatgtggatgtttgcatattcaaataattaattcttaaaaagaagatgaaaatagaaggtgggcgcagtggctcacacctgtaatcccagcacttcgagaggctgaggtgggtggatcacttgaggtcaagagtttgagaccagcttggccaacatggtgaaaccccgtctctactaaaaatacataaattagccaggcatgctcgtgggtgcctgtagtcccagctactcgggagactgaggcagaagaatcacttaaacctggggtggcggaggtcgcagtgagccgagatcatgccactgtactccagcctgggtgacagattgagactccatctcaaaaaaaaaaaaagaaagaaaattaagcaatagtcccaacatactaaacgcatttgtttctctcctcaaaggaaaaattagagggcgagttatagagggtcttgaggttgtgtgagtcaggatggcctaggttttgctgtaataatgaacagccctcaaatctcagtggctgaactcattgaattttatttcttgctcacttacacagccaccacgggatgttgggggagtactgtttatctgagtcattctgggacccaggaggatgggcattcagcccaacgtaattaccatatctggcagcggtggctgcgaaggcttctccttggatgcgatgccgcagctccctcccactcacacttgattggccaaagcaagtcacatgacactgcttacctgcaagggggcagggaggtgcaacgctactaagtgcccgggagagggagaactgcaatttcttggcaagcggcaaaagataaccacagggtactgtttcatcaagggccgcccaaagccctgtctgaatatggggctcgtgtttcccctgctatgtagttacacaggcctcctgcagcttagtttcagcttttctagtttttcatggctcccagagggaatattttctatgccgtatagcctsttttcacatgaagccattttggggtgttatagtaacagctggtgacttgattttatttatgttgctatgtgctgaaagctttatgaatgttctggctgtgccagttactagctgtgggacatggaacaagttatgaacaacctatttaccttctccaacccttagttcatttatctgtaaaatggggataatactatcttatagggctgttggggttgttgtgtgagaaagtgcagtgtgtatgtgtatgtgtgtgtgtgtgtgtgtgtgtgygtgtgtgtgcagaatgggtagaaccgtgcccagaagtaggaagccctgcatatgttcaatatttagctattattttgttgttgttgtttgtttgtttgtttttttgagatggagtctctctctgtcgcccaggctggagtacagtggcacaatctcggctcactgcagcctccgcctcccgggttcaagcaattctcctgtctcagcctcccaagtagctgagattacaggcgcgcaccaccacgcccagctaatttttgtatttttaatagaggtggggtttcaccatgttggtcaggctggtcttgaactcctgacctcaggtgatccacctgcctcggcttcccaaagtgctgggattacaggcgtaagccactgtgcccagccttagctattatttttattccttcaattttttctttggggcagtctggagaacagtttcatgtgaacattctgatcacatggaaaagggaaggtttactcacgtgtcggaagaggtgtgaatggaaagtagtaaaggcatggtttctgatgttcatgtttgtggaatctgtcgtctatggcagatgcttccccgtgctaccaatttgtgtgtctgaaaggacacccgtacattcatytgcatcctcaaaatctgttcctccgtgggtttctccatctctgcaaaatgcactgctgtccactgtgtgcctaagccagccctgtttggtcaattttttgaaggctgtagggtagagtggtcaggaacaagaagccctggacccaagctgtcagggttcaaatcccagctcacctggtattgcaaatcgcatgggtgactccaggcaagcaactgaagccgtgtgtgcctcggtgtcctcatctgaaaaaggggaatgagaatcatagtatctatcttacagggatattgtaaggatgaaagattagctgttggaactgtgcctggtgcagagaaactacttcatgtgtgctttgcacacccgaaaccttcttttttatatttrtttatccttggcctgggggctgtctcctctcactcagtggtgtgtctcatttgttctcctctgtgcctgagccagcacatggcacatcatattttctcagtaaatatctggcagaaaaatgtattcatcagcctggccaacatggtgaaaccccatctctactaataatacaaaaattagccaggcgtggtggcgggcacctgtaatcccaactacttgggaggctgaggaggaagaatcgcttgaacccgggaggcagaggttgcagtgagccaagatcacgccactgcactccagccagggcgacagagtgagactctgtctcaaaaaaaaaaaaaaaaaaaaaaaatatataaatatatatatatatatatatatatacacacacacacacatttacatagycccgccttcatcaaatgtcaccctgccccttaaaatgccgcccatgcatgttctcccacctactgcttttgtttccaatcattcctaatggcccggatcyattggatcccagcatcactgcttgttagcgcagtggccttgggcaagtcactcctctggtgcagatgggggtccctaagaccaccctcagtttccatgattcactagaaggaatcacagaactgagaaaaattgttatagtcaaggctacagtttattacagcaaaaggatacagagtaaaatcagcaaaggcaagagccacacaaggcgaccccatcagtctctctgattccttaattatctaacagcagcacatagggcagaggccaagagagaccagcatgagctgccagatgtcgtctctcagtgaagtcccatggacagtgctcagttctcccagcaatgacatgtgacaacaatgatgtattgctagccagggacacttacttgggccttggtgtccagggttgttattggggtcagccatgtagacttgtgctgaatactgctgagagatcgagacagacggtaagaacggctgagagctgatgcacgccaggtgtccttccatgcgttggccaggagtgatctcattttagcccatccatgaccctgttaaatagacatctccatttttccagacaaggaaccaaggctcattgaggagaggtcacttgcctgaagtcccacggctaataggcaaatccaggagtctgatccttaaacctccacccttacagatgtggccttggacatggctgcacaccctcgcgtgagttcactcactcaggatgtattgagccattgttccagggcaggtagcattcaaagcatcaggggtgctgttatagscaaggctacagtttattacagcagaaggacacggaataaaatcagcaaagggaagagccacatagggcagaggccaggagagaccatcccgaaggggaacatccctgtgcttgtggggcttccatcttaaggagggcaagcaggcaatgggcagatcaggaaacgaagatatgacttgccaaagggtggtaagtgccatggccaaaaggagscagagagagatggggtgtctgcttagttgggaagtcacagaagascgggacgtgatgtttgaacagagacgataattataatggccactttcagaacacttactatttgttggataagtaataacagtaatatatgtaccaggcaatgttctaaatgcttgaatgcatctcatctttccaatcacagagatgctcttattatcatcactttacaaatgaaagggaggttagggaagttggcagaaggcacacagccaggaagcaggggctccaggatctcagcccagggatcttggcctcagaggctatgcttttcaccactgtcctgcctctcagtgcatggagaaatgaatgttcagtgcctagaagggataatcagggaatatggaggttaaggaggcaactgaggcacagagaggttaaatcrcagggttcagaagtgttgggggtgggactcaaagctaaatgatctgcctccacaatctaagctcattaccaccagaccagtcatccttaagcatgcataggagtcccctggagggcttgtcaaactagattgctggggcccgcccccagagtttcagactcagtgggtcygaggtggccccgagaaggtgcatttctgtccaggtcccaagaaccgatggtgatgctgctggtccagggcccacattttgagacccactgccctagactgcctctcagcacacggaggaatgaatagccagcttccggcggaggaaactgaggctcagagaagctaaaagtgtcatgtggaaaaaatcacatagccgttagactgtggtacctggatctcaaacccaggcaatccggctccagagtgtttttaaccatttccctgcactgcctcctgccggtcaaaagaataaaygcatatgcaggcaagaatgaatgggtggtcccatttccgtagaaggggaaaccgaggtcggggagctgggcggggagaccccagcatcctctgacctctttccttgcctccctgcccccgcccgcaggtgaagctggtgttcgtggaggaccaggctgtggtggagacggtgttcttcytgacgtcgcgcaccagggcgctgctgcggcgcttccctcgcatgctgctggtggaccggctgccggggctgcagggcgcgctggatctgctggccgtgctgtgcgtggacggctcgggccgtgcgcgccaggctgcctgctgcgtggcgcgcccgggcacaccgagcctgctgcgcttcgcgctcgcgtcgctgctgcagagcgcgccagacgtcaagggccgcgtgcgctgcctcaccgccgggcccgaggtggcggcgcagttgcctgcagtgcgccagctgctgccctgcgcgcgcgtgcagatctgccgcgcgcagggcctggagacgctcttcagcaaggcgcaggagctgggcggcgccggccgcgaggacccgggcctgtggtcgcgcctgtgccgcctggctggcgcgtcgtcgcccgcagcctacgacgaggcgctggccgagctccacgcccacggcccagccgccttcgtggactacttcgagcgcaactgggagccccgccgcgacatgtgggtccgcttccgcgccttcgaggcggccagagacctggacgcgtgtgccctggtgcgaggccaccgccggcgactgctgcgtcgtctcagcccctcgcgtggcgtggcgcagtgccttcgcgacctggtggccatgcagtgggccgacgcggccggggaggcggtgcccgaggggcccgatggcggggggccttggctggaggatgagccagggaggggagcccagggggagaacgagagggtgaggggcctggagacaggcgactggggaggggctccgaaagaaggaagtatttggaggggagcccagatggagaaggagtgggcaagggcactggaaaccagagactggggcggggctcagttcgaaggtgagaaggggagggcactgcagatcagagattggagagggggtcggttggagaatcagaagccgaggggactggaagggggtgtcttgagagggtcgaagttagagaaagggcacctgagagggccagagattagagactggagggggccccagttggagggtgagaaagattggggaktggaaggttatgtctggagggggtcccagttggaggaccaggcgctaagaggattggaagggtatacctggagggtggcccagctggaagatcgcaggagtaccaccgacctgagggggacccagtttgactatgagagggtcaggagtcttgaaggaagcccctggaggggggcgcagctgcacgatgaaagggcagggggactgagaactgcagaatggaaggggccacagtcagaagtagagaaggggagggggctggaggtcagaaacttgagggggatccccttggagaagtccctggagttggcccctgagaacggagaccaaaggggaccccagtgggaagatgagaggaggagagggccagagattgcagaggagaggggagcgagggtgggggtcaaaagaagaaggggcctggaggatatagttctggtccagctgggagacacgagggtcacaggcatggagaatggagatggagggggagcccggtccgtgggccccaagagccgagccggacgagggatggagtggggagacgcaggagggcggtgtctagggctggggaatggagtcgtgtctggcaccccggtggggactgtattggaaggcagcccagaatgggcagcggcgaggagtgaacacctggctgcaggtgacggcctgcaggaaggaggcgaagatggccccagggaaccaaagaggctttgccgacccccgggagaggaggaggtggactgggaacccctggccaaattccgagcagcctgcgggccagagctggcagacctggtggctgaggagttggcctttgctaggcagcatgggacccggggtttccactggaccggagctggctttgcccttaaggacggcacctcggacttcttcctggatggggccctgacacgctgcagctgctcaattcacgccgcccgccgtctgccctgcagacacctctttgcagcgcgcctcctcactggggctgccttattccacatggacctgctcagggattgctgggggagagccccagagccctgacccttcatgcctctgcccaccaccctccaccaggagggtcggagggcattcttcgatcccaaagataatagggctgaggccaaggagaccgttgcagtccccctggccaccttctgggtcatccagggacctcctcatggcagtttgcctctctgggtccaagggcaagctgtaagtggtctctgaggtcctggagccacagcttgggaaggtgttgatgggcagggtggattctgagggcttccctctggagaggaagcatgtgatgagaggtgtagacagggtcaggctgggacagaaggaaggaaaggggcagagctggggggagggggaggaagcgatcatatggggagtgtctggcaagagtagactggccagtctagggagtgcagcggggagaggggaaagggagaaagtacagaagacagatgaaggagaggaggtaagcgagaaaaaatggaaaggggagccggaaatggaggagagaggacaagcaaagagacagaaatgaagacatgaggaaaagctgggggaagcaggagaggaagggacgggatgtaggagggggaagaaaaatcggagatgagacaaaagaaatgtgtgggagacgggtagagacgaaatgcaaggggcgtggttttggtttttctccaagacctggagacatcgacccccatcgccttctgaagagagagggagggcgggcactgggggtcaggagagtctccagcaggggaggggaattgtttggactattgttcttcaggattggaataaaacaatcttattttggtttccgtgatgagttcttggcttctggggttggttgggagtcccagatccagggaacagttgagatggtccagcgttccttcattctttctaccgacaaggcctcctggggccagatggatagaggagccacaatgaattcatctccatagcaactcaagcttcctcctccatcatctggaccagtgcgtcccagtggcaacttcttgacatgagtcgattctaccttcaaatgactgactcatgccaaatgtcctggccacagaatgggcctgtgacccagtcctggtcaacgagtctgctcaggttgaggtgggaggcytttttatttttatatttttgtagaaacagggtcttgctatgttactcaggctggtcttggactcctcggcttaagcaatcctcctgccacagcctcccaaagtgctgggattacaggtgtgagccactgtgctcagaactaggaagcttttttttttttttttttgagtcttgctctgttacccaggctggaatgcaatggcacgttcccggctcactgcaacctccacctcccaggttcaagtgattttcatacctcagtcacctgagtagctgggattacaggtgtgcgccatcacacctggcaaatttttgtatttttagtagagacggggtttcaccatgttggccaggctggtctcaaactcctgacctcaggtgacctgctcgcctcagcctcctaaagtgctgggatcacaagcgtaagccactgcgccyggcctaggaggcttctaataaagattctatcactcctaagaaggcctagagacatgatcaggcctagacctgctgatgattaccttggtatggtgtgataatgaagtccacactgaggatgacagagctgagatgaagaaaatctggatctttgcttggctcagttgagtctctcgagtctgctctaccatggggcttcttaagtaaaatatatccttttttgttagagacagtgtctcgctctggcccaggctggagtgcagtggtgcaaacatagctcactgcagccttccagctcttgggcccaagggatcctccagctcagcctcctgagtagctaggactataggctcgtgctaccacctagctaatttctttttcttttcttttcttttcttttttttaactttttgtaaagatgaggtctcttgctacgttacttgggctgttctcaaactcctggcctcaagcgatgcccctgcttcagcctcccaaagtgctagaattacagatgtgggccattgcacctggccaatcaaagataccctaatgatttagggaagtttgagttggggtttctgttrtcrcaactgatgaaggggatttaattctattataggtgacaaagtccagsttgaagtagctcagcatttttcaaactttagcgtggacgtgagtcacstgggcaccttcttaaaatacagagtctgactcagtaggtctaagatagggcccaacattctagcaagctctccgatgatgtggctgtgctgggttgtggagcacactttgagtagcaatgaaggaacttgarataaaagacaattcaggccgggtgtggtggctcacacctgtaattccagcactttgggaggctgaggtaggtggatcacttaaggccaggagttcaagaccagcctggccagcaaggcaaaatcctgtctctactaaaaatacaaaaattagccagatgtggtggcgggtgcctgtagtcccagctacttgggaggctgaagcatgagaattgcttgaacccaagaggcgcaggttgcagtgagccaagatcgtgccactgcactccagcctggrtgacagagcgagactctgtcaaaaaaaaaaaaaaagaaaaaaaatgattcagtggttcaagtcatgcgaagtcaaaggctttgatggcagctgactgcaggggctcaaacaatgtcaggtttcccctctctcgcctgcttttcgtgcgatggatttcttcaaaagacagctctctcctgagaaagggggggactagaagttcccatatcacaccctcctatcttgatccaaaaataccattctatcagcattcrtatattaagtctcaaggaagcagcaggttggatttatggaggtyatcagttatccatggctacataaatgctgtgttaacaactataaaacttcctaagtatataacaataaacatgtatttggaatcaacctaaatgcccatcaataatcataagctagataaagaaaatatggtacatatacaccatggaatactatagagccattaaacaactagatcatgttctttgcagggacatggatggagctggaggtcattatccttaawgaactaacacaggaacagaaaaccaaatactgcatgctctcacttataagtgggagctaaatgatgagaagaaatgacacagagagaggggcaacacacatggagacctactrgggggtggaggatgggaggagggagaggatcgggaaaaataactaatgggtactaggcttaatacctgggtgacaaaataatctgtacaacaaayccccatgataaaagtttacctatacaacaaacctgcacatgtacccctgactttaaaagttaaaacaataataaaaatgaacaygtattgcttatgagtcttgggtcacctgaggggttggctagacccttgcttttcagtgtggtgcatgcaacagtgtcatgaacattccctaggagcttgttagaaatgcagattctcggctgggmacggtggctcacacctgtaatcccagcactttgggaggctgaggtgggcggatcacctgaggtcaggagatcgagaccatgctggccaacatggtgaaaccctgcctctactaaaaatacaaaaattagctgggcgtggtggcgcacctgtagtcccagctactcgggaggctgaggcaggagaatctcttgaacccaggaggcggaggttgcagtgagccgagatcgctccactgcactccagcctgtgcgacaaagtaaaactccatctcaagaaaaagaaagaaagaaaaaagaaagaaatgcagattctcaaacccattccaaaactacagaatcagaatctcattctaacaagatcctagtatgcatgttatactttgaaaagcaaagcaactgatcataaacctacaattatcggaaataggcttatttaaaaaaaatgaaagcagctaatcttgataaagtagctgatcttcgttgggcttgcccacatatcgggagtcatctggcttttgggtgaactaaaaaggccttggcagggcttggtggctcatgtctgaaatcccagcactttggggggccaaagtgggaggaccgcttgagcccaggagttcaagacgaacctgggcaacataggaagaccccgtttctacaaaaatagaaacaaaattagcctggtatgatggtgcacgtctgtgatctcagctactcaagaggctaaggtgggaggatctcctgagcctgggaggtcgaagctgcagtgagccatgattgttccactgcactccagcctgggtgacagagtgagactctgtctcaaaaaatgccttggccgggaggactagggtaactcgttcagcacgtagacccctccagtacaaccctatgaaacttccctgcagcccctgcctttgcagacagctcttcgtctgctgtgctgcccattgctttcttgcaatgtactatctgtctaataaatctgcctttctttccctacgactgtcttgataaatgcctttacctcccatgatactggccccagctagtcacacccgtgatgcccatctcttttttttttttgagatggagtctcgctctgtcgcccaggctggaatgcagcagcacgatctcggctcwctgcaagctcygcctcccgggttcacgccattctcctgcctcagcctcccgagtagctgggactacaggtggccgscaccacacccggctaattttttctattttttagtagagacggggtttcaccgtgttagccaggatggtctcgatctcctgacctcatgattcgcccacctcggcctcccaaagtgctgggattacaggcgtgagccactgcgcccggagatgcccatctcttaaaataaaaaataaaaaaaaaaaaagaaagagagaaaggaaaggaggcaggagggatcctgggaaggcaaacaacagcwattgagcgcaaaccaaatccaaaacttctccacttgcctgttttatcattagattcttagatgtgggctatctggttagtgacgggaagctgaattaattcattaattgattcaccaaataacacacagarccctggggtggaaaagagctcagcccrtaaggtaaagagaagatgggccagtgtagatgggtcagagtgtgaragagggagagatttggacagtgaaatccgcaagcccttaaagatagaagatgaggtgagtctttatcctgggaggtatgggaagccttcaaaaggttttaaacagagagtggcttgattggatgtacattagaataaccacctcccctaccccagaagctttactgtgacaaatggattggatgagtccagaccaggaagagacgtatgtgaccataaacaaacaaataaaaataaattttaaaaaacaggcagaaggatcttcacagaactggaccttgaagaatgtgtttgccaggaaaagagaatgaagaagtacgttcctattggagggaactgcacgtattacagtatttggcccttcaggaaggcaagaggaaactaaaggttagtaaaccttaaccctctatatgccccacatatatagctcacagtgttaaatcaagtttagcctaaagctgcctccttacatattttaagttyggcctgaaggtttttctgtacgtcgtgaactataacaagtggaggtgtaaacagaaggtggcctacrcttgtgccaatcaccgagttttgggcaatcaaatgtagccaactgttcgaactgtgtacagcaaacgccgagctgtaatcaatycagctgtttctgtacctcacttacgttttctgtatgtcactttcctttttctgtccataaatcttccaccacatggctgtgctggagtttcagcctactctggtccgaggctrcctgattcgtggatccttcattgctcaattaaactctatttatttatttagagatggagtctcgctctgttgcacaggctggagcacagtggtgcgatctcagctcactacaacctccaccttctgsgttcaagcaattcttgtgcctcagcctcccgagtagctgggactacaggtgcccaccaccatgcctagctaatttttgtatttgtagtagagacygggttttgccatgttgaccaggctggtctcaagctcctgacttgaagccatccgccctcctcggcctcccaaagtgctgggattacaggcatgaaccacagtgcctagccaattaaacttctttaaatttaattcgtctgaagtttttcttttatcacaagtcacatcaatccctcgggcccctgctcaaatgccacctcttcctgaaagccatccctaagtagtctctcyaaagagccatccctgcccctttctttgctttatccttcacagcacttatcactacctgaaattatgccacacagctatttaccastttggcattgtgattaagcttatcaagtatgaagccagactgcctgggttcaaatcccagctccactacttccttgtcatgtgaccttccagcctatgttacagttgaggggtcataatagtacctgtctatagggctttgtgaggatgaatgaattagtgtgtgtaccagtgttctaacatygcctgcatttccatttttcccaaagcagcccagttacttattaacatactgctttttccagtgacacgtgttcacagttattaagtcgatctcccgccaaaatagaagctctatsttgttttccattgtatccccagtgcctagaacagtgcctgttgcaaagtaagctttgagttaaaaaaaaagatgaaagaatgaaaatggcagactgcctagcagaactagcycttcccgatgtttcattgttgctatagtgacgatccagtctgcacgaagatcccagcttccttaaccttgttcctacctccagccagctcacccattggccacctgtatctcctgctgtagcagccagaaagctacaactcccarccggctgagcgccaccagsgctttcgcgtccaawtccctttgctgagtgtgagggcctgcgcagtagaacccgcgggcccagagctccatctgagcatgtgcaggctgcggggtgtttccttcgtctgctggcgggagaggagtggggaggagctctttacccgctgagcattgtggggcccgcttggatctccttgtccaaagggtctgggcgccggggctgcagtctctgkgtgaggaggcggacgcgggaaacctgcttcggtctccatggttacgagccgctcagcgcgcaggagggggattcaaaggttggcgttgccacagtaaccctggagtggaaggagacggggattagagacctcgcgggagaaattagactaacagcctgggaactggagggatggagggtrtrccggaggaatcagtctgcagtaaggggagttggggtgatattaggggaaatgggatgttttcaaggacagggagtgttttgrtgaattcctatgtaataaggagatttggggagatcattgaaatcgacawgttactagatacttgggatgctcaargggaagtggaaacgcagtaggatccgcccgcctcagcctcccaaagcagtagggaaaattggggtattaagctcttttgccattctgcagttattatagagctcctgctggaagccaggcacagttgacagtactggtaaacaggacagatgtgactatagacggaattggggtttcatggagaaggggaggtataagaaaaggggactgttgtcctctatgggagggactgggaggcgattgggaagaactggcgctgtaaagagaagctggaagttttataagggaattgaggtattatataagttaattctgttgttatttatagaaggccaactcagtagcagcctctaggaagcactgaggattcctcagtatgcaaaggcatttagtgatagagttaccagatttagggggaaagcaatggccagttaaattctaatttcggaaaatgcataatattgtagttactctctgttgtttatctgaaattcaaatttagctgggcatcctgtattttatttggcagctctcattatggttaatttaagtgtttgtgaagagtgggttattataggggaaacaggtattatagagtaattgggttgtaggaggagctggggatagtcaggaaaagtcrgagtgttgaagctaacgccaagatcagcactgactgtgtgccagagactatgctaagtactcttatttttaaaaacgttttattatggaaagtttcggccatatacaattgtttgcttgtttttgagatggagtcttacgctgtcgcccaggctggagtgcagtggcatgatctctgctcatttcaacctctgcttcccgggttcaagcgattctcctgcctcagcctcccgagtagctgggattacaggtgcgcaccaccacgcccggctaatttttgtaattttagtagagaaggggtttcaccatgttggccaggctggtcttgaactcctgacctcaagagattcacccacctcagtctcccaaagtgctgggattataggcgtgagccactgcgcctggcccatatacaattgttaaacagataatatataataaagctacttgtacccatctctgctttacatgagtgctgttgaggcatcccaacattcctatgaggtagcgttactgtcacacccccattttacagatgaggaaactgcaccacagagaggttaaataacttggccagaggtgttagaaccagaatttggacccacacaatcgggccccagagtctgggctctcagctgccatatcacatgtaacctccgtctgggaaatgtgagtagggagtgaggcatgatgggagcaacaagagagtagtagtaaggtataaaaggaaaggtagggaattgggccgtttgagcattgtgcagttgttataggatttttatttttattttttgagacagagtctcaytctgtcacccaggctggagtgcagtggtgcaattttggctcactgcaacctccaccttctgagttcaagcaattctcctgcctcagcctcccaagtagctgggattacgggtgtgcgccaccatgcctggctaatttttgtattttcagtagagacgaggtttcaccacgttggccaggctggtctcgaactcctaacctcaagtgatccacccgcctcagcctcccagagtgctgggattacagccgtgagccatcgcccccagccagttgttctaggatttttataagatgttttgggagactgggggagttacagaagagtttggtgttttgaaacattatgggaagttgtatagttgcatttcaatagaacagtagcagctagccacatgtgggtgcattacattaattataatgaaataaaactcagcacatttcaggaagcgcctaccgtattggatagtgaagatctagagcagtcccaatgagtctggataacagggatttagggtaaccaagggttaaggcacaagcaggtgcagccagttctaggcaagattgggcagcatccaggccacatcctcactcctgtgataacaagacagaagtctccacttcagcctcttgattggtcacgggccaatccttcatagggtgtaaccaactggaggcctctaaagggcacctaggggtgttaccaaattcttttagcttaatgaaaactctaaagagcactgcagtcaggggctcttgagctacttgctcaagcccactccgactctggagtgtactttcacttccataaatctgtgctttcgttactccgctcttttgttgctttgtttgtgcattttgttcaattctttgttccacacaccaagaaccctaacaactcacagtcaggaccttccatagggtaacaccatcactgcagaaagttctgttggacagccctgatgtgtggggtgacaagtgtggaggctttcctggytcctaaagttcgacctyatctcttagcgattgctctcgtacttcctctgactcacccctaaccttctcctctctgttctactaaaaatacaaaaattagctgggcgtggtggtgggcacctgtaatcccagctactcaggaggctgaggcaggagaatcacttgaacccgggaggcggaggttgcagtgggccgagatcacgccactgcactccaacctgggcgacagagagactctgtctcaaaaaaaaaaaaagaaaagaaaagaaaaaaaaaaccatgctgaattggccaaatatttatctaggacttcccagcctgagaactgtaagaaataaarttttactctttaagccactgagtccatggtattttgttatggcaacctgagcaggataaggtagtatacayacctttaacttcactgtgtaacttcagattaatttccaaaatcaagcattacctaaccaacagcagaacttacatttgtgctccatatactcaccagtagtaggcattactgacttcttaataaatggaagtttgatgaatataaaatgtagtatttttatggcttttaawgaggtttctgataactagacgtatgaaattctacttttgttcattgtccattgcgatttacaaactgtaacattttactcataacgtttgcccatttttcacaaggagttttctgtttgtttactcatgttgaatcatttttatgtattataaatatcacctgatatttacatcttcttcttagtrgcttcattctaatgaacttcttcttttttrttgttgtttttctkttttkttttttttttttttgagacagaatgagactctgtcagccaggctggagtgcagtggtgtgatcttggctcactgcaacccctgcctcccaggctcaagtgattctcatgccttagcctcccgagcagctgggattacagacatgcaccaccatgcccggctaatttttgtawttttagtagagacggggtttcaccatgttggccaggctggtctcgagctcctggcctcatctgattcacccacctcggcctcccaaagtgttgggattacaggcgtgagccactgcatccggccttctatttttaatttagcatcctcaaataaatcaatttaacttctaaaaatgtgtgcctttttgttttaataacattaacctatttttttatttttgtaaatttatgaagtacattcttcaaatgtaacaatttagttctacttcaagataaggtatagacaactgcaaaattccactgtcctyacgatcacaatcatgaagaggatggagctgcagaatctgaycatataaaracttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatktcgagggtacatatcggaactactgagaatacaaggatgagctgcaaaaatctccacttgtctggcaaatgacaactcagtggacaccaaacactgaataacatgtacagtgraattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttwaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatyccagctactcwggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataagscaagaaatttaaaatatagagaacaaaatggaaattttagaactgatacatacagtgaccaaaatttaaaaggtggtgaatgcactcagtgggacgacacagayaacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaayataatattgattgattcaacataaatactatggtttatttctagatggcaaggaaaatcacrtgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacgkaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagargaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaatmattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgsgaacgctggattctctcttccagactacctaactgactcattttacaaattctgctgtctaagataggacacgaggtaagggtccctttcactaatgcttctgaagagcacrtccagggccaggtcccctttcttctccaccatgctcagcaaggcctcattcttgctctgccgtgtcttttcctgctccaccagctccttctcattctcagtaagaacctcattgtcytggagatcatcgagcacccctttcaggtcccccatcctggcttggagttgccggtggttctccttcacaaaggctgcacctggatgaaagggggagtttcagactttgagaatcgytcacttacaggattcaggatctataccaagcttagagtcaaaattcaggggtgggagattgctccttgtgtctgtarcttaatttgtggacatacaaaatcacacacattcacagagcaaatataccctttgcagtatcaaatgcatygaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatasaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgaytgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatsacactcttgataatttcactccatttaagttggactttctgtcatttgccacacaagactttacacagatccagaggacattgcagattgctgccttgggtgatttttaaaattaacgtggacatgaagtcatcaggagacaaggagttccaracctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtattttyagtagaggcagggtttcaccatgttggccaggctggtctcraactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgyatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacasagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttttgtagaaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccsgtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgkggttttgcactttcatctagactccttgatgttttcraagttcagatgaattttgcaacatgcccccccmaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgaytgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttacmgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggagaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataaytatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgccygctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgtatgttaatatccttcccttcatagagcttcattgaaatttttcatgctgtgttacccaagacaaggatctrctactattgaagatactgatttctgcatcattgtagktattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactatttttttwaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttargaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggygggcgcggtgactcacacctgtagtcccagcactttgggagactgaggtgaccgattgcttgaggtcaggagctcaagaccagcctggccaatatgttgaaacccccatctctactaaaaatacracaattagccaggcgtggtggcaggtgcctgtagtcccagctactcaggaggctgaggcaggagaatcgcttgaacccagggaaagaaggttgcagtgagcagacaytgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggraaggaaggaaggaaggaaggaaggaaggaaggaaggaaggaaggaaggaaagaaagaaagaraagaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttygcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttgktgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattc

SEQ ID NO: 12600 - DNA, 40000 bp, Homo sapiens
  misc_feature (1)...(40000): n = A,T,C or G, or insertion/deletion polymorphism (see Tables 1-2)
taatgcaggctcctttgactgtatatgtacctcattctgcagaaactcttttaaattcacaatacatgcaacacttttctgttaacagattagcttcttataaagtacttttactctctgctacacatattatcctcccttactgtaattctcttaatcccacaacattacttcctgaaacaactgatgaaatacgtcatgactgtattttactaacagaatagcttttgatgcccagacaggatttacaggagacactgctgtaaaatgctgatgttatctggttcacagacggatcgtatctaaaggatgaatttggaaaataatgagcaggctaggccattgtgtctcttgtggacattatagagagcaatcccttgcctacagtagaatcagcacagttagctgagttaatagggytcgccagagcttgtcaagtggccaaaaatcaaatggctaatgtttacgttgacagctattctgctttgggtgtagctcatgattttggaatgttgtggaaatagcaacctcctccagacgccctattatcgtggctctcaagtctctgatcatttagaagccatccaattaacaacaacaacaaaaataatggactattatcaagcccatttataatagccctggacatttccaacttcactctccagagagtaaaggaaatcattttgctgattcaacagcaaaaaagtctgcattaacactgatatcaaataaaactagagaggtggctatatttaaaatgcactccattgaaaaggaactccaagaggctcaagaaaagccttcagagaggggaaagcagatatagctaacaaaaatggcggtgctttttctccacttgcaaattatggtatggacccaamgacagactagttttgcctttgggatttcaattttctatgtcacaacatgtctatgagctcactcactgggggcctgaaaaaatgattgcccagggaaaacaattattattgggaatyctcacccacaatagcacatagactttatgctaaatgtccaatttgtcctaaacctaatccaggaaagtgtcttcacagatttcaagggcatttccctttgcccactggacctttcaatatatggcaaatgaattttatccaattacctccagcccagggttataaatacgtgctggttatgatttatatgttcactcatcagactgaagcatttccttgcagaagagtcatggcacaaacagtagaataatatgtgttgctgtgggtaattccctcttggggaattccttccaaattacatcgcaataggggactcattttactggagagattatccactccatttgtaaaatctggctcattttccaacattttcrttttgcttaccatccacagtcttctgaattggtggaatggagaaatgaaataataataacccagctggaaaaattaatgaaagcttttcctattatgtggcccaaggctcttccattggtttcactcaacctaagagcaactcctttcagaaaacatcaattatctcataagataattacagggtgacctatgaaattggatggtggtttatataaaccaactttactgaaaggagatatactccattattgtcaaggcttaactaaacgtcttttcaaaaaaaaatcaataaaactgattttaacactgtgctcccagaagatgaagatctcaaataccaagatctctagccaggtgactctgttgattgaaaaagacatcaactaaaagtctcgcttcaacctcattggaaaggagtttatcaggtattgttgactaatcactgtgaagctaaacttgaaggagttgactcctggattcacatttctaagttaagaaaagctccaacacctaaatggacttctaagtccaccagagacctccaattaaaratctctaagatttctgactcctctgaaggtgggaaggagacatctgagtagacagcatttcccaagataccagaccaggtgtgtattcaygatgattttcttctgcatataccttttgtttttgcattttcctgtcacgataatgagtatctagtaacatcctctcctttgtttgatccccatttctcttattgggaaatcactcatctaatttatatggaagtagaacaaacctttttcaatatcaggaggatattggaactctgatgttgacttcttagaatcagttcgatgttcctatagcctatggcaccttcttttcaggcataatatactattagggaccttatttaaagaaatacatccagaaaattcttctcaattcgatgcctggttgggcagtttttaatactttactaatagctcactgcatgactgtgaatctagatgatcaattactacctgaagtccttgagataattgaaaacagttgcagcttttgtgccttgccacagtgtctcttgccctagaggtcagaggctttgtttttgtggctgtaggtctatgaaacattctaatgaaacttggaatcatacaatgggaattactcggtgatatggtttggcctgtgtccctacccaaatctcatcttgaattgtaatccccacctgtggagggagagacctgatgggaggtgattggatcatgggggtggtttccccatgctgttctcatgatagtgagggagttctcaagattgctaatgggtttaagtgtggcacttcctcactctttctctctctctctctcctaccactatgtaagatgtgccttgctttccctttggcttctgtcatgattgtaagtttcctgaggcctccgcagtcatgtggaaccatgagtcaattaaacctcttttctttataagttaccccatctcaggtattctttatagcagtgtggaaatggtattctccagtggtatcctcatccagttagtggataagaataccgccggaggataatttgggaattcaaccagggagaatgtgaaaagccttatggtatacccaaactaaactatatctaggggtaactgctacatatctcaccctaacttggaacaccaaacatatttggtttcacaatctgtacctaaattgcacttctgctataattgttcaatggcaacaacatgtttggtggataaaacagcactrgccaactaaggtaaaaagaaacttaggtgcaacaggggaataacttgtgatattaggacaagataaaaatgtattttatgaaaaaagacattcacaagaaaagttgatacttaccaatcaaaatagattagaagaaatactctttcatgaggaaagtaaggatcaggaagctgcatggaaagataatgacactgttgctaagtggataagtcaaactgctcaactaatgagggaccataccaaaacctagcgatgagagagcatacatccaaactcagcaaggtttattgaccatgctaatacaaatggaagcaaaagcctctaaaacatggccaaccattttggatacagaagcacaaggtgtgcatttatggaaaaaaatcctcttcttcctggaaaattactaccagkgtgtgtagcctaatttgctgcactctacagctttagcaccggatatggtttggctgtgtcccctcccaaatctcatcctgaattgtaattcccataatcctcacaggtcctgagatggagctggtgagaggtaattgaatcacaggggtaggtttcccccatactgttcttgtgatagtgaataagtctcatgagatctgatggttttatgaatgggagttcccctgcacaagccctcttgcctgccaccatgtcagacatcactttgctcttcctttgtcttccgccatgattatgaggtcgccccagccatgtggaactgtgagtccattaaaccactttttctttataaattacccagtcttgggtatgtctttattagcaacatgagaacacactaatacagcaccccatatatgtagtcaccagacctattacatagtacagttagcaggaacagggattattttaacaatacctacattctcccaatgggcagttgatggaccatattaaataataatacttggaatccaatttcagttctagattgtaaacacattcagggagactagtactgtccctgttagatttggaatcctgaaatcatggaaacatgacctctaatttctacccctattcaaaataatatatggagcccaggcgacataataagacctcatctctaaaaaaaaaaaaaaaaaattagctgggggtgttggcccatgcctgtagcctcagctactcgggaagctgaggtggtaggatcacttgagcctgggaggtcgaggctgcmgtgagccatgatcacaccactgcactccagcctgggcaacagagcaagaccctgtctcaaaaacaaaacaaaataatatgtggtatatgggaaaagaatgtttttgttgggaaaggaaaaaaatgagattataaccattctcatttttaccttagttggccagtgctgttttatccaccaaacatgttgttgccattgaacaattatagcagaagtgcaatttaggtacaggttgtgaatccaaatatgttgggtgttccaagttagggtgagataggtagcagcaattaagtttgcaaccagacaatatttgatttaaattatactgccatttggtgcaatatggagttcatagagaagttacttttaggacaagtataacactgaagattatgatatgtgacattattatgacattgataataacaaattttgaaaattgaaactcagttcacctcaagttgtatttccagcaaaaaaatgaatggctagaagagcaattagataaatcatcaattagttacagttctaagtgaaatacactaaaaaaatcgtaaggtacaaatacaaacaaacaaaggggggaggaaaattattagattagtcataagactatcaaaatacaagttcaaggtttttttctatgatagattgtttcctttcttcattgtctttacctgaaaggacctctcagttgttcacactattattaattatttttctagtatgtctacgttacaaatattataaatgctgcaaaaattgcaaatgtcactgaaagaatagaactccagcccaaattaagtgagttcattgatctgaactaacagctgtagcatgtatgtaagagtagtcttctgatgactatttgtccaacacattatttccctatttctgatcaactgaggaagggctttctattttaaawtttttctttttttttttttgagacagagtttcattcttgttgcccaggctggagtgcagtggcatgatcttggctcactgcaacctctgcctcctgggttcaagtgattctcctgcctcagcctcctgagtaactgggattacagacgcccaccaccacggccagctaatttttgtatttttaggagcgacaggatttctccatgttggccaggctggtctcaaactcctgacctcgtgatctgcccgcctctgcctcccaaagtgctgggattacaggcgtgagccaccgcgcccggccttgttttaaattttttyaatcctaaagtcccaaggtttataaaacacatcaaatggcctattcttcctcccaactcctcaaggctcttcagcaatatggttgaccatgcaacacatcatcgcatctgaggaacagcctaagaaaataattctaattgcaatgatcacctcttttctccataacgtgaggagatattggcatgacaggagagcctctcgcattctgaaaggaaatasaggaatttttgcatcctcactgacaaaccaaatgacagaacttcatrtaggagtgaaaaatagaacaagggcacttaaaaattccaatttgattcccctatgccctataattccaagcaaaggggacctgtcctcttcaaatccatcagatatattatttggttttcaaagtcctcttttggagaatttaaccaaaagggaaagatttttagaaaaaagaaaatctgaaagaaaaagttttaaaacacagcccaagatggctgcaggctggacaaacaggtactaatataaggcctatgaactaaagctgaagtctcgcctgctagggtggagtctgtcaaatatttcactggcatgactgattgtaaccttgcctatcagatgaagcactaatgcagggtagaatcaatcacccctctccagaccttaagacccctacgtattccacaactttttaccctatatatgttaactgcatatttctttatttatgcataatgtcactaagcaccaatcagaattgtaagtgtcacctttccttcaatgcccctgtggagacaggaagtgactccatcttggatatgaatgtgccatgttgtattctaattagccccagtcctgcaaatgccttctgattcttactttatttactatccttagtgtaagaagatgacaatctgaatgtcatcacacaaatcataggccatgatgcatgtaacattcttgcctgttctggaggctgcctcttattgtcttgctggacacacacgccctttccctatggtacagaagccccgggtctggggagtagcagtgtggagatctatcttctgccttgcagctaaaatcccaagactacgcttctgcctgtaagttctcccccagtaaaacactctagaccaaactgaatttgtttccctccttttctggtttccagctcctttggcatttgggggtcattttggatataaggccctttcatggaacagcccccttctcccattttctttctctcttttttttttttttgtttgtttgtttgctctgttttaagacagggtctcacactgtcgcccaggctggagtgcagtggcatgattttggctcactgcaacctccgcccttgggttttgttgagacagagtctggctctatcacccaggctagagtgcaatggcgcaatattggctcactgcaacctccacctcccggttcaagcaattctcctgcctcagcctgaagagtagctgtgactacaggcgtatgccaccatgcccggctaatttttgtatttttgtagggaaggggttccaccatgttggccaggctgctctcaaactcctgatctcaggtgatctgcctgccccggcctcccaaagggctaggattacaggcgtgagccaccgcgtccagcctaaatttttaaaacatatattcagagaactgaaaagaggaagcagggagatataacagaaacaaggaccatccctcatatggaaagtcaatacatgacatttgaagcaagggttgtgaaatcgcatcacgagcttgttatttggaactattgagataaatgctagaagaaatgcctaacagaattcgaagtattggccttggaggtcaggagtccgggagttgggagctgaggagacacactygtgagtccatttgtgataaacttcaactgtgtcatgcatcctttaaatttgaaatttttgaaaagttaaaggttaaaacaaatcaaaagggccttgcagagctgtgttctcaccagtccccatggcagtcccttggcaattcacagatagggctcccactacccaggttagctcaggccacaagcccgggtgcctccgcctccttctcatgtgggaggttatgtaacccacccaaggtcacagaggcagtgggtgtcagtccacagtcacggctcagggcttctgtcagaacagggacctcctcggggtggggcatgtgagtgcccttgtgctgtgactcaacccagttccccgtgtgactccacagggagctcagagaaagtcagcccacacccactttcatctgaggacaccccagtggggcagagcaggccttccctgctccaccccaagcaggactcatgccccagcctttctggggcacattgctacatattttaaaatgggcaaataagtactttcatgaacatggctagtggggaagaaaggagattattgccctcattttgtggatgagaaaattgaagttaaaagagggtaatgagctgggtggggtgctcacgcctgtaatcctagtgctttgggaggccggggcaggcggatcacctgagctcaggagttcgagaccagcctaggcaacatggtgaaaccctgtctctactaaaacataaaaattagctgagcgtggtggcacgcacctgtagtccccagctacttgggaggctgagacaggagaatcacttgaacccaggagagagtggttgctgtgagctgagactgtaccactgcactccagcctgggtgacagagtgagactctgtctccaaaaaataaaacaaaaaagaggataatgatttgttcagggcacaccactgatcccacccctgatttggatgcaggcctgactctagcacctgggttcttgggtcactgaggtaaagcacactgactcaggtttgtaaaacgtgggccaaatagcagctgagtcactgggttgctgtgaaggtcaaatgaggtcaggtagatatgggactcttgggagggttgttggtacatcccaaccacctcacacatttcagctgttaatggtgatgatgatgtcagagctgggagggctggagagatgccccaaacctggggttcaggtgtagcctgttraggctcccttgagaatctaatgaaagcagatgaccctctgttctgcaggcagcctcaagacagtgttttgcacgttaagaccctcctaggtgctctaacatcttgcatttccacagatgataaaatgaagcctctggctgatatttccttggatctgtttcccagctcaggaaggtgttcttgaattctgaagcagacatctggagcctgcgactgagcagctgccatgataggaaaggggaaagacctctggttaccttccagaaagackagagaaggtgcctgtctcctccacgacctaactgtacacagcaggatgcaattacctctagaaccactgaggaagcagacagtaaactggacatccatctgtcccgaggcacaaaaatatttgcaggcacgaaaatatttgcaggcacctcccctgtccagattcagactaggcccttccaccacagcagtccccacagctgggtggaagcctggaggtcaggaaggaggagygctagttgctttcaacacttyaatggtgaaatcatgcagagaagcacttctcatgttaatccatctcacacacattccaagagcacctactatgtgtaaggcacacagtgggacaagcagatgaacaaacagaatctctatgggaagtggtgagtgatattctagcagttctcatacaatgctgcgggatgtaaaacacactctagctgggggaactgaccaggaaggaacacgggcttgttgaaacacatgatattggaagtgactatatcaagatgccccaaagtcaactcatgacttttaccaccaacctgacctttcactgcccagtgaaagttgccatcatccgattcagttacatgtcacacttcccacactctaactctccatacacatctcgggtcttgctgacttttcctcctctatgtctctgccgtccacttctctccatctttaacatctacttcagcagcttctcctttggtctgccctccaatccaacttccaatctgaacgacctcatctaagaacagatgtgatcatggttaatcccttttgaaaatctttcaatgggccgggcacrgtgactcatgcctgtaatcccagcacttttggaggatgaggtgggctgatcacctgaggtcaggaattcaagaccagcctggccaacatggtgaaaccccgtccgtacaaaaatacaaaaattagctgggtgtgttggcacgcacttgtaatcccagctactcaggaggctgaggcaggagaatcgcttgwgcccaggagacggaggttgcagcgagccaagaccatgctattgcactccagcctgggagagtgagactccatctcaaaaaaaaaaaaaatatatatatatatatatatttcaatggtacttctattgttatctgtttttttgtttgtttgtttgtttgtctgtttgagatggagtctcgctctgtcaccaggctggagtgcagtggtgcaatcttggctcactgcaagctccacctcctgggttcaagcaattcccttgcctcagcctcccaagtagctaggactacaggtgtgtgccaccatgcctggctaatttttttttttttgagtagagacggggtttcaccatgttagccaggatggtctcgatctcctgacctcrtgatctgccagccctggcctcccaaagtgctgagattacaggcgtgagccactgcgcccagcctgttatctgttttaacaagtcccagtcttccttccaggtctggttcaaatggaacttctccccagttccccagtagggtgtgttctctctcctgaagtatttcatgagaacgtcaagaacagggcttaggagcccccgcttagtctggcccagacctttctttctgcctcatcttgcattgtagccctcctcattatccacccctccgcagagctgctctgcttgtaataagtcatattacctaggctccctctcatctcacctttttgcgtacgttcttccccatctctggccaagtccatttttcttcccctttgcctggatgattcattatttattttttggctgctcagacactcattcgtaagaggtgctaaaacctgagaaaatgaagtgttggaaggattgtttgataagctgcttggaatgtcagtgagttctctaagaggcatgcctcaatcataatggctgggagttgattgccttcctagaagattctgtctgggtaaatattaggctcttgctttgctagtaattagggtgagcaaatgtggaccacagctgaattgtttaggacaggaaagagaagccaaggactgtcaaaagaaaccttcctttttctaaaccttcctccacataatgttgttcctcctccaaataaatgttaaactagttttagttgaaattgagagcaaaacccacaaacaataaaaaggaagtcaggagaggcagaaaaaaatgcacagaacagaagaatgtgtcattaagagttaaacatcatcagaaacagaagagatatgcataaaacaagaacactatgctatggaaaagaaacaatcagagaacaagaaagagctcttagaaattaaaaatgtaggccaggcgcagtggctcacgcctgtaatcccaacactttgggacgccaaggcaggtggatcacctgaggccagaagttcaagaccagtctggacaacatggtgaaaccggtctctactaaaaatacaaaaaattagttgggcctggtggggggcgcctgaaatctcagctacttgggaggctgaggcagaagaattgcttgaacttgggaagcggaggttgcagtgagccgatatcataccattgcattccagcctgggcaacaagagctaaactctgtctcaaaaagaatttaaaaaaaaaataaaaaagaataaaaatgtaatagctgtttggtcaggatagggtcaatgctgtaacaaaccatcacaatctcagtgggttgtgactaagaaagctcatttcttgttcccatcacagtcccattcttccccaagtcacaggaaggaattagctccatgtagtcattcagggacccaggcaacttccttcatgaggtcttgccatctcctagggtattgaagtaccctacttctagccagcagatgaaaaagagcaggagaagaaaagaagatacagaaagaaaataaaagttactgggcacygttggggaagttggggcaccaacttattactctaaarattgttaattaaaggaaaagaattaagcattttttatgcctaactgcattttctggtaattaaatagccaaaatgaatgaaggaaagctcttctatgcagaagaatttcagctactacatgaagaaaaaattagaatcagaaaattatcattttttaagcccctaagaawataactgattcaagcaatggttttcaatggatgccaaaatcactcagtgaaaggttgatggagaacttctcagtgaagggtaaggttgccattgcctgaacctaaagatagatcttagcatcattaaaagcaagaccagcagacatcatatgcctccaggtgtgatgcactggagacttacaaggtatcccatgaagtataaagaagcaagtgactgtatccctagtgtaaaaactctacatgagaattgacacagtttcttcaggaagtcaatagcactgagaacaaatataggaagaggaattaatttaygttaaaagagagttagaggctgggcacagtggctcatgcctgtaatcccagcgatttgggaggctaaggcagccagatcacttgaagtcaggagtttgagaccagcctggccaacacggtgaaaccctatctctattaaaaacacaaaaattagccaggcgtggtggcccacacctgcagtcccagctactcaggaggctaaggcgcgagaatcggctgaactggggagatggaggttgcagtgagccaagatcacaccactgcactccagtctgggtgacagagcgagactccatctcaaataataataatgatttttaaaaagtcaactaataacataaggtgatgagtctggaaaggatggcaagaaagcacacttcataaatatgaaggaaaatgaagaaaacacttgtgttagggttctctagatggacagaactaataggatatatatatatatataagggagtttattaagtattaacttacatgatcacaaggtcccacaataggctgtctgcaagcttgaggagcaaggagagccagtccaagtctcaaaactgaagaacttggagtctgatgttcaagggcaggaagcatccagcatgggagaaagatgtaggctgggaggctaggccagtcttgccttttcacctttttcttcctgctgtatattcgctggcagctgattagatggtgcccaccagattaagggtgggtctgccttctccagcccgctgacccaaatgttaatcttctttggcaacaccctcacagacacacccaggatcaatactttgcatctttaatccaatcaagttgacactcagtattaaccatggtaagtccaccccttgtcaagctgaacccatacacatctcctgagatcatacataatcttcaaataaagacaataataaggtcataattatgcctaaaataatacaactatccttggtacaactggaaacccaccaatccccaacccaaatattattacataaagttaataatacttaaatgttgatatgaagtcagtaaatcttatgtcacatgataaaggaaaaggaaataaaatggatatattttcttcgtacaagtgtatacatgcacaaacatgtttttagccaaagaaggaggaaatactcatgatagttacagtccgcatttctgcagctggtcacatggtcataggtggtattgatgattaccwtcttctactacccattctgtattccctttgccttcagcaagcacctcagcaggttgtggtttttttcctggtggagtgacccaaaccttcattcctgaggggtctgggctatttgtagtcctgcctggattgcgctattgtagtttcccattgaccttaatcaaagggcatggtaatactaagagatgctctaaaggatgtcctgtattccatgcatactcttccttacctctgttatggagtagtagactgattttatcttgatagttcaccttcccactccatctcccttctggctcccccatctgctgagagctacttccactcaataaaaacttgcactcggtccctaagcccacgtgtgatctgattcytccagtacaccaaggcaaaaaccctgggatacagaaagccctctgtccttgtgataaggcagaggatctaatcgagctgattaacacaagctgcctacagatagcaaaactaaaagagcgctctktaacacacacccattggggcttcaggaactgtaagcattcacccctagacactgccgtggggttgaagccccacaacctgcccatctgcatgctccccctagaggtttgagcagcagggtaccaaagaagcgagccacacccccattgcaggccctgcgagggggataagggaacttttcccatttcacttgtgctgtgattcagttccctgggtgactctgcagggaggctggagggagagagttctcccagagggaccatcccacacccacttccacctaagaacaccccagtggggcagagcaggccctccctgctccaccccaagcagggcttgtgccctggcctttctggggtgtgctcctgcatacttcaagctcagccaacatgagatactctgactcaagtgtagggtcaggtggggagaaatgaatgagaccggatcaagccaacccaagcctatgcaccgagttaagggtgtacacactcactgggcaatggggcagggtattatcgtccccattttatggatgaagatattaaagttcaaaagtttagatggcttgcccatggtctcacaactgctgtggagtgtggtagtgaagttcatggactctgcaaccagactgccaacctttgagcctgttctgctgctgatctgggcaagtacttgacctttctgtgcttccattttcctctgccaaatggtgaggctaacacatgctacttggtagkgttgttatgaggactgaataagccaatacacatgaaaggctgaggataacttttcctttgcagtcacaactacgctgttwggtataagaggcctamctttcggcctattttggctttcaatacacttacctcactaagtttaatatttctagcttttgatttagagcaagggatgtgtgacattttcacttaaacatgtagagaccattttagggttattcattggcctaattttaatattgttgggtctcagggaattgagaggcctgaggagaaggagagaggagtagaggaaccactgattgatgtagtagttagaacacatgcaatatttcttaagttctctgtcttatatgggtgcaatttgtggcaccccaaaacaattacaatagaaacatcaaacatgagtgatcacagatcaccataacagatacagtagaaatgaaaaagtttgggctgggtgtggtggcgcacacctgtaatcccagcactttgggagactgaaatgggcagatcgcttgaggtcaggagttcgagaccagcctggccaayatggcgaaaccccatctctaataaaaatacaaaaaaaaaaaaaattacctgggcgtggtgccttgcrcctgttgtcccagctacttgggaggcaaagacacgagaatcagttgaacctgggcagaggttggggtragccaagattgcatcaccatactgcagcctgggtaacaaagctagacccgaaagggaaargaaaggaaaggaaaggaaaggaaaggaaaggaaaggaaaggagaaaggaggaaggaaggaaggaaaagaaagaaagagagacagaaaraaagaaagaaaagagtgagtttgaaatattgtaaaaattaccaaaacatgacacagagacacaaagtgagcacatgctttagggaaaaaggtgtcagtacacttgctcaacaaggggttgccacaaacttttgccaaaatattcaatttgtaaaacaaaacaaaacaaaacaaaaacacaacaaatatctgcaggtgcaacaaagcaagtgcaagaaaatgaggggtgcctgtactgtaaattgctyttgtaaagatgcacagctctaccaagtgccacgaacaatgagcatagcttcccttcctccactcctgaccctgaacacccctgcccaagggttcttcttttttgccactgtgatgagcaaccagctcaagccagcccaagtcagctcaaatggcaaaaactggtccaaacttgccaagaccttccttggcctcccgagtccgtactgtattggatccaaccagataaaaccagctcaaactggcccaaacccaatcagccatgtcagtccaagcttacatattcttccaacctttccaacttttgtccaaatctcctcctggcttcctgagagccaccgcttgaacaaaagcacacactccccacagtatgcaatgtcactcaggccctgggcagcctaactcacatgggctctattcaacacatgctgcagcgtcaaaactctactaaaagagatagttgggttgttttgttttggtttggttttgccttagccaaagtttgtttgtttgttttgattgcactttgaacttgcacttttttattttgatttgcacttcactctgaacagactaaagaggaaatttcttggcaggaaagtgagggatctcagagaaagcaggcgaagaattcagcctcaggaaagacaggaaaccaggaaatggaaagccatcaggagtttcagggacacttctctcattcatgtctccatcctgaagtagaaaccgaggcaggagagcagcttgttcaaggccaacagccctttaggagcagagccttatcaggggcattggggccctcaccgcaggggcctggagatcggaggctgatgctggctggctcagtctatgaccagggacctggcccaccaggaagccctgggtgcccgctggctccaccacaggcccacagtgacctggccatcctcctcaggaccctggagccctgagaggttgtgtgggatcagaagctttacagattgggggctctctttatgatttaagggacagaatgcaaaattattaaaacagaattgctgagcccatccctgggtcttgaaaggggttggagaagaatgaagaccactggggggttcagccgcatttgcttcatgatgaatccgcctctgtcagaagcagctagaggcagagcccgaagaagaagcccttggcagagccgcaagcgtgacaccgcattccttggacactgctctcccatgaaggcccagagggacttgctgaggtctgagaggggctggccaccaagggaatgagagacttggtgttagacagtcctccactgtgtgatgacaagcacatcagttcagttctgtgagcctctctttcaggaagtgatcataaaagcatccccttccacctcacaggtgctgagaatgtaagagaagaaggtcagctctccctctgccggtgggacraagggcccagtggtggcctgcaggctcaggggtgtctgctcccgctgcctggcctctatctgctcctggcacctgctcccatctcagagcggggttggggccaagccctggggccttgaatggcagcgggaggcagacagagtcctgggcagaagggggcaggtccccagtaagaccccactttcaggtcagggaagkcctgaaggctgcgggccaggctgccagtcccatggactggagtggggactcatggtgcctcttccagcccacccatggctgcccgtggaccaattggcatggacttcctccctgataaaaggtscataaaagccctaggctcagccagagcagatcagaggatggccagargatgaggagagcagagagacaatggcacaaccagctgcagagaggagtactctctgctgatagctggagatgatgggatgactagcagcagagaggagctaccttctccactgagagctacagagacaacctgctggcagggaggagccaccctctccgaggcctcctctctgctgagaactgaacactggacagatgacctgcctgcagagaggagctacacactgccagtctctgagctgttgtaacactaaataaaactcttcttcatcttgttygctctttgcttgtctgcatacctcattcttcctggacacaggacaagaacttgggcaaaggtgctgtggccacagatgtttccagccaaaaaattgacaccccaaagatcccataacactagggmgcttggactttatcctgcayatatgggctgccgcaaatgggattacacagtgggcatcaggctcaggagagcacattggaagggactctgtggtggccaagtgtggtggcaaatgcctgtaatcccagcactttgggaggccaaggcaggtggatcacctgaggtcaggagttcgagactagcctggctaacatggtgaaaccccgtctctactaaaaatacaaaaattagccaggcatggtagcgcatgcctatagtccttgctactcaggaggctgaggcatgagaatcacttgaacccaggaggcagaggttgcagtgagccaagatcatgccattgcactccagcctaggggatagagcgagactgtctccaaaaaaaagaaaaaagaaggagcttgtggggtcatgtggtcaatggattagagaaaatgagaccacagcagggaggccaccaggctgttatgctggctctggagagaactagtgaggggctggaacctgacagtgacctgggagagagggaagaagggaggggctgtgtgcatgagacattctgggggtagaacaggaaggatttcaaaaaaaaaaaaaaagctgttggcacacagttggctttctctaccacctccagtgtgaatgacttggtggcccattgatgagggaggtgatggagaagttcaaaatggaggacaaagcccagatttctagctgaggagtgaggtacactctggctaagggaagcagcccttccgctagatgggggcccatagcgggctccctttggcttgtgttgaatctgagtgaactgtggtacatccttgggtcggtgatcaagaggctgtgagattttcaggtctggagtgtgggagagaggtcacagctggagagagaacctgggaaccaccagcagaggtgaatcctggtgctatggaaagtagacacagatgaccccaggctgagaagtgagctccagccgcaagacttggaggccataagggccaaagggtgacctgcggcagggggttggaggttgaagttaaatcatgcccccacaaaatttgtgtccactggatgactggtgtccttataagaagacaagaggtcgcagagacaaagagaaaaacgttgtgaggcagagactagagttatgctgccggaagccagaaaaggcctggggctactggaagatgcaagaggcaaagaaatattcttccctggagccttcagagggagagtgaccttgccaacccttggcttcagacttctaacctccaaaactatgagagaatacatttctgtcatttttattttattttatttttaaaaataagacagagtctttctatgttgcctaggctggccttaaactgctgggctcacrtgatcctcctgttggatacaatgagttcaaaatttctcttcaaagaatcaatatgtcaatatgttcagttctttgtcctccattttaaagtttaacttccccgtagtttcagtaaacaacatttccccccagttttaatcagcagttcacatctgttcccctggttacctgctctgcrtcctgactcatcccagtcacctgctttgacctgaatcacccctggtcacctgctctgacctaactcacctttagttacctgttcctaactgtccttcccaccaaactactcaccccgccactggttggttagacctggagacctgtgacttacatactcagacccactcaccctctcccaccccccaggggcaaagaaaactcactggaatgtcttccatctggaaagagttcacatttcccaaagcctgctcacacccctaagtatcgtacccataatcygtgcttcttatatyctgagtgtttgggcataascaagaccattttgcaggygggaaatttgatgttctgggatgccctcatgagatgcacctgactggatgggctgttgagctcctctagcttctctgagtggcctctgttaccccaatctgctctttgcttcccacatgtcaggggaagttcctcttcagctccagggactctgggatccccgaggacctggctgagttgagtggtagcagagagggtgggagaggccctgctgaagggaggggagacaccttccttggctgagctggaagctgagaaatcaatggctgtacctgctatagctgcaggaatgtggccttggggtgtgacgagctcctcccctccctcctctccctccccaaccatctggtttgcctgagactcaggagcttcctaggactcaggatttacagtgctagcaccaggaatgttccagacaaatccaggcaaactggtcaccttgtgtccccaggctctgcaatctctgtttctcatctccaatcctggccactcactgttctctgagcagaggctcattcccatgcctgagccaagttgttcccacacctgagccacgcttcctacccactttyacctactgattctgctctgcctccaggtcccaccattctccctccaagaagccacccactcctccaaatggatggcttccacctgaactgtcctcaaagtatgtcccatgttcctccctgtgctgcagccagctgcgcctgcctttagctttccacaggcctgaggacaactcaaagactgggtctgtgcctgcytcccctgtccccctagcatcgggcacacatcctggcttggcctgagtgggacaccctaccaacactctctgaaaagacccaggatgcacggtggggtctctgtgacatctagactccaggaggagagccagcaagaacagggtggccgaaggaaaagctggccctaaacgatatattcatccctctcttaatcccaacaaccctacggggaagttaaagttattattattaccactattttacaaggaaaactagagttcaactatgttagttaacctgcccaaattcaaagctagtagcagtggtgcctaaatttgagcccagttcttccttattccagtgacatgctcttaaccactatgatatgttgatgaattttatagaaacgctttctgggacaaggcaagggcatgaataaataaaaagcggggaggagcggcaggatgaatttaaggatgtaaactgacaccagctaggtatgaactgagcargtgtgtgggctgcattatttaacgtaaaagatcaatagcccattttttgtagtcgctctgagaagaagtagcttctaatgcgtccccttcaaccactgctcaagagagtgggaaaggagggatgcagaggcaaatgacaaggagggtgggcagggcaggccactgctgagaaaagtcagtgtaagacctgaccgaagacacaggcatgcggtggctcacacctgtaatgccggcactttgggaggttgaggcaggcggattgcttgagcccagaagttcgagaccagcctgggcaacatggcaaaactccatctctaccaaaaatataaaaattagccgggtgtggtggtacacacctatagtcccagctattcaggaggctgaggtgggaggatcacctgagccctgaggggtcgaggctgtagtgacccaagatcatgccacagcactccagcctgggcgacagagtaagactctgtctcaaaaagagaggaaagaaagagaaagggaatggaggaagggagggaggaaagaaagaagagaaagaaaaaaggaaaggaatggaaaggaaaggaaaatgaaagaaagaaaagaaaaaagaaaagaaaagaaatgaaaagagaaaaggaaagaactgacccaaaatgacagcaagatatttttggaaggtctgcataggatttcatagttacccaaacctctgcctcctccctgccatcccaactcccaacagttcccaggggcctacctaccagagtgtcttaaagccctccagcctagctggctctgggttaaggctctgcctccagaaggctcatggggaaaggacatggggtacagggtgggtgtcaaggcctttgcctacagccctgaggctgcacacacagcagcagagctggggcctggaggcagagctgggacagtgggcgtctgaagcaggagtagggccagccagtggctagagggcctggggatctctttgcaattctccacctccctgggaggggggccagaggcagatgagagtccaaaggtcagatggacactttgacttcagtgagtcaacaggggaagggagattccctggggccagttcccaccccaagctcaaatgagtgtgaggtttcctgyttcctcttcaaccccaacccctaggcacctgagctgggggcccatggtgtagcagatggtggcrggcaggaagccattgaagctggagctcatggaggacatgtaggcacccatggaggggaagaccagccaatcgcctacatccagctcgggcagccgcacatcctccaagaagagcctgtcaaaggcatcgcacatgggacatagagggtgcaggggaagaggggyggctctgagcagaactcctgtgtgacataggaaagggggtcagaaaagacagcaggctggcctatcccacccccttatctggaaggcactgaaagacccggaaggacactcccaggggcacacgggtgtatactggctgggacccatccctccatggcccctgcccagcctggccaggtctgatgtgcctacaagtaagggctcagattcctcctctgtaagtggggctgttgtcttcaataattgctataaggcagcagttgaaaactcaattacctagaggtcaagcaggtaacacaaatgagtgaaatgggccaggtaagtcttacaacaaactggaaagtcaatgtctgtccaaaggggaaagccactgaggaagtcccgttccagcagatcacagtgcctgacatgctagactaatttgttgaattatttgttgccttgttgttctgcaggccacgtatcatcagatctctcaaatgtttgagaggagctgagaaaatccaggcttttatgaaatatgtctagattttttaatatgggcaactaaaattgaaaactattgtgggaaccaaacaaacacagggtctcctactggttcctccacatccagaactcactccttccgatgagaagagaggcaaatacacacacgaagacacacacccagaaacacttcacacacgtacacactcgcacatgcatgcaaacacacgtcacatacatgaccaaatgtgygcacacaccaagacgttcactggccgggagaaacagtcaagatatttacaaagcagtgtggcccggacaccaacccatcacattaggagacaactgcygcagagctggaggaagatcctgttggccctacagggtcaggtattgaagctttgttgccagatcgtgggagggactgagcagcaagagtgtcggcagggaggcccctggtggactcgggggaatagctctttaaccaccaggragaaggaatggctcttaagccaccagggagaagaacttcaatattttggaaaacaacccacgcctttgtgttctggtgatcgcccctttgcctgaggaggcctacatatccagctgctgcacacgctctgatctgtgagcacacatcatgtacgtgtccacatgtgttctaagcagcaggccaggacctgcctctggggtccagcacagccactgttcccartaggggaggcacaaggcacctcaaggtaagggactagactyggggctggagtggcccccttaccttcaccaygatgggaacccttgggacaggctctcggtagcagaggcggaaggagccatagtggccatckttgagataatacaccagcttccggctgcctcctggggagtgctcagtcactactctgacccccagctcctgggacagagcccaaccctctgcccttcctctcctccagggcctggggacacctggacagkggyatccccacccagtgccatcctggcccacccaccgggctccagcacagccctcttggcaatgatgttgacagcggccatgcagacagactccacatagaagcagccaggctctgcgatgaccttgacaccacgctcctcagggaggtcctgggccagggcagcactgatcactctcgccaactggaatggggtggagggacagcaggaagaggttaactcatccagcacgtgttgatgtgccagcgcytgtgccaacgccttacctgcatcagtcctttcatccccgaggcaccctgcaggtaggcattagaattatccctgtttaccaaagaggaaacagaagttgagagacaggaggtcacttgtgtggggttgctggccaccaggctccctgagaagtccaaaggtgcagcaatttaatctgatgcaccgtaagaaggcgagtgtcttgtggacccrgggaatgtaaactcccaactgtaactgtaactgtattggtgatgctaacaagaattctacattctacaggaaaacatatacacatacagacacacagacacacagagaggcacagcccccagacaccttgctgcagctgcagtggacaccctgtgccacctcccctcagcctacctgagctcatctgcccgtgcaaaatgatttccagcctccagygcctgcctccctttgcttctcattctgtgggctttctccagcaccctcggmaactagctggaatgtgaggaaattaacacccccagaccacagccttcaaccaaagarggacaggagttggtgaataaaggaccagccccatgtcctctagtgggatgattctgaggttctacattgtccccagggggactggtgcagcggcccacagtggtaaccagctcatagatgaattttcttttgacttttctcccttctatctctctttcctgacttcctcattggcgcttccacggatcatctccaaaaaaactacttgtatccaagtgtttgtctcagagtctgcttttgggggatatcaaagccaagacatgcacatacacacatacccacctgtgcacacagagcacagagatacaccagagagacctaaacacacagagrtacatgcatgaacacagactccccacacacacccatgcctgggcacacatgcggacctccctgaacacccccagcgcccgtaccagctcacctcctcaaacttgggcccggagccctccattccggggaagccccctccaatgtccaggcagctcatatcatgcccagccctgtggcccatttccaacatgcaccggcagtcagcgatagcttgtgtgaagctctgggggggtctggcagttggagcccaggtggaagctagcagagccagtgcatgtgacatggtgagagatatgtactgaaacacatgttccaaaccacaaagccacacagactgtggataaccgcaacagagacagagaggcacagtcacacataaggcatgaagccaytggggccaaatgcagaaacaaasagcggaaacataactgattacactggcataagtgtgtgctttcagacagctgcacactcaggccaacgaggcacctacgaaggggcactcaccctgagtattcacacgtacacacacttagacacacactgccatggagccctgccagattgtattggtccctctgcttaaaacagggaccaaatctgcattgctgggtccccagtgcctaggttaagacttgggccggggcgtggtgactcatgcctgtaatctcaacacttcgggaggccaaggtgggtggatagattgagcccagtagttggagaccagcctgggcaacatggcaaaaccctgtctctacaaaaaaatacaaaaattagctggctgtggtggcacacgcctgtggtcccagctacttgggagactgagcaggaggatggcttgagcccaggaggttggggctgcagtgagctgtgatcatgccacttcactccagcactccagcctgggcaatagataccatgtctcaaaaaaaaaaaaaaaaaagccttggcacagaattcagtaaatatttgtaggataaattaataaatggatgtcacagctaacatatgagatctgggatttagatcaactcctatctgacttcacaccctgtaggtatcctgaacagaaacnnnnnnnnnnnnnnnnnnnncagcactgccacgtgggctgcccttcccctcatggacacttcacaacaagacaccaaaccccagggcctcagagcagggaggccctgagtaaccttcacatcatatcctgcccctttagacagatggggtctcacaggcccagagaggggccacagcttgccatgggccccaactgattacacttatgccagtgtagtcagttatatttccagctgtttgtttctgcatttggccccagtggtttcgtgccttatgtgtgactgtgtctcgctgtctctgtcgcagttatccacagcaagggaaggaccagaacccagggctcctggagtcctcaggcgtcactcacctggctccgaccacggccaaccccaggtctctggcagacgtgagcaggtgcccacaggcttccaggctggccccgaacttggtgctcagagggaaggtgctctgactgtcctgggtcctcagccggaggagcagtccggaggagggacaccaaggatagggaggaggcagagagcacttagccagagatgccaaagagcccagggcttcttataccacccccacccaggcccagctgatccccgcatctgggaggttttccaatgccaccaaatccatgcggccatcacaccagcccaacacacgtgtgtatacatctactcttccccaggtacaaccagagaagggagggtagaaaaatgatagtattggtaagcacctactatgtgccagacaacatgcccccaagttgtaaatgaaggaaccgagtgttaaaaatgttaaaagagacttgcccaggcggggcacgatggctcaagcctgtaattccagaacatttggaggctgaggcgggtggatcacctgaggtcaggagttcgagaccagcctggccaacatagtgaaaccccatctctactaaaaatacaaaaaattagccagatgtggtggcaggagcctgtaatcccagctactccggaggcagaggcaggagaatcacttgaacccaggaggtggaggttgtggtgacctgagattgcaccacgcactccagtctgagcaacaagagaaaaactctgtctcaaaaaaaagagacttggctgggcacggtggctcacacctgtaatcccagtactttgggaggccaaggcaggcggatcacaaggttaggagttcaagactagcctgactaacatggtgaagccctgtctctactaaatatacaaaaattagccaggcatggtggcacgcgccagtaatcccagctactcaggaggctgaggcaggagaatggcatgaacacgggaggcagaggttgcagtgagccaagatcgcgccactgcactccagcccgggcaacagagagagactccgtctcaaaaaaaaaaaaaaaaaaaaaaaaacaaaaaacttgcccaatgcatacatcaggtaagcaacaatgccagaatttgaacctgggctgtctcactccaaaggcagctgccagacccttttaaaatggctgggccttgagggtcctccccttcacttgtctcagatcagcatttgtcaggggtgtgctgtgttgggtgattcgttctttactgctgaccctcaccctagctgcctgcatccctgctggactcacctggccctggggtggtgctgggccaccttggtgagctcctcctcgctgtcaaaggtcaggagctgcaccccgtgctgggcagcataccggatgtgggaggcaggtttgcaggggttggcatagacgatgcgcgagggggccacacccaggcccagcacctgctccagttccacctggggtggccaagagccagggttgggggctgcatcactgcccccaccccagctatgtggggacagaaacactgtgcatgagccaaagaggctgccctgatgaaaccccgggttgggtctcaccccctgctccctcacttccaggcaggagccctgcgtggggctgacggggtgctcattatggagtccctgcagggcagggaagggcagggcagggctcatagtctcaatgtgccgggcactccaggtgctcatagtctcagtttagaaccaacccccctcccatcaatttcagccccatagagaggagatgggctggcttcctagaggcagcgggtgcacttaatcctgcttagtggagggctcctcagaaagggaggaagggctggtccgaaggcagtgagttatctcaattgactgttaacagtcagttacagatgaactccttgttctactcttctttcccacttctcactactacacttgactagtcttaaaaagaaaggaaggaaggacagaggctcagcaaaatactcccatcctgagttctcccccttcccacccttgggcttcggctctaacctccctcaacattgctgaatccccttctgctaagaaccccttggaatgtttcacccctggcgtaagaaaaaaatgccaactttggatcggtcatctctgtctcttaccatatgttggcccatgggcaagtgatccccctaaggctgtctcctcctctatgaatgtggatcccctgactaccttgcagagccgatgggaggatcaaggagaatgcatgttaggccccctgcagtgtgcttagcatatttcaagtgctctgcgggacaggggacgcttattcatgacctcagcagcagcagcatgggattcacccccttccagctggcctggcctaatcctcggtgggcacaggcttacctggctggcacagtcaaagccggtgcccagggcggccaggacacgcagcacccaagggctactgttgcacttcactgcatagaagggcgagacctgtggcagggcttggcagaaggcctgatggcagctggccagtatgtccaggtcagccagtatgaaggggtcttgctggtcctacggggcagggagacagggaggaaaggctgaggggctggattatctcacttaatcctcataacagctctatgaagtaaaggctgctgttatccccattttgcagatggggaagcaaaggctcaaaaaggtggtcactggctcaaagtcctatagcaaaagcatggcaaagacagggtctgaacccaggtctcctaagcctagggagaccgcccttgacactgttccattctgccttgccacggtcctgggtaggagagaggagcctgctgggctggggcagctccaggctatttgttctacagtcattcaacagggttatccagcacctactctgtgccaggctctagtctgggtactggggaaagagcagtgaagaaaacagatcaaaaatcctcgtctttgtggagcttccatccaactgagccacagagaaaaaggcatggactcaggcagcatgagctgattaatcaactgtcatgagccacacactgtgctgggggaagggatggagatactatataaatcattcccattgcacagatgcagtcactgaggtgcagagggctggagtgcctcacccaagttcttactgctggacagcagcacagttgacattcaatcccaaaaggaaatggcttcaggaacacctgtaggccaggatattttcgagatatctatttttttcttctaattttctctcttcttctcccccttattgatgccagtgtctggctctataatgtccctggggagagatgtggccaggcaggaggcagatgtggccaggcaggaggcggccttcttagggaagcttagcccttgggagaagaggatgccagggtacaagaagaatgtcatggtgacaccgatagaaggccctccctgaccaggaagagggtcccctgactggcggggatggggtggtgaagatggtaagagagctgagactttgtgccctaagggaatctgaggggtggtaggatggagcccctggaagccagtggggaaatggtaagtcaccgggtgagtctagagcaggccttcccagccttcatgtgcaggcaaatcccccaggatcctgtcaactgtgtgctccatgcagtcagtctagggtggacaaagagtctgcactgccaacaggttctccagtgatggtgacaatcaggtccagacgagaatatgtccagaggcagcacagccctaaaaacccagggagccagggaagccaggaggacaagcaggcaatcatctttgtagaccaaagctggaggaccccacagcttggcactgggtaaaacccccagtggtggaagcaggcagggcaggaagaacaaaagtcatgctttcccattagccccagaacaagagagccttgagagagacggcctaatggcgttacagaacggtgaaacagaaagccttatttcttgccactaaggaagacctgaggctcacaactccccgtctctcacctccctccatactcagtcagaaagctcctggatcctccacaggaccatctgctgggcagattcttctggccccagggcgatgagcttctttggccatggccttccatgggcttccttcaggcccccgaggcaggtgctcatccctgaaactccaactgagccctctaccgggcatggtcctggcatcctggaaaagacttgctctcatgacccagcctcctcccagcccccagctccccactccccacaggccctgggagccagagctcccaaataagtcttttgtgtgtttttgtttgtttgttttgtttttaagatggagtcttgctctgtcgcccaggctggagtgcagtggcgcaatctcggctcgctgcaacctccacctcccaggttcaagcaattcttctgcctcagcctccctagtagctgggactacaggcacctgccaccgcacctggctagtttttgtatttttagtaggcacagggttttgccatgttggccaggctggtctccaactcctgacctcaagtgatctgcccaccttggcctcccaaaatgctgggattacaggcatgagccactgtgcccagcctggaggccagtattctaagtgaggtaacacaggagtggaaaacccaaaaccgtatgttctcacttactagtgggagctaagctatgaatatacaaagacaaacagagtaatataatggatttcaaagactcagaagggggaggctggaggggtgctagagattaaaaaaaactacacattaggtacaattaaccctactcagatgatgggtgcactaaagcctcagaattcaccactgtataattcatccatgtaacaaaaaacaaaaacaaaacaaaacaaaacaaaaaaacacttgtacaccaaaagctaatttttttttaaaaaaagcagcaatatggagtcagctgtgttagatttctctcagtgttttaattttgcaaaggcagtttcaggagtcagatctccggtgttcctgggcttcaggtagatccctatgggaagagcagagtccagcccagatcttaagggataggggaagtacttcctagctgtcccctctaaacctcggccaccctggactgctcagcccaaatctcccagccagaaaaatgtaccttcctaggtctgcccgcaggacaggtgcacagagaggagtccgacccctgttataagcgaatgccggcaatgatgagaagtggagggaacctagaaacttcccatccactctttccgctctgcagatggaaagccgtggggcccagagatctccagatcattcagcaaaccaggagtgaaactgggagtaggaccaaggcctcagactccaacagggagctggttccaccgcctcagagaccagttgctgtctcctggggtcgtgtctcttgccctccactgcagatttaagcatctcactggaagtgtcttcgaatggaagtgggagcctgtgtgcgtcactcagggtctagtcatctccccaccctctcccctccctccctctccacgtggactgctgaggtctcacctgagctcttctggccctcccaggctgaagccaccaccttggggcagccccactgcagggatcagctgtaatctcctgcaggcttacaccccacctctgtgctgtgacccagaacctcctctgcctgttccagtgaaggacaatcaacagggagtgggctgctctccaggtttttgtctgccagccatgcccagggcaggaggtggggaggagggcagagatgacagggctgtgaaccccaaatatctgagacagatctcagtcaatgtagaaagtttattttgtcaagcttaaggatgcacccatcacacagcctcaggaggtcctgacatgtgcctaaggtggtcggggtacagcttgctttgattcatagggagccaggagacatcaatcaatatgtgtaagatgtacattggttcagtctggcaatgtgggacagcttgaaggcggcaggggtgcttccaggtcataagagacaaaaggttgataagagatgaaagattgcattgagtccttgatcagccttccactgaatacacaatttaatctgactcagtgaatctgcatttttacgtaaacaatagggcagaggaaacaatcagatatgcatttgtctcaggtgagcagaaggatgactttctgtctgcacctctgaagatcagctattagtttacattgccagggtgaaattcaacagaactgttttaggataaagaccttgaggcccacaacgaattttcttgtgggcagtttgtgagggaggtatgtagctatcttatttaggaataaaatgggaggtgggtttgcctgacatagttcccagcctgatttttcccttggcttagtgatttggggatcccgaggctttattttcctttcaaagggcccaagtcttcttctgcctggggcagcagagataggggtctttccccagaaacgaacctgttctgagaccttggaccagctgttcttcctttctcccggcctgcctctcgctcactggccctctatggccctttctccttggtatagcagagggcttaatcccaagggctcgacatcagccttgtttaccacttaccaagcctggtgtgccactcgcaatgaatttgcgacaggcaagttagttgactgctctgaacctcagttttttcatctggaaaatggggccttaaggccagttatgaagattaagatataaaaagaaaatatatacaaactgcctcactctcaccgctgctgtttgtgtctgtgtttctatccataggaactttccctgccagattgtattggtccctctgcttaaaacagggaccaaatctgcattgctgggtccccagtgcctaggttaagacttgggccggggcgtggtgactcatgcctgtaatctcaacacttcgggaggccaaggtgggtggatagattgagcccagtagttggagaccagcctgggcaacatggcaaaaccctgtctctacaaaaaaatacaaaaattagctggctgtggtggcacacgcctgtggtcccagctacttgggagactgagcaggaggatggcttgagcccaggaggttggggctgcagtgagctgtgatcatgccacttcactccagcactccagcctgggcaatagataccatgtctcaaaaaaaaaaaaaaaaaaagccttggcacagaattcagtaaatatttgtaggataaattaataaatggatgtcacagctaacatatgagatctgggatttagatcaactcctatctgacttcacaccctgtaggtatcctgaacagaaacatcaatggggcagaattgagggcccagaagcagagctgatagcaaaaactggaacatatcaccaatcaccaaagaaggtgaaggggacagagaagtggtgctgggacaataggtaaacagtttggaaagtaaagtctgtttggaacctcacttctcaatagaataaaagtgaaatggtttaaaaagttaaataaataaatatatatatgatcatatgattccatttatataaaatatccagaatatacaagtccacagagacagagagtagatttgtggttgcctatgactggggaaaggggagagaggaatggggagggcctgctagtggggacagggtttccttctgcggtggtgaaaatattctgcaattagatagagatgatggctgctcgacttggcaaacatgctaaaaaccactgaattgtatgctttgagaggtcaaattttatggtatatgaatcatatctcaacaaagttgtttaaaaaaacagattgtgtgctcgcttcgrcagcacatacactaaaattggaacgatacagagaagattatcatggcccctgcacagggatgacaygcaaattcgtgaagcgttccatatttttaatgatcaagtgggcttcatccctcggatgcaaggctggttcaacatatgcaaatcaataaaagtaatccagcatataaacagaaccaaagacaaaaaccacatgattatctcaatagatgcagaaaaggcctttgacaaaattcaacagcctttcatgctaaaaactctcaataaattaggtattgatgggacatatctcaaaataataagagctatttatgacaaacccacagccaatatcatactgaatgggcaaaaactggaagcactccctttgaaaactggcacaagacagggaygccctctctcaccactcytattcaacatagtgttggaagttctggccagggcaatcgggcaggaggaagaaataaaggrtwttcattaggaaaagagggagtcaaattgtccctgtttgcacatgacatgattgtatatttagaaaactccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccatttacaattgcttcaaagagaataaaataccttggaatccaacttacaagggatgtgaaggacctcttcaaggagaactacaaacaactgctcaatgaaataaaagaggatacaaacaaatggaagaacattccatgttcatggataggaaaaatcaatatcgtgaaaatggccatactgcccaaggtaatttatagattcaatgccatccccatcaagctaccaatgactttcttcacagaattggaaaaaactactttaaagttcacatggaaccaaaaaagagcctgcattgccaagacaatcctaagccaaaagaacaaagctggaggcatcacgctacctgacttcaaactatactacaaggctacagtaaccaaaatagcatggtactggtaccaaaacagagatatagaccaatggaacagaacagagtcctcagaaataataccacacatctacaaccatctgatctttgacaaacctgacaaaaacaagaaatggggaaaggatttcctatttaataaatggtgctgggaaaactggctagccatatgtagaaagctgaaactggatcccttccttacaccttatactaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagmcaaaattgacaaatgggatctaattaaactaaagagcttctacacagcaaaagaaactaccatcagaatgaacaggcaacctacagaatgggagaaaatttttgcaatctactcgtctgaaaaagggctaatatccagaatctacaaagaactcgaacaaatttacaagaaaaaaacaaacaaccccatcaacaagtgggcaaaggatatgaacagatacttctcaaaagaagacatttatgcaggcaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggggggactgtaaactagttcaaccattgtagaagacagtgtggcaattcctcaaggatctagaactagaaatatggtttgacccagccatcccattactgggtatatacccaaagtattataaatcatgctgctataaagacacatgcacacgtatgtttattgtggcactattcacaacagcaaagacttggaaccaacctaaatgtccatcaatgatagactggattaagaaaatgtggcacatatacaccatggaatactatgcagccataaaaaaggatgagttcatgtcctttgtagggacatggatgaagctggaaaccatcattctcagcaaactattgcaaagacgaaaaaccaagcaccgcatgttctcactcataggtgggaattgaacaatgagagcacttggacacagggtggggaacatcacacaccggagcctgttgtgtggtgggcggagtggggagggatagcattaggagatatacctaatgtaaatgacgagttaatgggtgcagcacaccaacatggcacatgtatgcatatgtaacaaacctgcacgttatgcacatgtaccctagaacttaaagtataataataaaaaaattaaattaaaaaaaccaaaacacaacaaaacaaaaaacagattgcacaatctctgcatccatccaggggggtccaggatcaccagttattctcttattaaaaaagttaaatatatatatataatatataatatatgtattatatatataaaaaatatataatatatgtattatatataaaaatatataacatataatatataatacatgtattatatattatatataaaaatatataatatataatacatgtattatatattatatataaaaatatataatatataatacatgtattatatattatatataaaaatatataatatataatacatgtattatatattatatataaaaatatataatatataatacatgtattatatataatatatataaaatatattatatatacatgtattatatataatatatataaaatatattatatatacatgtattatatataatatatataaaatatatatattatatataatatatataaaatatatatattatatatattatataatatatataatatatattatatataatatatataatatatatataatatatatattatatataatatatataatatatataatatatatattatatataatatatataatatatatattatatatatataatatatatattatatatatatatatattttttgagacagagtctcannnnnnnnnnnnnnnnnnnntataatatataatacatgtgttatatattatatataagaatatataatatataatacatgtattatatattatatataaaatatataatatatacatgtattatatataatatatataagatatattatatacccatgtattatatataatatatataaaatatattatatatacatgtattagatataatgtatatacaatatatatattatatataatatatatattatatatagatatatattttttgagacagagtctcactcagtctcccaggctggagtgcaatggcatgatctcggctcactgcaatctatgcctcttgagttcaagcgattctcatgtctcagcctcctgagtacctgggattacagggacccgccaccacatccatctaattttttgtattttagtagagacagggtttcaccatgttgcccaggctgatctcgaactcctgagctcagacaatccacctgccttggtctcccaaagtgttaggattacaggcctcccaaagtgctgggatttaaaaaatcagccaggtgcagtggcacatgcctgtaatcccagcaccttgggaggccgaggagggcagatcacttgaggccaggagtttgagaccaacctggccaacatggcaaaatcctgtctctactaaaaatacaaaaaaattagccaggcgtggtggcgcacacctgtagtcccagctacttgaggagctaaggcaggagaatcgcttgaacccagggaacagaggttgcagtgagcagagatcatgccactgcactccagcctgggtgacagagcaagactccatctcaaaaaaaaaaaaaaaaagagagagagaattgactaaagtatctttaaaagaattactttctaagcttggatgtgacacaagagatcacacttgtgaaagatcatcaggtttggtggcacctgatttataatttgtgtatattcataaatataaaactcagctcttcctgggagttaggacacctggggattaactaaaaggatattgtggcctgaataagccactcaggtttcagttcccttgactataaaaccttaataagttatttaatgcagagattgtgttcttcttctgaatcccagcttctaataaaattatgtcacctttcctgatcctccatttcctcatctgaaaaatggaattaatatgttagtgtttgataccagcattgttttgaggattaaatgagataatctaagtaaagatcttagtttaaaccgtgttaattgaaatccctggggttagaggactgttcctggcctcatctgcctgatacacatgttagcagaaagttcttagcaaatggctctgacagctctatctttctcagagggctgtgaccggcttgtgcagagctctggtgggtaaatagttttcagctcattctgcctgattatatcctcatttcttctggaacatcactacaaacaaagcaacaagtttgatcctatgaactaagcatggagttggaattcaagggtgactagccaacaatgggggttagaccctttaggccctgggatggccatgtgaataaagtaaaaaatacttcagtttttctttaactatgctattaaaggtcttctttatgtgcaatatctgaagcttcaccttaagggagatatttcacaaaaataagatgccaatgttattttgccttaaatgtataaaaactatcatctgttttgtagcaaggatcagaagaaaaataaaccaggtccaacgtttctatgactcccatgttggattaatgaatatggaatctttataaattatgcattgcataatttcactatttcttatcatcctcataacaatcccatgaagcactaatcatcatctccattttacagatgaaaaatcagaggcttacagatgtttaaaatgaagaatttccatggttgtcagtaagtggcagagccaggattcaaacatgggtctgtctgattccagaccccaggcttcttccaccagtgcttaactcattgaatagtattcacaactgttgggaacaggccccccaaaatctggccataaactggccccaaaactggccatgaacaaaatctctgcagcactgtgacttgttcatgatggccatgatgcccacgctggaaggttgtgggtttaccagaatgagggcaaggaacacctggcccaccca

SEQ ID NO: 12601 - DNA, 40000 bp, Homo sapiens
agcataacagaaagtcaagttgttaggtgaagagggagcttccaggaaagatctttaagggggtctagctcatctggaagatgagtcctttgcccttcccaccctctcttttcctcctgcctggtcatggtgtgattattgagctccagcagccatcatrcactgtgaggaactctgaggctaaagatggtgaaagagaaaggcggaggaatcctggaaccctgatcagcaggagccatgcaaccagcccacgcccaccwgcctccagacygctacatgaacagtcaacattcattttgtatsagccgcctgagttttctgttacatgcagctgaaccctgcaygttaaagaaattcatatccctcscctttattttttaagactctccatcaatcaaatcactgtctcattttgacatttatgttcattaagtatttgaataattggatcttacccttgaagcccaagacatttascaggtcccaagaggttccgagactgctcccaattacctaagttatctgcggggaatatcctacagtcttaagctactctaaaacttcagccctagagcgtgatggctgaaaggaaaaagtrtacttgtagcscttatgcttcttaacccactgaccatgtcctcaaatcaaaytgcactgtacaaaatggtagtcactagccacatatggttaaattaagtacaattaaacaaaaatataaattatgtttctcagttgccttagctgcatttcaactgctcaacagcctccaygtgcctggtagctaccttactgcacaacaatatagatggtttttatcatgccagaaaattctcctggagagcactgatctagaaatacacttttcagccgsgcacagtggctcaytcctatactcccagcgctctgggatgctgaagcgggcggatcacctgaggtcagaagttcaacaccagcctggccatggtgaaaccccatctctactaaaaatacaaaaaattagccggtcgtggtggtgtgcacctgtaatcccagctactcgggaggctgaggcaggagaatcacttgaacctgggaggcgggggttgcagtgagccgagattgcgccattgcactccagcctgggcaacaagagcgaaactcttgtctcaaaaaaaaaaaagaaaagaaaagaaaagaaatacacttttccccaggcgtcgatgacagccagttctccttgtgtcccttccacctccccaggcattccccagcccctcatcctctactcactgctcaaatgctggcatttctcagaactctatctaaatccctcttctcccctcactctgcctaggcgatctccttcagcatcaactgtcatccttatgcagaaggcttaaacactaatgaacattttttttttttttttgagacagagtctcgctctgttgcccgggttggagtgcagtggcgtgatctcygctcactgcaagctccgccccccgggttcatgccactctcctgcctcagcctcccgagtagctgggactacaggcgcccaccacctcgcccagctaattttttgtatttttagtagagacggggtttcaccgtgttagccaggatggtcatgaacatcttaatatcctcagaaacttcctgcaagaacccaagttttatctaaatcatggatgtggtagaaagaatatatctgggttttgcccttgttcctggcacagaactccgaaaactcttagaatgttctgggtgacaggagtgtcttttgttatctgtgaagagtcacttctgaccacatctgagtctgcactaatgaggtgacagagggtgggcccttagagcatttcaagggatgggctggccattccagaaagaccaagcatatgattagagggccagaacttccattcccacccctgacctctgggaagaagaggggctggagactgagctcaatcacatgaccaacgatgtcataagaccctgatacgataaacacctgagctcaaagagcttcctggctgatgaatacattgatgtgccaggagggtgatgcccctgactccatggcatgggagctcggcatccaggaccctcccaggtcttgccctatgtgtctcttccatttggctgttcctgagttgtatcctttatcataaaaccatcttctgtgagtttagtgagttgttttagcaaattatcaaaactgacaaggtggtggaatccccaaatttacagccagttggtcagaagtccaggtagcatgaagacttgcaattggtatctgccatgagagcagccttgcagaactcatgtctgacattcagttcaggtggttggtgtcagaaccgagtwgaagtgacaccaagctggtgttagagcactggtgtcaaagcattatgacctcttagccactgttckgatatttagttaatagtggttcaaaactgcrrtaaataaatgatgctttcaattcaccttggattactgcatacaggttcacaattcacacagaatattcaatcccaactgaattccatagagttctcaaaatcacagaagatatctatgtgcataaccaaacaaccataagaggaagagctatttttcataacctcaaaastcagtggagtatgtgatctaacaatgaatcagtgaccctgatgagatacaatgacagcaaggraggacagatccactggcacacactaatttaagtgaaaattcaaattataatatgaaattagtagattttagaaaagggccttctaacagcaagctctggctgaagtgcaatggcgcaacctcggctcactgcaacctctacctcccgggttcaagcgattatcctgtctcagcctctsgagtagctgggattacaggcacgcrccaccacccttggctaatttttgtattttcagtagaggtggggtttcaccatattggccaggctgttctcgaactcctgacctcaggtgatccacccgcctcagcctcccaaagtgctgggattacaggcatgagccactatacctggcaaatttagaatatttatatttatcctgttttttcaggtatatatatcccatgtcaagctaccctgcttggttaaactttggccacaatttctctaagctcaaataatgctgacgtgaaaataagctataatttattttactaaaamagaamtttgattttacaaaaagcagcttccgaatttgttcagcaggttcaaattttcaatcttgaaggattttttgttagcactggtgatggcggcattttgttttaatttagttttttatttgattgttttgttttgctttaaattttaatgcaaggcttcagagctttcacagcccaggtcctttcctatttgttaactgttggagtggtgtctctaacatttttataaactgcagcaaggacggaccttctgctgaacctcaacgacttccttaatggcttccatcctcccaccattaccatggaagtcactattttctacaccaactcatcagctcttccctggaaattctggaacacaaagaaaatagtctctctctggacacctgggtcataatatgaaaaacatggggctggcagccatgttgtgccacctggaccaaacagcagagactgctggtccatgacagaaaaggaataactcagaaacactgagggagtggacagctggaaaagaggcagaagacaaaagagagaaagaaagagtgtcctcctggccccatccatgcagcatcctagcccaatccctggctcctgacctggattccgtagacagcccagaatccttccaacgaattccctttttttgtgttagttgagttaggtctctttcaccagtaaccaagaatcccctgactaatagagggttctacagtcctttccgctgattgttttgaaagaggcaagatagaaacctacaggtggttgactgaacccagcagagtcctagagccaaaaagagatcagccaccccttggaacctgctccygtggcagggcttagaccacagaaccctaacttgcagctccacaccaggccactgcagcgctccacagcaactttctggtaggcccttgggccacagacttaactcctccagccaacctaccaactaatgctagrttaaaggggaaatgagttgttctctatttcgtaccgctgctttgagagtataatatgggggagacaaagtaaagttttcaggataccatcagagacaacatacatggagggtacagcttccccagctgcaagggcagcaaatcaaacccagaagaaatgtgggcacagcacctccattcacctaatcaactcctacaggaaagaagtaaatgcaagctgcaaaaccaaagggacatcayattagagaaaacatgctgatgattcatcatacagaagaagcaaccgttatttttaaagtccatsaaagcacctggttgaaacatgacacaccatggcggctgcacaacaatataaatgttgtttaayggccctgaactgtacattgaaaaatgattacaataatatattttgttatgtatattttaccacacttttttaaaaagacacatcataagagtttgagacagactgaattccctccattgcaaacacaccacaggcagtgtacatgtgacagccgtataaataacatgttccctggcctgaggcaactaagcacagagctgaggctgacctgagtggtgagtctgggtgggcagaaacgaacagagtcctggctttttgttttttgggagggagagggggcaggggttgtcaaacaaagtaggcatcttctgaaatgagtaacaacaaaaactcactccacagtccattttctccaacctactaacctggttgsagatcaggctackaagcctgatcagcacggtcttaacattactaatttctaaatatttcaacataaatggaacagttcctcactcctcagaaatcactgctggtttcctatcagccacaaacagatggcagctcaggagagtcctgttcccattatgccaacttggcaggaggctcacctgctgccacctgaaacaccaatccctcccacctttacacagaaggctcccaaacacaactaaaatcctgcctggatacccactgatcagcatccttaaaagcataggggggaagtctcattacaactccactaattaataaacatagggagggacgacatcacgtcctaatataattacaagaatactgtagcttttcattgcagttccactatatggttcagacaggttccctgcctgattacactgggctgtaatccagttttgctaatatatccatatgtataagagtgagagcagatcttatatcaaatctaaaggaaaacttttggaaatgctaaaaagttcaatttcagacatattaatacatcctcmacattttatttacaataagaccaccaatcttgtttttataaccgccaacaggtttcttggtttctcggctgcaacttttttattgaagtgatcaaagacttagagaacaacaggatgttcacaagttacccttaaagtagaaaacatgaaagctgcctgtgtgagtgtggtatatgtgtgtacatgttagtatacataccacgtatacacacacacacagaagttatatatatacatacatacagaaacacatacacacatgcacgcactggcaaagaaaaaagaaaacaatctgggctgttcacttcatcagattccaagcaaagatgctcttctgtgctttctggacacacctactaatcaccaaagccttaaccactgactgctccttgcctgctcagcaaatcaaactcaactctggaatgttaagccaaggtgttcttcaggaggagtagcttaagtaactagagagttactttaaatagtaagagttcactgcattcatgccatagcccagtacttaaacctataacaggctctgctcttgcgataaagaccaaaatccttaaatgtggcacacgaggcccagcaagaaaagggatctctcccaccaaggcctctgcatttccccagggaagccacctctgaccttctgactagatcaattctgcctttataccctgtacttcttcatgcaatgagggaaagaatgacagctattgcatcagttagcacatcttcggttgcaaataacagataaccctaacttaaattggtgtaaacaataagaaaatttatttcacagaacaagtccaaggttagtgggtgccaagcatggtgcactggggctctgcagagttctctctgctgttggcttggctcagtccttaacctgatgttggcttcatgctcagaccagtagcaaaacaattgtaacagttccaggcaccacacccagacatgacaactttcagaggaagaaaaggccaccattcttagagttgttgctgtaaggctgagttttccagaacctctggacagacctcccactaatctcactgaccagaactaggtctctggctcacccctacagtcatcacctacggagaatgggacccatgtgactagctgaaaccagtcaggatttaccccagtgctagggataagatcaccttccccagagtcacacaggagacaagaggctctctaaacaaaattccaattctacttagaaagaagggaagaaagaacattagatatgcactcgacagggtctgccggttatcaatttagggtacatgctctggtccccaacagtgtctacaactgccaagagaaagccccctccagcaacacctgcagggggattcataaacatgacaggatccatgcagagggaggccacagggtgggggtgagggagtaagasaagggacacagagtttttctgttgcttttgttttgttttgtttttgagacagagtctcactctgtcacccaggctggagtgcagtggcgcaatctcagctcactgcaacctccacctcctggrttcaagtgattctcctgactcagcctcctgagtagctgggactacaggcacctgacaccatgcccagttaatttttgtacttttagtagagacagggtttcgccatgttggccaggctggtctggaacttccggtctcgggtgatccacccacctcagcctcccaaagtgctgggataacaagcgtgagccacggcacctggccggaacacagagtttttaatcaggagatgcagactcaagtctcaagacttctgcttaacatctcatgactacaggcaaatctcagccttagttttctcataaaatacaaaaatatgtgcttgacatattgtgcaaggtkgctgtgaagaccaaatgaaatggcatatgtggaaaaatactttgtaaactaggkgttaaacataagtaagcaatgattatcacttacagtggaaaaagtcacaaaccattcaaaaaaactccttggagaaaaggccaacactcttatctggccaaactgaagtatgtgtaatctactaatggacatctaccttaaaaatggtgtttctgggctgggtgtggtggctcacgcttgtaatcccagcactttgggaggccaaggctggtagatcacttgaggtcaggagtttgagaccagcctggccaacatggcaaaaccccatctctactaaaaatacaaaaattagccaggcatggtggcgcattcctgtaatcccagctattcaggaggctgagtcatgagaatcatttaaacccagaaggcggaggctgcagtgagccgagatcatgccattgcactccagcctgggccacagagcaagactctgtctccactgatttactaatgacttggttggaggccaaaaccaggattcccttctccactctttccttgacccctcctccataggcatgcacaataatcagattctcactgttttctttttttttttgagacagagtcttgctctatcacccaggctggagtacagtggggcaatctcagctcactgcaacctccgactcctgggttcaagcaattctccctgcctcagccttccgagtagctctgattacaggtgcctgccaccaagcccagctaataatttttctatttttagtagagacggagtttcgccatgttggccagkctggtctcgaactcctgatctcaggtgatccgcccaccttggcctcccaaagtgctgggattaaaggcatgagccaccatgctcggcasattctgtcttctatatggaaaggtagggcagtggcgttctgtaggtcagaaaatgttaagaaaatcaaaaaaagtgttttagttagaaagaggggagattatttgaatgcacaaatagaagctactactggtcacccatgagaaagctcaggtcaactaacattaacaggtgtaagctgagaagccacaagataataaatccagaggcatctaaggcctccctgctaatgctcttttgaccaggtagcccacctgacatgaagccactcaacatgcagcctgctctgcctaattccctgcccgccctctccatctcttagttttgtccatctgtctccacttacggcagggcagagacaggagagcaggccacagagattttcaaacctatctgaagagtaagacacgtgtttattcaggcaacatgtctcgtctaggcaataaagttggaagactggtcatgcctcacacctagatcctggagggtgatgtataggaatacattcttcctcacagtgagggtgactttctctcctagacttaaaaatcagcarcaacatatcctaattttccactcaggtccaggcaaaagaacgagacagcagagtgagagcaaaacatcttagggaattaagatgaacaaataatggaaaatagaagcagtgactgacaattcgcatgggatttctatgcccaagtttcttgtggcctcacacatgcaaagcagcatccctgccaacgcgtaagcttcatggagcagatgcgtctaataagaccaatgcctaagattattttccatctaaattaccatatgtgtgtgaaaggactgaactgtaaagctgtaaagttctacacaaacgcggatagaaaaaccyaccccatctaaatccaatgtggtaacctggaaaaagtacattagtgaaaaaaccgggctgctctgcctacggagtggccattctgataaggggaaaaaaagaaaaaactggcaaaatctgaaagaagtctagtgttcaattaataataatgtaccaatgttaatttcttagttttgacaaatgctctagttatgtaagatgctggctgggcgcggtggctcacacctgtaatcccagcactttgggaggccgaggcrggcagawcatgaggtcaagagatcgagaccatcctggccaacgtggtgaaacctcgtctctacygaaaatacaaaaagtagctgggcatggtggtgcgcacgtttagtcccagcyacttgggaggctgagacaggagaatcgcttgaacccaggaggcgaaggctgcagtgagctgagatcataccactgcactccagcctgggtgacagagcgagactccacctaaaaaagtaaataaacaaaagcttataaaaaaattaaaaatacccaacatctgctcaagaaaaaaaaaaaaagaaaaaacattctatgggaaaaagactttctaaaaaatcaaggtagaaacaatggaaaaaagatcgataggtttgactacacagaataaacttttacacatcaaaatatgtcatgaacatggagttacaaggcaaccaaccatgaaaaatacttatacacctaagaggtaacacagtaaactccataaacttaaaaaaatgaaatgctacaggcctagatgctctatctgctacaacygcttcacacatttcaaaaccgtccaaactcacattcagaatctccttcaactacatgttttgtcccaaccatccaaaccctctgggttctctgcagcctgagagttctgctagagaaagtggagcttcaatgcagctaacctctgtttaatctgactattcctaaccaaaatcttctagaatctaaaacctttcctctttgagctcagtatrtcaagcttagctacttggtgcctacaatagtgatctggtcaaaccagaagtgggggtcctgagaaaagactaaggagtacaaagactctgcactgtcaaaactagactcaaatttcagcaccagccaatcagcaccagaagagggaagtggaaaagcttcaatgcatgcgagcagtcattttccacctgaagccccatttacctggatttttagagagactcacatatccaaagaaaaagcatcttttaaaataaaatacagttactcataactcagcagtttacattagagccaatctatctcaggaattttttgattgttgtttctgtgtgtttttaaatgtacaaagagaccagagaattagaagagacagtgtacttctttcaaatgtccctatatataaaaaatagtttatattaagtctaagttagaatcatattaaaaatattagttatattaagaattaagaggcagaagcttgtaaatctcacatgacaatgaagttccacacatgaatacagaagccaagaaacaaaatatttttcacacagaagagtatgaccgtattaaaccaccgaactaaaaattcagtagctgaaggtatgcatcccagctgattaacaatctttcaataacattagataaacccatgctataaaatattaataatctgcttctcaaaataatattatgtggtaacagacagtacttaaggccaggcggacacaaaatgaagagaaaggaattaaccaaatcttaacttctcagggctcttttgtgatctaatttgtgaatgcgcccagcctcccctgtctgcctccttcttgggacatctcatctggggtccactctaccactcaacaccaaaggagcgaaaccaattctgctagtcattaacaatctagtgaaaggtttggtaataaataatgaataagtgatgaaaattaaaagggggaagtcattggcttaaactgacctccatagatcactggtatcactcacctgatagtgcttccttgtatacatcaagttttggctgtcttgtatacatcagagtaacagatcaattccctattagtaaaatcacatgccatttttctcagtcatgtgggggagaaagaacttcaccaactaaacatgggtgaaggacagccaaggagattccatttatatgaccatcagtcagccaaggagacaagaggtatttgcgaaacacagaaaacaaagctaagaaagggaagaaaaaatgtggtatcccaaggctctcagaattaagaacaatactcctaccatttctgaaccatatggtcaaccttgagacttctctattttacaataaatttatagaaagctgattccaaagcacctcataaacattattgcttctatatctctctctaaagaaaagcattttggcrccaggtatagtggctcatgcctgtaatcccagcactttgggaggccaaggcaggcagatcacgaggtcaagagatcgagatcatcctggccaacatggtgaaatccagtctctactaaaactacaaaaattagctgggtgtggtggcaggcgcctgtagtcccagctgctcgggaggctgagacagaataatcgcttgaactcgggaggcggaggctgcagtaagccaagatcgtgccactgcactccagcctggtgacagagcgacactccgtctcaaaacaaaaaaaaaaaaaagaaaagaaaagaaatgcattttaactaggaatggtggctcatktctctaatcccagcactttgggaggccaaggtggaaggatcacttgagtcagggaaatcaaggtgcagcgagctatgattgtgccactgtactccagcctgggtgacacagcaagactccgtctcaaaaaaagaagcagttttagcctagcagggaccaaatgatacttaatattactctatcaaatttcttgcacaaaaatgcacataaaatacaattctcactatcattgactactttttatactgtatcacaaaatttttcaaggcattttaattggtcaaaaactttaaataaacatattccatatagcaatgtaattgagcagcttgttaatggtccagaaaaagtctgaaagtgatagttaaaattaaaggttaatgtaattaagataaaactgaatgagagagaaaatttgtggagttcctatcaggactttgctctccactgataacacagacccggctgtcacagccattgaagttgtgaggagggagatgcaaaatcaaacacaaatagaatgtcataaatccaaaaaggctgggaactgatgcattagagtaagctacaatagatagattctgggcagcatcccaatcctacactacctaatttattcccaagtccctcagaggcaaagctgggtaaaaagacgaaacagaatgcgtgccactttcattctcacttctgtcccagtattaaaaataattactaatggaataagataagcaaaatgtgagctttctgtcttttattaagagttattgtgcattacccccaaacatttcaaatattagattatttatttcattattcaggcaacagaaaattaactcagaaaagtagtttctacatatgaaacataagactgagtttctcatttcatgggaaaatataacaagaataaaaatggtaaaggctcaaatcacttgtaaggcctggaaaaggtgacctcagtgtcaaccgcattcatcttatgggcttctcctatgacccaacctcttttttcttttttttttttttttgagacagggtctcactctgtcacccagccttgacctccctgggctcaagtgatcctcccacctcagcctcccacctagctgggaccacaggcacttgccaccacaccgggctaattttttacattagttgyagtgatgaagtaggtctagctatgttgcccaggctggtctccaactcttgggctcaagcaatccttccacctaaacctgtcaacgtgctgggattacatgtgtgagccaccacgcctgagcaacccaacctctttaaacctctttctctcagatacattaaatccaggcatcactatttatttatttatttacttacttacttatttatttattttggagactgggtctcgctctgttacccaggctagagtgcggtggcacaatcatggctcactgcagcctcaacctccccaggctcaagcgatcatcccacctcaggcctccgagtagcggggacacaggtgcaccaccatgcccagctagtttttaaattatctgtaaagaacagacgccgggcacggtggctcatgcctgtaatcccagcactttgggaggccgaggtgggcagatcagaaggtcaggaggtcgagatcatcctggctaacacaatgaaaccccgtctctactaaaatacaaaaaaattagccgggcgtggtggcgggtgcctatagtcccagctacttgggaggctgaggcaggagaatggcgtgaacccaggaggcagagcttgcagtgagccaagattgcgccactgcactccagcctgggcaacagagcgagactccgtctcaagaaaaaaaaaaagacgaggcctggctatgttgtccaggctggtctccaactcctgcattcaaatgatccacccaactcagcctcccaaaatgctgggattacaggcatgagccaccatgcacggccaggcatcacattttaatggcattctctaatctgttaacatacagttaacagttaaattctctgattatttaacaactctaaacagtaactctgccgaaaatgtcagctttggctgatgggttttgtgcgcacagcagaagcctaacttcttatgatataggtcttgatattctaaccactggagctgaatttgtgcctccggttttgtggctaagagggtcatttgaagcttaagaaactgattacgtgtaaagataatcctgtatattttctcagcctatggtaacatcactgctgatcaacttttcatgaatattaaaactgccccggcactaacagctcggtttgttgtctgaggatctctgacactaccattttgccatagctgttcgtaacaatgatgtgcatttccccatggaggtaaacacactcttaatagccaaagatagtggaaaggcacagttgcaggggagaacaacatggtcctgtaagagcttcctacacaaaactcttgacttccctaactgggactgaaaaacattcacacacacaaatcagaggtataactgactcaagaagtttaaactaatcttccttttgtccttgacaagaaactaataaaagaaacatccagtaggatgaaaaaattctgaacctagtgacaacactctataacatttaagtagaattcaaaattgctgagcaacagttttggaaagcagatacgaatgagtctttagaatgtagtgttccaactagtaactagctggatcaatagctgaaacatacaaataaaagctgtaagacttcatagctttctttcataaaaatcttaaaaaatgtttcataaaccatgattgacttaaaggatcaaattcttagacttaaccagacattaatagattagactctacaagcactttatcccaggggatctaatatgcccattacaaactgggatacatgttaaaactacaaaaggaagaaacagtagaaataatggtaataacctaataccccatgtaacatgtttccaaatcctttcccatccattacagtctaaattgagtctttaatttttaaaaagtgagaaatcagtatcttacattatagtgtgtatcttttgcaaagctctctcaaatccattttgactctaattgtgtttctgattaaaaataataacagtgagaaagatgttcaaataaatctatatcctctgcacagcactgctgcacacctacagaataacttcctacactctataacctaccacaccattactgttggagctttccataaatactacatttcaattctattcttaaaatactctttatctcacgggtgagtatccttgacaccacataagtatagagactgttatttctgcttacattagaaaaaataactgattctaaattagccatatttaaaaggaaaaagggcataaatttttaaatccatgaattcaaaattttaattttcaccaattatattctatgaaagcaagaaaccaagtagagctgactcactggtatagatcctaccatggtaaagagatggttaaaaggaaaagaaagcatttatttatcagagtttgcagtcattttatagagatgtgattaatgtttctgagcaaataatgtatttaattttttttttttttttgagatggagtctcactttgtcgcccaggctggagtgcagtggtgcgatctcagctcactgcaagctccgcctcctgggttcackccattctcctgcctcagcctcctgagtagctgggactacaggcgcctgccaccacgcccggctaatccttttttgtatttttagtagagactgggtttcaccgtggtctcgatctcctgacctcgtaatccacccacctcagcctcccaaagtgctgggattacaggcatgagccaccatgcccggcccagatgtatttaattttagctaaataggtagtgagcatctatctccttgtcttcctggaatgtcttcccctttctttagttaaaataacctcaactctccttgtgagtccgtccccattctatatggtctttatagaaatctcaattgagaacaatacacacacacacacacacacacacacacacacacacacacccctaaggggtaggcaaattactcacggtcaatcatatgctcagtccaggaaatttgaatcttatgacargagaattaaaccagttggtgcagtctttgagaccatggttacctaaacaaacatctattaggtggtttctggagcttagatcctctcggctcagccttcaaagcctagttgttcagcatcttctgtgcctatatgtttccaagtgctgtgcctatgtttatgtaacctatctttttcactcaatattatgggtaccttcccagattggttgctataaatgcatgtcatcactttcaatggctgcatgcaaggaaggtaatataatccatttaaataattccttgtctaaggttatttcctattctttactatgtacatatatctgttctaacatttcctactatttcttcagaataaattcctactaaatgtggactttctgggtagaaggctatgcacactttgcattgtgatatctaacagcagctatctggactgagtgcatcaatgtctacataggctatctgagaggacatacctcccttcatctgcaccagcaccgagaattaccatcatccttatcattccctttccacaccaggagatgcccaaataataagatcagcaagagaaggaacagcagaagtcatcataacatgatactttatattaaactttaccaaatcatttcaaatccataaaggactaaattgggtctaggccgggtgcggtggctcacacctgtaaccccaacacttcgggagggcaaggcaggaggatcccttgagcccaggagttcaagaccagcctgggcaacatagtgaggcttcatccctaaaaaaaaaaaaaaaaaatttaattgaccaggtgtggtgatatgtgcccgtagtcccagctactcagaaggctaagggaggaggattgcttgaacctgggaggccaggctgcagtaagcatgatcgcaccactgcactccagcctgggtgacaaagtaagaccctgtctccaaaaaaataaaaaaattgtgtctaaattatattgccaacataatcactgaaaaatgctgtcttaagtctgctcaggctgcgataaaaccataaactgagtggcttaaacaacagaaatttattttgtttcttttatgtttttagtttttttattattatttaaataaaaaataaataaatagagacaaagtctcgctatgttgcccaggctggtctcaaactcctgtgctcaagtgatcgtctcacctcagcctcccaaagtgctaggactacaggcatgagccaccatgcccggccacaacagaaatttatttctcgaagttctggaggctaaaagtctaagatcaaggtaccagcaaggtaggtttcattctcaggctttttttcctcccttgtaggcagctgccatcctgctgtgtgctcacatggggagaaaaaaagcaagcctcctggtgtctcttcttctaaggacactaagcccatatgaaggccccacactcatgacctcatctaaccttaattacctcctacagaccccacttccaaatactatcacattgggacttagggcttcaacatatgaacgggggtagggggactcaaacactcagtccacaacaaatggtatctactttagctctgaattctatttatttaatgactagtaaaactgaacattttgtttattgcacatttaggttttttttcttttaaaaatggtctgctctgatttcatgtctgaaacagaaagtatacaggacgaacctgaaacatctcatcatatcgtaaagcaaggaagctatgagattactagagacgtgtcagaaggactcaggtgccarcctaaataagcctacactgcccaaagagggagcaatttgagcatcgaaaggacagtaactgcaatggactgaaacacaccacgtatgctaaaataggcgttcataatgttatgcgaaaaaatttaaaaccctcaaccatcaccactggaggatgctaggggaccaaatcataactttgaaaactggtaaatcaagggaaataatcagacacttttcaaacccttcctatacactctatacctcaaggtaaccaaataattgacaaaggagaatttctacacacacacacacacacacacacacacacacacacacacacctatttcagctaataactaaatgacaggatgtaaccatattgtaatccctcctgaactcatagaccaagttaacattcaagaatggttgctagtatcacaaaaagaaagaaagaagacttcctgatgaaaataatcctgccctcacaaaaaaataaaattggattcttttgatttagcctctacaatgaactaccaatgtacaggaaacacaagaaataaaataacatattttacattacaaggatgcaaagaataaaattcagtttcttcaataaagagttgcaaagaaaaaaaaagatagagaacctataggttaaaagagactttaaaccatccaactgcaatgtatggaccttatttgcatcttaattcaaacaatcatatatatatatatgatatgatataaacacacacacacacacgtacacgcccatacacacacatacatacacacaaatatatactgcagtcaaggagtattgattggatatctgatgatactaagaaaaaatttttaaggtaagataatagtaytgtaattattttaaggggtctttttcttttggagacatgtactaaaatatttacagacaaaattatatgacagcttgatttgctttaaaataatccaagtggagggacgtgagaggtattgctcaaacaaaactggtaacgttttaaaattgccaaagctgggcaagatacagtgctttattacaccagtctccactgttagcaatgttttaaaatttccatgataggccgggtgcggtggctcacgtctgcaatcccagcactttgggaggccgaggcgggcggatcacgaagtcaggagttcgagaccagcctagccaacatagtgaaaccctgtctctactaaaaacaacaaaaaaattagccgggtgttgtggtgggcacctgtaatcccagctacttgggaagctggggcaaggagaatcacttgaacccgggaggcgaaggttgcagtgagccaagattgcgccactgcactccagcctgggcgacagtgagcagcagggtggagtttcagtgcctgtgctgtgtggagtgaagtgaaccggtacggccagaacagcaacttcctgtgtgctctcaagcctgtcaataagatactgcagatccacaaagatgatgtaactggcctgcattgtaaagtgatatgccttatccagaaaggaagtttcagagaagccttgaatgtcatcaatacttgcaccaaactgttagccaataactctctctcctttgaaaaggcatattgcgagtacaggctcaacagaattgagaatgtcttgaagacagtagaaagtaccaaccggcagacagacaaactgaaggagctttatggataagtgttacaccrtttggaacactatgatgaatgcttagtggcataaagagatctcgtccgaaactcccacgatgcttatgatgaggagaggaaaacaaacccttcagcagttgttgcagctcaaagcaattgggaaaaagtggctccagagagcctgggcttccaagaaggcacacatgagctgtgctaaacactgcatgtgcactgatagaccacggccagctgaaccaggccatgaacatcctacaaaaagctgaaggtctttgccacmattcattatcagaagacactgatgagactgaggaagacccacaggcaggactggccatcacttatggtcagatggcctatattctgcagcttcagggtcaaacagaggaggctctgcaactttacaatcaaatamtactactaaaaccaacggatgtagggttactagatgtaattgcaaataacatcattaccattaacaaggaccaaaatgtctytgactccaagaagaaagtgaaattaaccaatgcggaaagagtagagtttaagctttccaagaaacaackacaagctatagaatttaacaaagctggcctggcgcggtggctcatgcctgtaatcccagcactttgggaggcggaggcaggcagatcacaaggtcaggagttcgagaccagcctggccaatacggtaaaaccccgtcwctactaaaaatacaaaaattagctgggcgtgatggtgcgtgcctgtagtcccrgctactcgggaggctgaggcagaagaatcgcttgaaccagagacgcagaggttgcggtgagccaaggtcacgccactgcactccagcctgggtgacagagcgagacaccatctcaaaaaaaaaacaatttcacgcctgactggttttggtggagacggggtttcgctgtattggccgggcggtctccagcccctaaccgcgagtgatccgccagccttggcctcccgaggtgccgggattgcagacggagtctcgttcactcagtgctcaatggtgcccaggctggagtgcagtggcgtgatctcrgctcactacaacctacacctcccagccgcctgccttggcctcccaaagtgccgagattgcagcctctgcccggccgccaccccgtctgggaagtgaggagtgtctgcctggccgcccatcatctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccctctgggacgtgaggagcgcctctgcccggccgagaccccgtctgggaggtgaggagcgtctctrcccggccgccccatctgagaagtgaggagaccctctgcctggcaaccaccccgtctgagaagtgaggagcccctccgcccggcagctgccctgactgagaagtgaggagcctctccgcccggcagccacccgatctgggaagtgaggagcgtctccgcccggcagccaccccgtccgggagggaggtggggggtcagcccccccgcccagccagccatgccatccgggagggaggtggggggttcagccccccgcctggccagccgtgccgaccgggagggaggtgggggggtcagccccccgcccggccagccgccccgtccgggagggaggtggggggggtcagccccccgcctggccagctgccccgtctgggagggaggtgggggggtcagcctccacccggccagccgccccgtctgggaggtgaggggcgcctctgcccggccgcccctactgggaagtgaggagcccctctgcccggccagccgcccccgtccgggagggaggtgggggggtcagccccccgcccggccagccgccctgtccgggagggaggtgggggggtcagccttccgcccagccagccgccccgtctgggaggtgaggggcgcctctgcccggccgcccctactgggaagtgaggagcccctctgcccggccagccgcccggtccgggagggaggtgggggagtcagccccccgccyggccagccgccccgtccgggaggtgaggggcgcctctgcccggccacccctactgggaagtgaggagcccctctgcccggccagccgccccgtccgggagggaggtgggggggtcagccccccgcccggccagccgccctgtccgggagggaggtgggggggacagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgccccgtccgggagggaggtgggggggtcagccccccgcccagccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgggagggaggtgggggggtcagccccccgcccggccagccgccctgtccgggagggaggtgggggggtcagccctccgcccggccagccgccccgtctgggaggtgaggggcgcctctgcccggccgcccctactgggaagtgaggagcccctctgcccggccagccgcccggtccgggagggaggtgggggggtcagccccccacccggccagccgccccgtccgggagggaggtggggggggtcagcccccctgcccggccagccgccccgtccgggaggtgaggggcgcctctgcccggctgcccttactgggaagtgaggagcccctctgcccggccagcctccccgtccgggagggaggtgggggggtcagccccccacccggccagccgccccgtccgggagggaggtgggggggtcagccccccgcccggccagccgccccgtccgggagggaggtggggggtgtcagcccccctgcccggccagccgccccgtccgggaggtgaggggcgcctctgcccggccgcccctactgggaagtgaggagcccctctgcccggccagccgcccggtccgggagggaggtgggggggtcagccccccgcccggccagccgtcccgtccgggagggaggtggggggggtcagccccccgcccggccagccgcctcgtccgggaggtgaggggcgcctctgcccggccgcccctactgggaagtgaggagcccctctgcccggccagccgccccgtccgggagggaggtgggggggtcagccccccgcccggccagccgcctcgtccgggaggtgaggggcgcctctgcccggccacccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggyggtgcaagatgtgctttgttaaacagatgcttgaaggcagcatgctcsttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaacaatttaacaaggcattacttgctatgtacacaaaccaggcsgaacaatgcctcaaaatatctgccagtttacattcccaaagtcccgagcatctctcacctatgttaacccaagstgcccagctctgcgtgaaaagcagcacacaaaagcaatagagctgcttcaggaattttcagatcagcatcaagaaaatgcaattgaaattaagctgaccatggcacagttgaaaatttctcaagagaatatttcttagcatgtctaatattgagaagcagagaggagttaaagcagaaaccaggcatggtgtctgcattagtgaccatgtgtagccatgaagaagatttaatagtaccactgatgtcttcacacaagctatctggtggtatcaaaaccatcagctcaaatctcctgctcatttgtccttgataaaagaagctgcaaacttcaagctcaaatatgggcgggaggaggcaattagtgacctagaacagctatggaaacaaaatccaraagatattcataccctggcacagtttatttctgcttactcacttgcagatccagagaaaggcacagctcttagtaaacatttgccatcatcagatagtatgtcwctaaaagtagatgttgaggctcttgaaaattctcctggtgctacrtacatttggaagggtggaaaagttactagagatagtcaaccaaaggaacaaggaaagggagatttgaaaaagaaaaagaagggaaaattgcctaagaattatgacccaaaacttaccccagatccagaaagatggctgccaatgcaagaatgttctttctaccagggaagaaagaagggtaaaaagaaggatcagatgggaaaagggacccagggagcaactgcaggagcttcatctgaactggatgccagaaaaactgtgagtagcccacccacctccccaagacctggcagtgcagcgacactatctgcctctacaagtaacatcatacccccaagacaccagagacctgcaggggctccagcaacaaaaaagaaacagcaacagaaaaagaagaaaggtggaaaaggtggctggtgatgagaatattcttgttgaaggctgtttttaaactagtctcggtaacattaggaatataataaaggtaatacagcaagaagcacagaactgctccctcttcatctccatattttcataaataattccttgtgtttcaaatggaaaacatcttcctcaaagtctgcctagtgagatatggcctactggttgcctcatagctttgtacagattatgaggactgaaaatatggccgggcacggtggctcacacctgtaatcccagcactttgggaggctgaggtgggcagatcacaaggtctggagtttgagaccagcctggccaacacagtgaaaccctgtctctactaaacatacaaaaattagctgggtgtggtggcacgcacctgtagtcccagctactcgggtggctgaggcagaatcgcttgaaactgggaggcggaggttgcagtgagccgagatggggccmctgcactccagcctgggtgacagagcaagaccctatctcaaaaaaaaaaaaaaaaaaaaaaaaaaaaaaaaaaaagaaaagaattgggcatttacccatcttggtatctgttgtatcctttatctgtgtgtgctgatttgatcttttttcagcttcacaaaccttatctaaggttttccaggatttaaacagaaactacttctactatttcagctagagtctgaagacacttctttctgttcaagttccactttaaattatggaggccttaggtgactgaaagtggaatcttctgagcattccaaaatatctgcttagaaatatcatgtgataaagaggaactttcttaatacactgatgttcttcacttaattaaatgaatggccacaagaaaaaaaagaattccatgataaatagttgaaatgtaaagaaaaaaagatctgctcatgtccttagcccatttttctaatgaactgttcatctttttcttattgatttttaagggtctatataaattgagatgtttaatatatgttgcacatatttttccagtttgtcatttgtctttttgctcatgccattcttcactatacagacactgaaaataacatatgctgtaaaaactgctgtcaaatcttttactttataggtttccatttggtgttaagcttagaaagacttttcccatactggaattctattaacatttacctacatttccctttaagatttattgaattttaaaggagccctataaatgaatatacctttccattcagcaaaatataccaccactacaacattagctgggaaataaaaacaacatctgcatcagccgcaatttcaggaagatgtgctggaatgtcatcatccatatagaagggaagtgataggacccagcaaggatttaacacacgtactggttttatcccccatgggtcctyattttaaagagtttctatgcattaaacaataacgaatttgttttaactaatttaattaatttaatttgttttaataaaataagtgttctataacttctaatcagagttcctgatcattgcctcgtggtcttttcactaaggtcaaatacaaggttcctgatcatcatgaagtaccacagttactaacatttagtatacaaaaatctagaacgtttatcaacaaaatgtggtatatacatacaatggaatattattcagtttttagaaggacaggaattcggctgggcgtggtggctcatgcctgtaaaccaagcacttcgggaggcctagctgggaggactgcttgagcccargagttcaagaccagcctgggcaacatagtgagaccttgtctctagaaacaacagcaagaacaaaaggatgcaaatgctgacacatgctataacatggatgaaccctgaggatatcacgctaagtgaaataagccagtcatgaaagggcaaatactgtgtgattgcacttacatgaggtacctagagtagtcaaattcatagagatagaaaatagaggggtggtttccaggggctgcagggaggggaaaagaaagagttggggtttaacaggtctggagtttcagtttgggaatctgaacaaagttctggacagaagtgatagttgcatgacaacgtgaatatacttaatgctactgaactgtacactgaaaatttaagttttttttttttttctttgagacagagtttcgctgtgtcacccaggctggagtgcagtggtgcaacctctgctcactgcaaccttacagcaacctcagcctcccgggttcaagcaattcttttgcctctgcctctcaggtagctgggattacaggtgtgtgccacagcaactggttaatttttgtatttttagtagagacagggtttcaccatgttggccaggctggtctcgaactcctggcctaaagggatccatctgccccagcctcccaaagtactgggattataggcgggagccaccacacccagccaggatgataaattttatggtatgtacattttaccacaaaaaattagtatgtttagtatgttacaatttagtaactaaattaacattatctcagccaaattaaaasacatttgacattttaattacatattccatgaagtctcactaaagacaaatgtacaatttctgtaaggcttttggtaatactgaaatgctgcacagaatgctaaacagaaacccatgcagtaactaaatcacagcatttcataagaggttgtactcagtttttaaatgcattttacaaatcacatgcatagctgagccactctatcttcactctctccaggagattgttaattgatgttgcaaatgagtagaacagatgaataaaaattccgacctagcttagccatgcacatggtagccactccacaaaccttcctgaattcagatactggaatctatagcaaaatcaaaaagaaaacctgggcttcccactgtcctataaactatccagtgagagggctgaaatttggcctgaaggaaggctgctgtctcttgactcttccattactcgccatctcagcatcaatgttggatgattccatttaaaacaggcttcaggtaccacacattgctttatgggttaaacatctttttctattcagagttttggtaggtaaaaaactgtgaataaccaaactgccactcttagagctccatatgcaaggctgaaagataaatatgatttatacacacaaactctttctaaatgaagaggacattattttaaaataaacaatagtaaatgcataaagttcgtatttctcaaccacaggaagcaatcatgacttcctaatcatcttccatgtatgaaagttccattgtgttgaaaacatttttctccatattcctccctctaattcagcactacggactttaactccggaagccaacacctccccacatcatgtaaaaaacaaaaccaaaaataaataaataaacctgctacttccacagccctaatatagagctcttaaaattcttaaaggaaatccacatcgtctaacaactttcacacaaattaagtactattctttaaactgaagaactaaacatcaaatttagctattcacaatttattcatatcatcacttccatgccagttacctatcaaggacttcactagaagacaggacacttgtgactctcccattcagaatatggctatcactgcacaacgcgagatgagtgtgcccatggcctctctggattgcagtgtggctatgtgcaaggtgccctgtcacttctcatccatcacaacctcacaccccagcaatctggcgctgcggagcccggggagaactttccaggaccaccgcaccattcccagcgggtttgtctgcaagaacttcaactaagaaatggagaacccagacacggaggaagaggcacaaaggaagggacccacacccacacctgcaacgggtttttacgtccttcaaaaccttagaaataacttcctctgtgctttttcataaacctgcctattgcaatgacttaaaggatatccttaaggtgctgaactactgtaaaacaaaagggcgtgggggagaccccaaagagatccaggagacagttcctggcgaggggagctgattatccccgacaggaaagtcttaagagactttctgatgacaagggcagttcagcaggtagaaggaattaggaccctaacggacctcaacctcggagagggctgtgtcaccctcgtttccttccacaaagccagaccaccctcaccttcccatccctgaagcggtgtcgccacaggaagaagtagacacctcccagctaattgccccaagcgggtcaaacttcggaatcggcgtcctgctctgcgttgtggagcgcatggcaaagaggaagggttggtgctcggaacaraatctccgtgatttgccagaggaaacagcacagactccagacagcagaagcgccgggatttccatgcagctgccacgacaggtgacccggcccgctctgcagtcacccggctcgcccgggggcttcgcggaaggtggggcaggcgggctggggagactggtccggcaggggaggtggcggcgcggccggggaagccgctcgggcccgacgccggggaggaagaggaggagcgcagcccagtctccctggggaaaccgttttcagggattttctgtctccacaattaagaaaaaaaaatggctccaagccaaacgcctcccgatctcacacacacaccacacgcaccaccccacacgcacgcccgccccgcgctcagctttcgccccattttctcacacgcggagacaaaaggctcccacagccaagcagcggccacggccgccgggcccgggtcagacgcccccttgcgccgccccctcccaagactcccgcagccaccgccccgacccccgcccgccgcgcccaccaagcccgccgcgcagaccccggggcccaccgcaggggcacacacgcccggcggggcagggacgacgctcgggccggcgccccctcccgcgggactgcgcggcggcgacagtggccccgcgcccgctcacctccgggcggccgtggcggcagccccagcggctcctccgtgcctctccgcctccagcagccccgcatcgccgccgccgccgcctccccccgcgtctcggccgagtctccgccttccttcaccgccgccgccgccggcccggctgcgcgccacgtgaccgcgccacgtgacccggcgcggcgagcggcgcctcccccggccggcgctaccgccccggcccccaccgccggccgttggcgccccccggccgccctccctccccggcccagggctcgcgtccccaacgccaccccgcgggccgccgcgccgcccgccaccggagccgccgcctgcccgggccacctgctcgcacccccggcgtcgccaccccgggagacccccgcccccggcccgcaccgcgccacggtgcccaagatgcccacagtgccgggcctaggcctccagtctcctggctcgggacggcctcagcacccgggcaccgcgcggcttgcgcgccgtctgaacttcgtttgagccggaagtggacgtcccagtcccattatgtcttacagggaaagccgccgggagcacagaagcgctgkcaccaccgacccgcgcagctccccgggaaaacggtcacccgagtggccgcgatggtaacatcccagaggatctcttcttcagttgtccatggagaaaggaccggatagcgtcattttaactcagggaagaacaattcacagccttccccctcctgttaaatttgatggatgtcctgctaacaacgaaacttgataatctcttctttttccagcttgtgcaaagaaatagcatagctgattgtgtgactcttcacacgtgtagtttaaaaaaaaaagcattcttttttccttgatttgaagcattagaggccccatatagttaggaatagcagcgactcttccgcaagggctcagcgttgttttctgttttgcctgtctgcaaaagttttcgaatccgtttcagacttaagaattactgattctgtgaattttgtcaaaaaaaaagttggaccgagtttgttaaattctgaaattccatgaatactcgcctcagcctcccgagtagctagggactacaggtgcccgccaccatgcccagctcatttgtgattttttttttttcagtgtaggagtttcgctctgttgccctggctcatctcgaactcctggctccaagtgatcctcctgcctctgccttccaaagtgttgagattacaggcatgagccaccacacttgacctaattttacaaattttgacaaatgctacctagactttttttatttttaaaaaggtaagccaagcgtggcgtgtagtccccagctactccggaggctgaggcgggtggatccctggagaccaggagctgggggccgcagtgagctataatcatgcctgtggactccagcctgagcatagcgaaacccggctctaacacaagaaaattaaatattaatttaaaagtaactgaaccaagaatagttgcctcatgtttgaatgcgtataaatataatgcatttaactgtggtcccagctactccggaggctgaggcacgagaatcctttgaaccccgagaggcagaggttgcagggagccgagattgcgccactgcactccagcctgggtgacagagtgagaccctgtctcaaaaagagtatatatataatatatatgtataacgcatttaatagaagcattaagatcagcattatttgattatattttataagcactccaaaacttaattttgaaaaccttaagaaataaaactacatttacatcttagagtaccttaaaagataatcttcgctcaatgtaattagtattgcacttcagtttagtgctcaatgttatgttaaatactgtggagagatcaaaggaagaatatgatatggcccttgccttcaaaatttacaatttctgtacagaattactttaaaatgtgtgcataacttttttgtttgtttttttgagacggagtctcactctgttgcccaggctggggtgcagtggtgtgatctccgctaactgcaacctccgcctcccaggttcaagcaattctcctgcctcagcctcccgagtagctgggattgctgggattacaggcgctaccaccatgcccatctaattttgtatttttaatagatacgaggtttcaccatgttggccaggctggtctcaaactcctgacctcaggttatctgcccacctcggcctcccaaagtgctggaattacaggcatgagtcaccactcctggccaaaatatatacataacattttttaaaccctttctctcttgcgcgcgcgcgcacacacacacggatcagggatcagcattcatttgcttggccctggcctggagcaaattatggaaattttgacccttgctgtcagactaaagagaagaaggattaaagatgaactttcttgacttaataaatacaatctatgtaacagtataaaaatgatacaacaaataccatcaagactgaatgatacaggtgttcttgcttctgcaaaatgaaaaaaaaaatacaaaccttgaaactactcttctaataataccatagttttccataaggcccacaggtataaactctctcttatccagcactcttgggtacaaatacacccaactctcagcaaaactgagaagtccctcaagtttgttttctgcctgtgtcattttgcacagtgtcagtggttttgcgaatgtctttggagcaaatatcttcactgaagtcctggttctaccacttactaacaagtgacaaacaagaacaatattccaaatgctgtgtctttagccatacattcaaaaaacaatatctccctcacagtgctgttgaaataatcaaataaaatatgtaaattatatgcctggcacacaagaggtgctcagtcaaaaaataatayttgggccgagcacagtggctcatgcctgtattcccagtactttgggaggccaaggcaggtggatcacctgtgatcatgagttcaagaccagcctgaccaacgtgacaaaaccccatctgtactaaaaatacaaaaattagccgggcgtggtggcacacacctgtcatcccagctacttgtgaggctgaggcaggagaatcacttgaacccaggaggcagaggttgcagtgagccgagatcatgccactgcactccaccctggragacacagcgagactctctctcaaataataatagtaataagccgggtgcggtggctcacgcctgtaatctcagcactttgggaggccaaggtgggcggatcacctgaggtcgggagtttgagtccagcctgaccaacatggagaaaccctgtctctactaaaaatacaaaaaattagccgggcatggtggcgcatgcctgtaatcccagctacttgggaggctgaggtagaagaatggcttgaacccaggaggcggaggttgcagtgagccgagattgtgccattgcactccagcctgggcaaaaagggcgaaactccgtctcaaaaaaaaaaatactaccactactaacaataatacctccaacctgaacatggtgaaaccccgtctctaataaaaatacaaaaattagcttggcctggtggcggccgcctgtagtcccagctcctcagcaggctgaagcaggagaattgcttgaacctggggggcagagtttgcagtgagccaggattgtgccactgcactccaccctgggcgacagagtgagtctccatctcaaaaawaataataataatacctaaggaccagacacggtggtggcacgcacctgtagtcccctgctactcggtggctgaggtgggaggatcacttaagcccaggagttggaggctgcagtgagctgtgatcaggccacagccctccaacctggtcgacagagtgaaatcctgtttctgaaaaataacaatgataataatagctaagttttattaaatgcttaccgtgggccaaactctgtgccttgttcgttcttatttttgctgttctttctgtccctgtttccctcagtgtgtgccttctgtcccctaccttacccctgcccccttaggaatctattctccctctgcatgttcagaacaaaagtgatttaaaacttttaaaactcatttataataatctattacatctgttatgaatttttttttgagacaggatcttgctctgttgctcaggctggagtrtagtggtacaatcttggctcactgcagcctcaacctcccaggctcaagtgaccctcccagctcagcctcccgagtagctaggaccacaagtgcacaccaccacaccaggctaattttttaaattttttgtagagacgagatctccctgtattgctcctaggctcaagccagtcttcctgccttgacttcccaaagggctggggttacaggcatgagcctcccagccctttgggaggcctgcattttatgcttctctaaaatcctttctaattgtgaaatgaaaaatgttgctgcttatttagaaatctgtggcatttgggagccattaggagggagatctggtaatggggacccttccactgtcctttgaaatcccacacgtccaattagtcccattttgttgtgtttaaatacttttaaacagtagattttggcaacacacttgaagaaattaaaaccgcataataattgcaaaatgataattgctgtaagaaacagcatccctcatgtggcattcgtgatcgtgactgtcagctggtgggcctgtagctctagagtcaagtttgggaaaagcttcttactaccctgaccaagctcccaaaagttctgagatacgtgacctttctttgaaagttactcttcaaataactttgctttgcatctgccttgggtcacacagtgagctcagagcccaactgaatctgataggcattctggtaacagtgtatcttgaccacttattaaaacgtggctgtgctcctggcggtggttaatcaccactgtcctaccctaaggctgggcctgggggcacaagggatccatagtcacagccagccaggcacctgggttggcctctgttcccttcccttctctccacacttctttgcacccctccttggccatcatgttcctctaagacatccagacaatgaagctccagcagctcttcttgcaggcctcttccctgcctccctgtcaccaagcagcctgctgggcaactcccctccttcttggctgcgacataactcagagtccaaagtttctgctgtctcaagcccttcagccaccaagacactcagcacagggatagggaaactggatcctggacataaggagatggcrgaggagtcagagcttttgaagaataagatgcaagcccctcccctttcgaggtgtcctgagagccaaaaatgccagcaccagctgaggcttcatcactggaaacccagcgtccggcaccaggtgaaacgcygtagccccgctgtgctccgctcagccatgccacctgcagactgtcctgcagttctggaggccaccacagccacacgtgaagaaacagtgatgagttgcagcacatcctttgagggtggccaggatggtgaggactccagaagctgtcttacaatgtcatacagttttataaacacctgaagaagaaaataagaatgtttaacctgggaagaaacacacttacaagcctctgctggtgaactttgtcccattgagagcaattgtatgggagggttgttccttttttttttgttttttgttttttktttttgagacggagtcttgctctgtcgccaggctggagttcagtggcgcgatctcggctcactgcaacctccgcctcccgggttctagygattctcctgcctcagcttcccaagtagctgggactacaggtgcataccaccatgcccagccaatwtttgtatttttagtagagacggggtttcaccatgttggccagatggtctggatctcttgacctcrtgatccacccgcctcggacccccaaaatgctgggattacaggtgtgagccatcaygcccggcccggttgttcccttttgattatttattgagcttctactttaaaccaggcagtgtccaaatgagaacaagtgtgtgggaacctatgaaggggctttggatcagaaaaggaagggcctctgctagggcagtcgccagggaggtgtgtggccttgcaaagtagccttagcccacccacttctatcttttgactctgatggcctggcctggacacacagaatgcaacccggggtcctactcaccctctgccttaaaggctcgaggctctaatcagctaactcgtccccttcccagcctgctcagagcctcccagagcaaagtaatacctggaccaagatctagaaccaaaaggcctgcttggttcactctggaaaggagaagatggcttacaagaaaagagagcttttgtccttgtctgcttcccccattcgggagaagggaagaggtgagcgggctgcggtactttgtacacacttgaagcgccactctccttcctcccgatcctttcattgctgaggtggtcctttagggccctgaattctgagcagactctcagtagatgcacatcgttgggtacacattttcttttttttttttttttttgagacaaggtcttgctctattgtcctggctggagtgcagtgtcgtgattacagctcgctgcagcctcaacctctccaggctcagatgatcctcctgctgcagcctcctgagtagtgggaccacaggtgcatgccaccacacctggctaatttttttattttttgtaaagatgggggtctcaccatcctggctaacagtagtgaaaccccgtctctactaaaaatacaaaaaaattagctgggcatggtggcaggtgcctgtggtcccagctacacgggaggctgagacaggagaatggcgtgaacctaggaggcggagcttgcagtgagccgagattgcgccactgcactccagcctgggcgacagagcaagactctgtctcaaaaaaaaaaaaaaaaaggggggggtctcactatgttgcccaggttggtctcaaactcctgggctcaagcaatccacccacctcggcctcccagagtattggaattacaggtgggagctgctgcacctcgcccacactttctttaagcaggatggtggacagttcaaaaggcattgacttggggccagaagcagtggctcacatctgtaatcccagcactttgggagaccaaggttggtggatcacctgaggtcaggagtttgagaccagactggccaacatagtgaaacctcgtctttactaaaaatataaaaattagctgggtgtggtgacgcacgcctgtaatcccagctactcaggaggctgaggcaggagaatcacttcaacccgggaggcggaggttgcagtgagctaagatagtgctactgcactccagcctggggatagagcaagactccgtctcaaaacaaacaaacagcaacaacaataaaaaggcactgacttggtcttaggtaagcagctgttaaggcaggtagccatgactctttggggaacaatttttttctggtagttttcgaaaagcttccccacctcttgtgtagaagtgttccctggggccggacacggtggctcatgcctgtaatcccaacactttgggaggctgaggtgggtggattayctgaggtcaggagttcgagaccagcctggccaacatggtgaaacccccatctctactaaaaatacaaaaaaaattagctgggtgtggtggcacgcacctgtagtcccagctactcgggaggctgaggcacgaggattgcttgaacctgggaggtggaggttgcagtgagctgaggtcgcaccactgtactccagccagggtgacagagtgagactccatcccaaaaaagaaaaaaaaggaaaatgttctctgggacagaggaagagtgattttattaaagaaactcgcgttcctcctggaggaaagggatcaatgacccccacaccttcctctacaaggctcagcgtgaagggtgtgacaggctggccctgtacaaggcctgaggcaggggagggctggaggccttgaagtttggtgactgagagagcaaagtgagatggaatccgtgatttacttgtggggccacgtgggaaggagccagaatggaggcccagggctgggaggtgtccgtgctggagccagttttgagccaagcctcaggaagctggctgccttctgcagagctgctgggtgggagagccgtggagctggcagccgagggttgtcacatctgagcctgaagactactatagctgaagcatcattcactggacgtgacttctctcaaatagtgatccccttaaatgctttggtcttatctgtcgtgtagaatctgttctatctggttttgtgtttgtgttcaccaccacttggaagaactaaytgagacttctgaagaatagacggtcacatggcctgggttctcatctgtgccgccacctgggcacaccactacatctctccagcctccatttcagagtctatgaaatgggcagggggcattgttccctgacccttcccaactcaaaagccctgtagctctttaaattcactcatataaatatatatagggctcttttctgacccatgattttgctgtagtttggaatatttatatcaacctcccataagaagtatcttgaaaacatttttttagggccaggcgcggtggctcctgcctgtaatcccagcactttgggagtccaaggcgggtggatcacctgagatcaggagttcaagaccagcctggctgatctggtgaaaccctgtctctactaaaaatacaaaaattagctgggtgtggtggtggctgcctgtaatcccagctactctggaggctgaggcaggagaatcacttgaacccaggaggtggaggtggcagtgagccgagatcgcaccattggcctggagcaagactcttgcaccgttggagcaagactgtgtctcaaaaaaagaaaaaaataaacaaacttttttttagaaacagagtctcgttctgtcacctaggctggagtgcagtggcatgctcttagctcactgtagcctccaattccagggctgaaggaatcctcccgcttccgcctcttgagtagctaggactacaagcacacacctccatggccaactaattttttaattttttgtacagatgaggtctcagtctgtagccaaggctggtcttgaactctcggcctcaagcaatcctcccacctcgcccttgcaaagtgctgggattatggggatgagctgccacacttggctcccaattatattttgtttttcctcagcaagttcatccaatgtaaatttctcaagccaggagggctataaagagaaaaacaaacaaaataacagcaacaacaaaaaaacaaactggggcattttaaagttaaatttctttctttctttctttttaatagataggggtctcaatatgttgcccaggctgttctcaaacttctgggctcaagtgatgttcctgcctccatctcctaaagtgttgggattacaggtgtgagccacgtgttaggccctaaagttaaatttctatctcaatgccatgctttcctttttttccctttcgccctcccccacccttttcttcccttgaccgtgaatccaagatatacttgataaccagtaaaaagtcactaacaggaccattgttcaagcatttattttggaggagtccaccataaattttctgagaatataaggatagcaaatactgttggttgtacccgcagccattctcccgacttgcttgctaatgaaccctagtttattaagatatccgcgtgtatccatatcacagtccactccaggaagcctggccacatccccacatcctgattgggctgtgccagtggttcccaccatgtggtccctggcccagcagcagaagcagtcatggggattgttaaaaatggacattttcaggctccatgccaaacttcctgaatgagagccctgctgttgggggcctgaacagtccgtggtttaacacactccacaggtgattctgatgcacaccaagtttgagagccattggtataagcaaatcctgccaatgctattctctttccttagaaacaggcaaatgatccagttctggtcagttacgctcggggggggtaccgtactgggaaagcctttcagaaaccgtttcttagcctttatttttttaattttatgtattttttttttcagatggagtctagctct

SEQ ID NO: 12602 - DNA, 40000 bp, Homo sapiens
atattatctagattttaaaatgtaacaatttgtttggtttgataatatttagtatctagctttagcctaggatgcaaaagtccagtgtgtccacatagcggtagcatgatttgaatctaacaaatttggatacctagtttacctttttttttttttaaacagcgcagaaaaggaaccaatatttcagaaacaagcttaataggaacagctgcctgtacatcaacatcttctcagaatgacccagaagttatcatcgtgggagctggcgtgcttggctctgctttggyagctgtgctttccagagatggaagaaaggtgacagtcattgagagagacttaaaagagcctgacagaatagttggagaattcctgcagccgggtggttatcatgttctcaaagaccttggtcttggaggtaggttcatattgattttcaggagagttacgtggtatgaacaagcactcttcacttagaccatcctatgaccagtaagaaggtattccattttattttcatttataaaattttctatactcatttaccaacaaatttgcatgaaagtgagagcaaaggataaaataagcatttaatagtatgattagatgtgaattagacttaatgagatataataaaatggccaaaagattgtaatggtcaaaattaaggactggaaaatcctagaatgagggcattaaattttgtgaaaggcgaagggaactgtcatttgtagagggtatgttgtatacttgttacagtgttattacttagaatcttttatttaagcaccattcatccattcaaccagtgctttttaagcactggctattcatttaggaaatatttatgcactgtctactttgtgtggggatggggtggtggggtggggtggggtggggaaggtgggagagacacaaagaagcaagccctcccctgtctttttttccaagggcactaatcctatcgtgagagtctaccctcatgacctaatcaccttctaaaggctccatctccaaatatcatcacattggggattagagttttagcttaggaattttgggaggacacagacatccagtcaataccatatttgaacattttatgtcactaatatatatactagagtccactttttcacttgacagaaacatatttccaatactgttaaccattctttatcagtatctttttaagcccaagcatagttgtttttcagttgacttcataatgtacttcacttttcaaacttagatgaatgtttaggttattttcagttatccttttttaggtaacactatagtgaacctattcttgcatgtaactttaaagattattaaatattatgtctttaggatgaatttcttacatggatttccaagagtaagattattacatcgaaggatgctaatttcttcatggttcttgataattattgttatattttctaaaatataatattagttcatagtatcaccagtagtatatgaatttatcagttttatcataatctcatcagtgattttgatggtgtcctgttgtttcaatttttacttaattttttttatcgtttgaacattttttctgatttgttcactgtttctatattgctttatatgaatcatccatacatgtttttgtccattactattggcgtcttaatatttttccagtggtttttaatgagtaaattttattatatatacatgtattaatctyttgttctatttcatatgtctttcccaaagtattgttttagtttttatttttaaaattaattttttaactttctaattttcggttggcactttaaaaatgtgatattttctattgaaagttttttatttttcaactgcttttgctgctttagatttaagaaagaagtttttacatgattctgatgaattcagtgttttgtttgctgccatttaaattatttgatgtactaaaaagttctttgcagtttgtcctgagtcacttttaatggatagtatgtaatcatcaacagttgggggataactctaccctttccatttggtttggaaaatctactttttcatatattcagtcattatatataaattggggtttttttttgagtttccatactggttttattttatttttatttctttttggtgacaaatctacatattcatacattgaaagaagtgttaagaaggactaaatgtgttcctatgtctttatggcagaacaggtttactcaggagaggattatggtttatttcatgttgcattttctttctgaagttgaagtggaattacagacctgaaatagttatgttgktatctttaaatgatattacagatttgctaagactctcattgacttccagaagcattcacagtttctgaaatagttacattagttttgttcagttctccagatttgaaggcagagactcatttttgatgtgtgtgtgtcttctttggttcttagtttaacgctgggtgtgttaacagaattgattgttttgaactcgattgctttgcagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaagtaagaccacagtttcaaatatataattactaaagaatcaatgcatttaaatttgacctttgtacaaataagattttataaattttaatgaatttttggggcatagtctagaacatatgtatattaaaataaactgtcagtcaaaagagtgttagatattcagtgcttttgttaagaatatcatatagagaattttcctttgacatggaactatgaagagttctcctttgactaaatgaaaattacataatttttatgtgacgggaatttagaggatatatttgtaactaaggcataagtccatttgtgyacattttggagtttgagtttgtggttaygatactttctattagaagtcaggatacaaaactgcaaggagaaatccctgtttcattctcactaaagacccagtctgttaggactggcttcttctcttgtttattaacttatatttaccagtaacctttaaaacactaattgaagaagttttaagcgtgagaaccctcatgtgactgacacagactaaagtattgacaaagcaagtgaagaagcaagtggacttaatcctttggactaaaaagacttgatatccatggaagaagagtatgttcactgtatgaaaatggaaaaatcggccaggtgcggtggctcatgcctgtaatcccagcactttgggaggctgaggtgggcagatcacgaggtcaggagttcaaraccagcctggccaatatggtgaaaccccgtctctactaaaaataagaaaaaattagccaggcgtggtagcacgcacctgcagtcccagctacttgggaggctaaggcaggagaattgcttgaacccaggaggtggaggttgcagtgagccgagatagcgccactgcactccagcctgggcgacagagcgagactcggtctcaaaaaaaaaaaaaaagaaaatggaaaaatagtcccaaatataaagattataaaaattacctgtgatctttctgactagaaataattactcttttttttttttgagactgagtctcgctctgtcacccgggctggagggcagtgttgcaatctcggctcactgcaacctctgcctcccgagttcaagcaattctcctgcctcagcctcccgagtagctgggattacaggcacatgccaccacgcctggcaaatttttgtatttttagtagagacggggtttcaccatgttggccaggatggccttgatctcctgaccttgtgatccgcccaccttggcctcccaaagttctgggattacaggtgtgagccaccgtgccctgccagaaataattactcttaacagtttgcaggatgcattccaatacttgttttcccctctgtgtatgaatgtatgagggtatgtaaagtttctctgcctatattttattttttaacaaattaatttatttttaacaaattaagatgaaaatccaatgttactttttaaaatatttttaaaatatttaatgattactaatgattactaatgtaatcattagtaatatgtattaaatgttgataaattagaaaataaaaaacacacattggacacgtgtttgcacacacatgcatgtccagtttatatggataaactggagataaggaatttatatttaatttaaattgctgaaatgtgctgctttagaaatgtatttttttttattctttagtgcaaagtttattgaaggtgttgtgttacagttattagaggaagatgatgttgtgatgggagttcagtacaaggataaagagactggagatatcaaggtgagaaataccaaatgtcacctcttcctaagagatgttgtttttcctgctttttcacttacccctttaaaaaagtaggcttaccggtttacatgttgagtatctcttatctgaaatgctagggatcagaagtgtttcagattttttatttttttcagatgtttgcattatacttaccagttgagcatctctaatcygaaaatctgaaatttgaaatgatctaatgagtattttgtttgtcacattactgctcaaaaagttttggatttcagatttttggattagagatactcagcctgtgttatttatcaaatgaactgagttctttctaagccatatgcaacaggatgggtttcagattgcaacacattgttctttagaggacttcagaatgctatgcaaaaaacattttaaacagaactaatgtgaatagtttttgaaacagtaatatacatcagcagagaagcagaggggaactagcaggggaaagaaggcaagattcaacataaaagaaatgattcagataaaatgagcaatttaactcaggtaatagtaagagaatctttttaaaaacaatttatccttttattttattttattttattttgttttattttttgagacggagtttcactcttgttgcccaggctggagtgcaatggtgcgatctcggctcactgcaacctccacctcccaggttcaagcgattctcctgcctcagcctcctgagtagctgggattacaggcatgcttcaccgcatccggctaattttgtatttttaatagagacggggtttctccatgttggtcaggctgctcttgaacttccagcctcaggtgatctgcccacctcagcctcccaaagtgctgggattacaggcgtgagccaccgcacccggccaatttttcctttttttaaaaaaaaattatcgtagtaaaaaacatgtaattctggactgctccccatagggttaccacctcttagaaattgtcctctaatgaaggtgactggaatgttttctctgctcatactgtagtattataaatacatgtagtcatttgtacaaaaattcttctaagccctagctgctgactaaaagcactatatgaagttaggaaattttagaatgaaagaatctggctagtcccttgaatttgtaatgagattgactgctctgtgttacatgcctgccttgtagttgtttcccccattgtctgtcaaagtggagagtaatcccagatggtttgcatgggagggctacaaagggagatgatcctcagggactcagaggaagtatctaaacactggtcatgcgttatctgaagcccacgtaacagtttcttcaatagtattatcttcaactactctctataatgctatctgataatatatctaaatctcttcacgcacattttttaagaatggctttttttrctgtgtgtttctgactactaaactgagtagtcttcatttctgttataggaactccatgctccactgactgttgttgcagatgggcttttctccaagttcaggaaaagcctggtctccaataaagtttctgtatcatctcattttgttggctttcttatgaaggtactgtaggagtgtgttattgtaatttcaataaaagaaacttgaaatttgaaaattattaaaacattttctttttatttgttttagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctggtaagaaatagcatcttcagttcttacaaaggctgtgtctaaaataggccagagataaggatggcaggtgaaacattcatccagtcaaccagatattctggaactgaactatttaaactagcacttaaaaacagcaaaacaaactcccaaattaataaaaaaaagtttcgggccgggcacagtaggtcatgcctgtaatcccaccactttgggaggctgaggtgggcagatcacctraggttgggagttcaagaccagcctgaccaacatggagaaaccccgtctctactaaaaatacaaaattagccgagtgtggtggtgcatgcctgtaatcccagctactcaggaggctgaggcagaagaatcgcttgaacgggaggcagaggttgtrgtgagccgagatcgtgccattgcactccagcctgggcaacaagagcgaaactccgtctcaaaaaaaaaaaaaagttttgatatgtttttgtcacataatagcatagtttttagaataattgtttttattggcatatatggtatttttaaaggtagtctctggacacgaatctgactctgaattctttatctcttatacctaaatatttttgtgcttggtttttgtagtaatgacagctaccatttcttgaatgcttactataaagtgtttagcaaacataatttcatttaatctatgtaaccactctgtgaggtaggcattatcattattctcattttacagatgggagaactaaggttcagagagattagttagctcctccaagtataaactattagtaatggcagaaccagggttgatatcaggtctgtctggctcatatgtgcctgtttgaacagacatgtcctgtccgcagaatgtgagaattgtaagggatcttcaggatcatgttagttttgagttgaatataaaggcttcatgagatttagatagctttgtaaaaacattaataaaaattactttttcacaaatctaaagttttcatggtacagtttttaggatctttttttgagaatgggatgatataggaaagaaaagtaaaaaaaatttaagaattttgataaaattgaagggaaaccctcattgtcaattatgatatgattagagtaataggaaactatttttggtatgagtacattttgtttaaatattccgtttttttcaagttwttttttaaactaagtgaaaccactttagtaacaaattattaacagaaatgaagtgaaatgaagtgggcaaacttagattttaaataatgacattttcaacatgtacatggaaacatttcaataaattttcatttagttaagccacttttgaagctttcagatggggaaattatgaatatttatgaaaagggtcatcsattacctgatatttttagcatttatttttcttttattgtaaatrtggtggtttttcttttttttttcttttttccaatccagaggttaattggagtagagtgccctgaaattatggagagaaaccattggtaggtttatattaatattagttagattaccaarattctactccttaatatgaatggaataatttttaacagaggcttctgctcctctattcccagatcacactgggaattgtatgacagttcattttctatataagtagcacagaaatttaaagcttgtttggaagtatctcagagatgagctgatcaaaccatttcatttttatagatgaakaaattgaagctcagagaggtagggctggcctcgaattccttttctagtgtacataccctcctgctgtttgtgaattggtagtgtatttcatctgattattacaagaatatattgattataatacattaaatattaaatatgacagtagtctgttaacatttggaagaaaggtaggtggttttctccctgtttcatttcatctgaatttgcctcattgttttttcattcagttgtatgtatgtttatattaatgttctcttagattccttagtcattccttggcattaacagctaagtgcttaatgaataattttattaatgaaataattagttyttgatttatcacaagggatatatgtaacaaccataacagatgtatagtaggcatttgtttatacttgataagaaaatatgtgatactttgaaattgaagtgttatgacccatttctttgggttggtgggatttattgcagatcacctgaaagaaccattcttagaagccactgacaattctcatctgaggtccatgccagcaagcttccttcctccttcatcagtgaagaaacgaggtattattttttgggcttattttataaaggaatcagtattccaaatgacaaatatatgattaaatttatactgttacgaataacttctgggacagatagtttgtcactgtggattagtgcattattaataccaaaattagttttatgatctatttagttrttaacattgagtgtatasaagtattgtgctagtcagggaaacaacaggtaaaaaactgaccttgacctagagaaggcctttttctttttttctttttttttttttttttttttttttttttttttttgagacggagtctcgctctgtcacccaggctggagtgcagtggcgggatctcggctcactgcaagctccgcctcccgggttcacaccattctcctgccttagcctcccgagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccgagaaggcaattttctacttaggaatgtagacagataattttacaacactgttgataaataaaacccacagattcagtgtcaagaagtgtgcagagcagggagggaagcttgtgaaatgggaggggtagttagggaggacgttgttcaggaaacagtggaaacaaaggaccttggacctggaggatgagtgggagttcatgaggtggacactaagatgaggaacttctaggtagatggaataacattgccaaaggatgagaaatggtggcactttcaaggaactcaagcagtttcctatggcaggagcatagggtgggtgtcagagtgggagacagaccattaacatttaatcttacagacaatggaaagtcatttgaagtgttttcttgttactaactttattgatatataattcacaaatcagtttgcccatttaaagtgtacagtacagtgacttttttagtatattcacagtgtgtgcatcaccaccacaatcaaatttagaacatttttatcttgcccaaagaaaccccgtacccattggtattcactccccatttcctcccaacactcagccctaggctacccctaatttactttctgtgtctagatttgtctatttgggatgtttcctaaaggcattgtatagtaaagccctttggaactggcttttcatttagcacaatgtttttgaggttcattcatgttgtagcatgtttcagttcttcatttgtttttatggccaaataatcttccaytgtgtggctatattacattttgtttagccattcatcaattgatagatatttgggttgtttctactttttggttattacaagcaatgctgctatgaacatctgtgtgcgagtttttgtgtggacatatattttcatttttcttggttatatacccaagagtgatattgctggattacatagtagttcacgtttaactttttgaggagctgctagacttgttttccaaaatagctgtcccagttacattcctttcagcagtgtgtgagttctaatttctccacatccttgtcagtgaacacttgtattatctttgtgtgcatagccatcctagtagtgtgaactaggccttttatcattgtgctgatttgcatttctctcatagataatgatgttgaacatcttttcatatgcatataggccatttgttgtttggagaaatgtatatttagactttgcatatwtttttaattgggcagatttaaaatttatgtattgttgagtttcaagagtcctttatatattttaggtacaagtcccttattagatatgtgatttgcaaaatttttctcattctgtgggttttctttccattcttmttaatggtttccattgaagtacacatggtttaaattttcatgtttattttttctttcgttgcttgtgcttttgatgtcatatttaggaaggctttgtccaatctaagttcaaaaagatttactcctatgttttctttttctttttttttttttgagatggagtttcgctcttgtcgcctaggctggagtgcgatggtgcgatctcggctcattgcaacctcggcctcccaggttcaagcaattctcctgcctcagcctcccgagtagctgggattataggtgctcgccaccgtgcccagctaatttttgtatttttagtagagacggggtttcgccatgttggccaggctggtctcaaactcctgacctcaggtgatccacccacctcagcctcccaaagtcctgggattacaggcaygagccaccatgcctggcctgttactcctatattttcttctaagagttttatagttttacctcttaaatttagctctttgatccattttgagttaaattttgtgtctgttgagaggaaggggtccagcttgatttgtttgtgtgtggatattcagttgtcccagtatcatttgttgaaaagactrtttgttccccagtgaattttcttgcccttgtggtcaaaattcccttgactgaaaggtaagggtttctttcaacaatattttgtagttttcagagtataagttttgcatttcttttgttaaatttattcctaagtattttaccttttttgatacttttgtaaatggaattttcttaaagaggcagtggcrtgattagacttttatttcaggaatatactctgacatttttgtggaggatggtttggaggaaagtctrgtaaaacatacactaagattaattattctgtcaatgatgataaaaggccagaactagggttgtaaaatgaaaggtaatgaataaatttgggtaatatctaggatgtagaatgtaaaaaacgtgatgatttggatattataatgagagtgaaatctcttgatgtaaattccaggtttctggcttagatagttttgccagccatttgctgacataggaacaggaaaaggagttaattgggttttctttcttttttcttagtttgtcttaaaggtttgctgattttatcttttcaaagaaccaacttttcattttgttatcttttgtatttttttcatttcatttattttggctctgatctttattattttctactaatttggggtttggtttgctcttgcttttctggttgagatgcactgttaggttgtttatttgatgttttcctgcttttttgatgtaggcacttactgctaaaaactttccctttaagtattgcttttgctgtgtctcacaggttttatatattgtctttgcatttttatttctatcaagaaatttttatatttacttcttaatttcttcattgacccactggtcattcaagagcatgtggtttaatttccatgtgtttgtatacacagtctccaaagttcctcatagtactgatttctagttttattccactgtggtcagagaagatacttgatatgatttcaattgttttttgaattttttaagccttgttttgtggcctacccatgatctatccttgtgaatgatcgatttgctgaggagaagaatgtgtattctgcagttgttggatgaaatgttctgtgaatatttgttaggtctgtttggcctgtagtccagattaagtctgatgtttgttgtttatctgtctggatgatctattcagtgctgaaggtggggtgttgaagtctccagccatgattgtattggggtctgtctccttagctctaataatatttcctttatatatctgagtgctccggtattgggtgcatatgtaattgttacatcctcttgctgaattracccctttatcattatctaatgaccttctttgcctctttttatagtttttgtcttgaaatctattttactgatgtaaatatcactatgctcttttttggtttccatttgcatggaatatctttttccatcccttcattttcagtctctktgtggctttataggtgaagtgtgtttattttaggcagcagatcgttggttctttttttaaatccattcagccacttaygcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttgcagrtcatatcttataaccgattattttaaactgatgacaactgattccacaracgagcagagaaaactaataaaaactctacactttatcctccttgctttttaacttttgtgagttttgtaccttcatgtaattgcttactgctcgttaaggtccttttcttttagattgaagaactcacttcggcatttcttgtgggaaagtttggtgttgatgaagtccctcggcttttgtttgtctgggaaagtctttatttctccttcatgtttgaaggatattttcactggatatactattgtagcataaaagttcttttccttcrgcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgtttggattaaatcaatcaccaatccttgcttggtgttctgtagcyttcttgtgcttgaatattgatatctttctctagatttgggaagttctctgttattttttcttcaaataaactttctaccctcatctttctctatctccttttaaaggccaagaacttagatttgctcttttgaaattattttctagatcttgtaggtgtgcctcattcttgattattcttttttcttttgtctcctctgtgtattttcaaatagcctgttttcaagcttactaattctttcttctgcttgatcagttctactgttgagattctgccatgttcttcagtaagttaattgaattttttatctccagaatttctgcttgattcttttaaattatttcagttgttttgttaaacttacctgatagcattctgagttccttctctgtgttgtcttgaattttgttgagcttctccaaaacagctattttgaattctctgaaagctcacatctctgttactctgggattggtcactggtgccttatttattattgttaatttagtgagttcatgttttcctggatggttttgatgastgtggatgttcaccaatgtctgggcattgatgagttaggtatttattgtggtcttcggagtctgggcttgtttgtacccatcyttcttgggaacgcttttgaagtattcaaagggaagtgagtgttgtgatctaagtctttggtcatagcagccgtatctgtattaaggggcaccccaagtccagtaacattgtgacccttgcagacttgtagaggtaccgccttggtggtcttgggtaatatctgggagaattccctggattatcaggaaaagaactcttggttctcttcccttactttcccccaaacagagtctgtccttctttgttgagctgcctggagctgtgggggacgggtgacacaggtatgcctgtggccaccatgactggcgtgtgctgagtcagacctgaagccagtacagcactgggtattggtgaaaggcttgtggtgatgactgcctggtcaccgctgatgttccctcaagactcaagagctctacagtcagcacaaatccagccaggcttgtgcccttcccttgagggcagtgagctcctgggggcccaggactggtccagaaatgctgtctgggagccagggcctggagttgggaaacttaggaatctacttggtgctctattctactgcagctgagctggcacccaaaccttaagacatattccttcccactcttccctctcctttcctcaagcagaaggagcctctccccatggccaccagtgctccaggcctgcagtgagtactgcctggctgctgctggtgttcactcaaggctccagggctcttcagtcagctggtggtgaatgctgccagacctgggtctctcccttcagtacaatgggctcccctctcacccaggacggatccaaaaatgctgtccaggtgccaagacctagaatcagggaccccaggaacccacttggtgctctgtctcactggccaagctggtacccaggctgacttttggttcttatgaaggtgctttcctgtgtgggagggggatgatcgccagaggacttgctttgtatacctggatacctgtagattctttttattttcttcatattttaaggaggccttacaaatgtattgacattattggacttgtcattaggtttgtatatgagcttcatgagggcagaggccacactcttgttattaccatatccccagtgcctggccacctattaggtacccaacattgattcaaacaactcttgaatttttgcctcagcaaattttaatcatgatttgttttcatgtattttcacatttttcttattattagcttacatcagtaatctttatacattgagttatcctttttgttttgtctcaagggatgctctaaaataaaatcttcattacctctcttcataggtgttcttcttttgggagacgcatataatatgaggcatccacttactggtggaggaatgactgttgcttttaaagatataaaactatggagaaaactgctaaagggtatccctgacctttatgatgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaagktgaytttttattttttttgtaaatgataaacataaggcaatattacttgcagatagtccttagaaggataagtatcagtttgaggggaytataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtaggaaaggaataaacaagttagtgatttgtccagaaataaaaatgttacctgagtttgctaactcccaagttggtagttttttaaaattccattttgagcaatagttgtagttktagttttagtttggaaggtagtggaatttccttagacaacattaatagcaatgcctcagtaacatattcattattttgaattcctctggtgcagactagatcatgcttgtcctcacacacacaagactgtgatggaaggtgtttttggccatgtattaaaaggcaatgtagtctttttcttcctaacactagtttcaatttctttttaaagtagtattttataaaatgaatacaagctgttaatcttgtccctgttgaaaagcacaagtaacaatgcattcaccctttacttatttggattattttggtgcttttgttactgtttccatattatacagaggtcacggtcaatgtatatattagagaaaacacaacttagcagaagcagtgttagaaatggaggaaaagaggccaggcgaaatgattcatgcctgtaatcccagcacttcaggaggccaaggcaggaggatcgcttaaagccaggagtttcacaccaacctggacaataaagcaagaccccatctctacaaaaaattaaaagatcagcaaggcatggtggcgtgtgcctgtagtcccagctatttgggactatatagctcactacagtgagctatatatagtgagctatatgaagtgccactgcactcagcctgggcaacagagtgagacttcatcttctaaaacaaacaaacaaaaaattaaaagaaatggaggagaaaaggcaactgtgccacctcctcaccacagcagtgtacacatcagtttaatagtaggttaatgaaactaggcttttcagttttcaagaataaatactgactcatatgccactactctagtatatttgcaacatagctatttgtatgatctggctgaggccctagtgataagtgctgtggttataattacaaaagatgatacaataaaaatgctttctgtagcctctataaccattaactcttcctaaggaaaaaaaacaaaacaaaaaccccaccaatctcactggttatgatttttccaaacaaatttctcttgctaaattggcatagaagttaaaatggctggttgggcaaatgaaagtaactaagtttagagttttgggcaaataaaaagaactaagtttagagttttgggcaaataaaaagaactaaatttaagagtttttctgagctcttctttctaagcttttctaacttcttgagttcttaacattatgaatttaaatctaccaacaaaacaacattttttaaaagttacaagattggaggaggaaagacctttattggagcaaaagtttacctgttgcatcctttactttttaaaatctgttgtaaagaaaaatctgggcatacctgaacagaacattgattctaaatggttaaaaaggttatcaattgattacactacattgtgagggttttatgagttactttgaaaggtattaaaaactttatagatataaggaattattatttatcgctactcacagctctcttcacttgataatttactgcttagttagagatactggttggacatcttagagactrggaatttggtttctagaattgtgttaaaaagagcttccaaagtattttgcatcacttaatgaattaacagcaaaatcaaggaagtaccttttaaacaactcttccaagacctaaatattagtagttwtttactaacagaaaaaagtttattcatatttatattactctccataatgctgattatggaattcagaagaaatcctggttgttgaaattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtccygttgggctgctttctgtgtaagttgtgatggcacagaggatacaaacctgccagattttcttaggactgttcagttgatgaattactgcaaatctttcytccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacrgggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactgrtatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaaggggggtggggggtttgctcctgccatcaaacttaacatgcagacatatttgtgacgtcctctaaaatgtagaatgtttcatacagaattatgatgcttgggtaaaaaaaagtaggatgtttgttgagcttcgtagattatatgtaattggaacctttggagtaaattttagtttctgagtcttaccaatatgtatttttttctattacagattgtctcctaaccctctagttttaattggacacttctttgctgttgcaatctatgcygtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcartttaaaatgaaggggttaaataagttagacatttraaagaaatgattgttaccataaattagtgctaatgctgaggagaactacastttttcttttgaatttagtatttgagatgagttgttgggacatgcaaataaaatgaagaatgaactttcgtgtctttttgtttcttgttgtgggctcgtttacatagcttcatgataatgaraaagaaaaccaaagtgggatgaaaagtgcagagggaaacctgttctattaaataactggggaagttgccttaatgtcttgaccttgatttcctcatctatccagtgaagcaatttgataaggttattttctttaaaaaaaattacttatttatttatttattttattttggggctgtgactcagatttgaaccgaaaggttctttgctgagttctctgaaaatatcagattctgacaggaaaggcaatcaagggctttataagttccactgtatagcaacatttataaggcagcccaggatgacatcaagaaacagtgagtgaacaartaagcacttgtaatacccggcataataccttaaaatccgttaggatttactgagtttatctatagtaaatttgaagagactatggatgttcaaagggtatcatcataaaagttcagtaaatctccaaataccatgaaagtaaattgttacttctgaaagagcagtaaaatataacctggcaaatgaagttactacttgagattctaacagggctaaaatataacttacaaagcttttacaataaaaatttcaatttttaagttttttcagttgaaaaaaattcttcactggccaaatcactagcaaaatcagtttcaaacatcactgccttgttttagtagagcatatggtggacccatttgcttggtttcgtaagattcccatctaactgaccctaaacttctattttctggttaaaaactcactttcccagatctggccttcttagcagttagttagctttctttttcgagaacaaagatctcacttcatgtggttattgttaacaagattacaaatgaaaaataacacgctatcgttgagatatagatgttcccacacaccgtctttgcagggggtgagacttccaagctccctacgtaccaagcaacagttctcttaaaattctgccctggcctcggtgccctcatggccaggattcgaggttacccttgttcgccactgagactcctttaaagtcctttctactatgatagtgaaataatcaaagcctgtaaagtcttttcttcccttcaatatcagaatttgaggccttctgacaaaagaaataaaatgagaaaaccgaaggaacctgagaaatcctttagtcctaattttacagatgatgccagtaggctggcttgggacaaggtgtagcttgtggcagaaccaggactcaaacttaccctcctgattgcaaatcagtacatcttcccccaccactagcaaaatgactgtcaaacagattttggcttctgggtttggtttggtttgttccttcctctccagagaaggacataaccatagagatttagggtggaaacatctttcttgctctcatccaagttgttgatacccaagttgccacagtaggatggcagtgatatggtgtggctctgtgtccccacccatatttcttcatagcagtgtgagaacagactaatagtggcagcttccttttcagggtaattttcatgcagaaatgatttaggatttcgagggagttaagcttatgggaaggctattaccaaaaaggactctggataatgatacggttgtggggacttggggcaggactcaggttgctgaggaagataccggaaggagcagctttgttaaggagtcctacagaaggaatgctgtggaccccctagggcatgtgggattggaagaggatgatgagacaccaagaaacttcaatggcacatgacacagattgtgtggccactacatttgctactagtctggctatcaccacgtgcctgccagcttgttgggggtgagctattatacctagcagagtcatctcttattccaaacagggttttttacagggtgaatacacagtttttgaatcataagcgagacgactttgggtactagtaatactattttactgaaaatctggagttgcacaaatagttctttagaacataaaactaaatggatttatacataacagttacattcagcatttaagagaggcagtacaaaaatgtgttctgcttttatctgatataaattgcatgtaataccatgatttaaacaatatcagttatattaactaatgccatgagatatatcttactcagaacgtctgatgtttcccataatagacagaaaaaatgcagttgtatgagcaactgagtttcttttcatcttcaaattcatttgtgatggtgggaagrtctaaggacaatccttccattgaagaagtaggaaaaacagttacagcactgttctgaactcatcaaaaatgaaattaggcacatgtgcttcagcaacctgaaaaattaaagaattaaattattcatggtgttatagttgaacaattacaaaattttcatacgtaaaagaaaagatatccttggagcaaggtgaataatagaagaggagactcccatgggcggacgactccttgaaacagcccctttctgcttgtggtgccccctagactagcgtctcatttcttggcactgctaacatttgaggggatgcagtacagctctcccgcctccaaatctgagcttcttggctcttaaaggtaccttgatctgcgaggaatgttcttgcctctgggaagtactgacaagtactcaggtcacctaatacacttcattaactgatgaccaacaaggaagaacaggatggctggcaagtgatggggttggagaggtaggggagggcaggaatgagaatgagataccaaggccagaaggggaagagcaggaaggccttcagaggcatgcattcctgaactgttcttgggcaaagccctgagaagactaaattgggctcagttgggtagaatgtagaggtaggtgatctccaagtgctggagatgagtattttttagaagcagtgtttaattttttttctgatcataaaggtataacctgctaatgagaggaaatttagcaaatgcagaagagtataaaaattatttttacagtgggtggagggcaaggggagggagagcattagtataaatacctaatacatgtgaggcttaaaacctaggctgggcgtggtggctcacgcctgtaatcctggcactttgggaggctgaggtgggtggatcatgaggtcaggagttcaagaccagcctgactaacatggagaaatcccatctctactgaaaataaaaaaatcagcagggcgtggtggtacgcatctgtaatcacagctactcaggaggctgaggcaggagaatcacttgaaccagggaggcggaggctgtagtgagcccagatctcactactgcactccagcctggcgacagatggcacatgtataatacctatgtaacaaacctgcacattctgcacgtgtagcccagagcttaaaatttaaaaaaatatttttttaatcttaatcccttaaagaaaataaaaactggcaacttttgtaatgaatttttccagtttacttacatatgcagacagacacacacacacacacacacacacaatcaaaattaggatcacataatattgtgtccttctctacctctgctaaatcttatattatgaacatccttgggcacatatcttggtaaacctttgcacatatatccagcaggtaaaattcctagcagtggaattgctgggatcagggtaagtatattacaaatgtttttttaaaatagataaagctaaattgccctcctcaaaggctgtcaatttacattccaattaatagcacttacaagtcccatttctccaaatgcttccgaataatgggggcccaacattttacctttcaccaacctgataagtggaaacagtaattttcgtatttggatttttgtcccttgaatccgaaggtttgtcatttctattttcttgaaaactgcctcttaatttcctttgcccttcccctgctttttttctattggcttggacatctttttcatactgaacttgaagatttgaagagcacactataaatcaagaaactagtcctttgttggtatttcctcttttgtcttttgttttttaactgagacactgacacagaattaattacattcagcatttataaaaaatcaagtctctaaatctttttctttatagtttcttcttttggttttatacttaggaatttctgagagctgatacatatttgcctaaaatttcggctaatttatttgtttcatatttcacactaaccctttatctgtaattaattttgataacataggagatgtaaaggggactaagttgctatttttttaactgtgtgaacttacatctattgactaatattccctttctctcttaatttgagatgctacttttccttatgtaccattgtatgcacagggtgtgtttctaggctacatattcttgctcattgttccttctatttagttgcataccagtagcaccctattttggtttctacagttttacagtgttttaatacttgatataatattttaatatcttttttttaaaaaaggacttgcctaagtcctatgacattttaaaaaatatattctttgaagttaaaaaagtacctgaaatcttgattgtaactgcagtaaacctataaactagatagaactattatctctgtaatattcgaggaccctcattcagaaacatggactttcaaattttatatttaaaatttttatagttttttaataaagtgttctttcatatttcttatagaggttattcttagctatatcattgccttgttatttctgtgaataggtcctttttcacactgtattttttaatcgattgatgtatttcatacatttattctgtagccagcttgttttctgatctctgtattattttgatagtttttcacatgattctattgggtattcaaggaagacagttatgcagcaatcccactactgggtaactacccagaggaaaagaagtcattattcaaaaaagatacctgcacatgcatgtttacagcagtacaatttacaattgcaaaatcgtggaaccaacctaagtgtccatcaatcaatgagtggataaagaaattgtgatatatacatacgatggaatgctacgcagccataaaaaagaatgaattaacagcatttgcagtgacccggatgagactggagattattcttacaagtgaartaactcaggaatggaaaaccaaacatcgtatattcctactgatatgtgggagctaagctatgaggacgcaaaggcataagaattatacaatggactttggggacttggagggaagaatgggaggggagtgaggataaaatactacaaatatggtgcagtgtatactgctcaggtgatgggtgcatcaaaatctcacaaatcaccactaaagaacttactcatgtaaccaaataccacctgtatcccaataacttatggaaaaatagaataaaaaaggaagacaattaatctcaaataatacagagtttgtcttctttccaatatgcattttattttcatttcatttcttattgtcttgcacctgtataacaaaagtagttgcaagagtctgtatagttgtcatgacactgtgacagtcctggctttaatgggaatgccactaacatttcactattatgtactgacattgctagttaattttaaaagttcatctttggctcatgttgtaagaaagtatctttgattcctaacctactaatttctaaaaatcaaatgattttcagtatctgctgaaagttgtatttttcagtatcaagctctccactttgagctaaaatttaacaaagtggaattactaatgagaaagggataggaaagaatgtcttggcaggtaaaaagtagtctgccatttttggaaacagtgctcatatatacatttagttgtggcatgaacttaactgtgcttgctgtgggaaccaggtcagtggagagagaaagaacaaaccaccatgattatttctttcctctggccacttaaggaatcyctcctggcttgcctatttcacttaactcctgaaccagatgagttgctgacaggagtacatggtggagaggaagaagaggcgggaggggcattgtgttaaactctgcaaggcaattcccatggtggaaaaggcaaggacatttcagagctgggggtagagcagtggcgagaggcgcagaggcatctactgtgaacgacctattgggcttcactcctgatgaatccagggccactattattagcatctttttacaactattaatattgttctttactatctatcacttaccctcctgggtagctttgtgtaccgaacataatcctccaggaacagaagggcacccacaacatctgcaggaatttcaggtatcttctggctgtgatagagaacagtttagatcaattaactgctttgcacatcataagcccttttggtcagaatcctgaaagactaaattaccaacagattacctaatgaagtcaaagatgaacaaaaacattgagcatgctcttaattcctgtcaagttgttaccttgctcatgtattttcaggagcccaccccatagggtaaatgtgagcttctctatacggtttccatgggcgtttacaacacgatccctgctatctatccagactcatctycctctgtttacatgattcaatacctagcaggtcccatactttcccatccctgcacacttttttttttttttttttgcgacagacttttcactcttgtagccaggctggagtgcagtggtatgatctcggctcactgcaacctccgcctcccgggttcaagtgattctccagcctcagcctcccgactggctgggattacagatgcacgccagcatgcctggctaattttttgtatttttagtagagacggggtttcaccatgttggccaggctggtcttgaactcctgacctcaggtgatccacccgccctggcctcccaaagtgttgggattacaggcgtgagccaccgcacctggcctgcacactgatttgaaagtaaacttctagacattgttcgagtctcagcttgggtacttctcctgtggaatcctccctgattctcctgggctgtcataatagttagcagcattctccaagcctcttaatttttcaatggtgtgctgggttcccatcaggagtataaactcctcgagggcctaggtcatatgttcatctttgtttctccagcatctggaaatgtgcttggcatgtactgcatatttgasggtatcaaataaatacagcatctagcaatttttcatatgggattttactcatgtattcattcattcagcaactacagtgccaagcactgttccagagctgggaatacagcaaagtacatgccaggctccttatagagctaacgttccttcttgtttacatcaaaaggagtttttaggtgttaaaacgatttccaattcctrtaccaattgrcattttctrattaacaaataacttttagtactattaatacattactggttaatttcgctgatgaactttgctttttgaatgggttaagaatgactgtacctggaaaaattctccctgctctcaatctttcaatctgtgaccagggctatatttgctctgcttggagcaagagaaaggaaggaattcccatgcgtcacaggttccttagattcctttgctctgctgaatcagaaagcctgacttacagctggtctcctgtagcctgatcaccaccctcagggttgccaataacatgctggactagagccacacttaagcctttactgccattagtgaaaaagaaagagaggaagaagaacctgtccaagttgacagctagggagctacaattgggacagccagttgtgtggaggttacttgctaatcacctccgcaccacctgaactggagtccttcccctcctctctgggagcctgggccagaggcgctgggtttttatgagcctactgctttccttgccaactgacctcacttcgtgattgttacaatttcatttttgagactttgagttctcctctatttttcaattgttaaaaaatcttgtttctgaagcaagtcttaacatctatcccaggaaaacaccagtgtttgttgttcgattcattaactaagaggaggaggagctggcctgactgcagctcacgggaaataacgacattggggtttagaaagaatgcaaaatcagtaggagccactggtatgcactggatgtcaagaaacccatcactgcaaagccgagatcacgccactgcactccaacctgggsgacagagcgactctttctcataaaaaaaaaaaaaaaaaaaaaaaaaaggactcatcactgcaattgtagctgctgtactgtccacagagggcccagaatgaagacgtgtaatactcctctgtgccaaggggagggctgtgcttggaatctcaatacaagtttgggaagccacattttaagatggtcaaaaacagactggaacacccagaaaaagtcactcactatggtgagcagcctctaaactgcaagacatcgggaacaggtggaaggggcttatctaaacattgagaagacctaagacaacagatggcatacaaaatcggaagtgatgttgcaaaggagggagactgcattattctgtatgatttcaaaaggtaggaaaaagctcagcgagtgaaacatccagagacacaggttctaataatcacaatcaggaactttctaatgagaacaagacttagccagyggactgtgctgcctggagaggtagcacaagccccctcggtgagagtgttccagcagtggctgcatgactacctgtcaaggatgtcctagagctcattcatgcacttagtgggaggtcaattaaatgacctcgaaaatcatttccagttttaggacttagtagtattttgtgtggacttagaagatcactttggttcgttttattttttttgagatggagtctcgctctgtcacccaggctggagtgcagtggcatgatctcagctcactgcacctctgaggcctcctgggttcaagcaatcctcctgcctcagcctcctgagtagctgggattacaggtggccaccactacatgtggttaatttttgtgtttttttagtagagatggggtttcaccatgttggccaggctggtcctgaactcctgacctcaagtaatctacccaaagtgttgggattacaggcttgagccactgtgcccagccgctttgattcgttttttacattatagtggcaaaaatgaccaagcaaacatgacagcaaaggttatktagccaggctgaccctttaggatagcagagaaggaggcacaggacccagcatctcatggaaataacttttttttctttatcccagaaaagccacatttaggggcaggggaaaagaactggcaggaattaaagttttataagcattgtatcaaatagcaactcttgtgaaatttgcttctctacatgcagacactgcccaggctttgacacactgatatgttctctgactcccactgaagtgagtggaatcatctcttggcagtggcccagcaggagtgcaggggctcgctgagattgaagagctgcatccaagagtgcagaggaacagggctgcactttcttccccatggtagttactattcatggtcctgagtcactcctggaaaatcamtgtgagtagaccggatggagttcccctggcagggtgactaaggatggacacacctgtaattgctctaaacaaggaggtatgccctgacttgctttacagagaagggtgagcaaccatttcccatctctattagggcgataagaggaatttggtaatgtgaggtttaagttaggttttgtgacaagaagtcccacgtagtcctgrttggtcttctgtaccttgtacactgctccaccgtggagcagataaactggccaatcagcgccaggaactgctcggtgtaccgggaatggaactgcttcagcagagtgagcagtcccaggacaagtggtggccaatcaaccgggtcggtcggttttcggcagaccattcctgcaagggaacaagttgcaacaccatatgaagtacttgccttcagcaacattcattaaataccaacgctgtgaaggtcaaaatgtttggggcccatattctcgctggcagatgatattttggagggaatgacaattctgggccatattttgaattagccacaggattggtagggcattccaggggtctgaaggattcaaaaccaataaaacggttactaaattttgtaattatcattactggttcttttgaattactcaattaacatatattattgtagcaatttttaaagatacagataaatgtaaatgagaaaaaaaatcactacaactgacttctgttaacggcagcatgacatactagataccctgaactactatcttaagtgaaaagctggataaaatacttttagggtatctttaaacaaatgttgagtaatatatatacataaagaatctgcagaaatcaagagagtggaagaaggatatttatgaagtgaatgagtatcaaagctggcctttacactaacgattttttaaaaattggagatggggtcttgctatgttgcccaggctggagtgcagtggctattcgcaggtgcaatcacagcacattatagccttgaattccagggctcaagctgggactataggtgtgtaccactgcacctggctctacactaaagatttctgccaaaatgtggagaccctgacctctgcctgggtggctgcatgggaaaccagagacagagattagggtcttccagaagaaacacaatgttgaaaaagaacagtgttgggaaggtttaggttgcctgatttcaagctctctatacagtttcaataattaagacactatggcataagaacagacaaatagatcaatggaacagaatagagtctagagatagtcccacccttctatgagtaattgaatagtcacaaatataccaaataataaaaaaagataaatcttttaacaaatggtactgaaactggatagtcttatgggggaacgacaaaccttgacccctatctcatactgtacacaaaaaacaattagagatgaaccactggcctcaatgtaaaagcaaagactacagaactgtaagaaaaaatatcgaagatatctttgtgaccttgaagaaggcagagatttcttttttttttttttgagacggagctcactatgtcacctaggctggagggcagtggcacaatctcggctcactgcaacctctgcctcccaggttctagcgattctcctgcctcagcctcccaagtagctgggattacaggcgtgtgccaccacgtctggctaatttttgtgtttttagtagagacgggtttcactatgttgaccaggctggtctcaaactcctgacctcaggtgatcctctcgtctcagcctcccaaaatgctgggattacaggcatgggccactgtgcctggcctggcagagatttcttagacaagacaaaaaagaataattataaaggaaaaaaatggataaactggacaccatcaacagtaaaaacttctgctcattaaagttaccagtaaaaaaatacatagataagtcacaatattctcaaaacatatctaataaggaacttgtatccataatatatacataactactacaactctgtaataaaaaaaaaatttaaaaacgagcataagactagaacaggcacttcgcagagaaggatataaggaatggccaataagcacatgaaaaagtgctcaaaatcattaatcatcagggaggcaaattaaagctgcaacaagataccatagatacccatcaggatggctaaaatgggctgggttcagtggcttatgcctgtaatcttggcactttgggaggccaaggtgggtggaacacttgaggtcaggagttcgagaccagcctggccaacatggtgaaacctgtctctactaacaatacaaaaattacccgagcatggtgatgcatgcttgtagcctgtaattccagctactcaggtggccgaggcagaactgcttgaacccaggaggtggaggttgcagtgggccgagattacgctactgcacttcagcctgggtgacagagtgagactctgtttcagaaaaaawaaaagaatggctaaaatgaaaatgactgacgccaccaaataatggcgaggatgtggactacacatatactcactcttggtgagagtgtaactggcacaaccactttggacaaagggttggcagtttcttatcaagttaactggttagacagaccctcaggtcccatatttgacttcttgtgaagaccggaaaatcttccccaaaccagagaagcctaaacaagtgatcctgaataacctaacctaggccttggcaattcagaacatggaggaagaatcctaacaggactcagtwtggagaaataatcctttccaggtggaaagcaagagtgatgttaacaacaaacacttctacaactagcactacaccacgaagcttctttcttcaaacacagaccaagccaggtatgcatttcataggccaatgctgagaacggtgtttacaaggttaaataaatgtttttcggatatacagtttcaaggctctctttacagtttcaataatcaagacattattggcataagaaaagacaaacacatcaatggaacagaatagtctagagatagtctcacccttatatgagcaactgaatacccacaaagataccaaacaattgttccttcctcagtcctactgtaatttagttcctgcattaacacatcagtcttattgatgagaagaattatagtcagttataaacaccacatttctaggatacataaagattttgttgtgttatgttttaagatctgggaattccagggagagtgatactttccataagcagctttacaatcaaggtgccaggccctaatcatatacacaatgaaaaaaaaattagaatgagaagtcaacaaaaagttattctttaatgaaaagaaggttctttctgcactgacagttcattatcaagaatcatatattcctattgaataataacatagaacagagagagaacatgaatctctgaatcttcagatgaacctttacattacacttgggatggccctttaaattgattttgaccaatatatagaaagggactcagcacctgttgggcactcagtttgcggtgacttggccaaagtcacataggtgataaktggtgaarccagattccaaacacacattggttccctccctcctacagcaagtattgtttgaggagatcatgctctgccttctgtgacaatcacaggcattgtcatggaagcagtgtctagaatcaatgattacttttgaatgagagaataaaaacattaaagagattccacattttcaccctaaaaaagcttatgaaataggaaagtactgtaaggaagaaatatatttaggaatctctagttaagaaacaatgattacatttgtagaaatgctcttataatgcttttaaagtaaactaaagtctatagtggatttttaaaaatgtcatttagctggatacaaagtttgaaggcagaggaaacactttgttatctattatgtaactacaaaaatattctgacgaatgacaaaaataaattagggttataktcctggagagaacagacatattgaaaggctttggtgtctcttgtttgtacagaatattctgacatacaatcatacataaagtattaaatgttcatgtataaatattagtcttatctccttaactatattgttacttttcccatcatggttccagatacacagctggcacatgcatcctgttgaaagaacagaacatcaaccaaaaaaagtttctttcacaccacaattagctgcctaaacattaaagaagagaatcaaaacaaaggtccctcacattctacaagctggacaatgaacccttactgaggtagaccatactttgttgattttaaatccactgtctagggctgggcacaatggctcacgcctgtaatctcagccctttagkwgccgaggcaggtggatcgcttgagccyaggagtttgaaaccagtctsggcaacatggcaaaaccctgttgctacaaaaaatacaaaaaaattagctgggcatggcggtgtgcacctatagtcccagctactcaggaggctgaggtggaaggattcttgagcacgagaggtcaaggccatagtgagctgagattgtgccactgtactcccatctgagtgactgagtgagaccttgtctcaaaaaataaataaaataaaataaataaataagtgtacttaaaaaaaaaataaatccggccaggtgtggtggctcatacctgtaatcccagcacttagggaggccaaggtgggcggatcacctgaggtcaggagttcgagaccagcctggttaacatggtgaaaactctgtctctactaaaaatacaaaaatattagatgggcgtggtagtacgtgcctgtaatcccagctacctgggaggctgaggcaggagaatcgcttgaacctgcgaggcagagrctgcagtgagctgagaccacgccatcgcgctccagcctgggcaataagaacaaaactccatctcaaaaataaataaataaataaataaaaataagaataaacccactgtctacagttcataaaaaggcattgtatttcaaaggcataaagactcgaatttcataaacataaatttaactaagaaaagatctcatatccgacataggcattctatacaaaaagctytttagttaaatgttaatctgttggtaytgttactcattgcaaataataaatgttatacgtacccagatttttgttgtattgaagttttggcaactgagcgatcaaaaatagaaagtttacaattggaaaatagggtaagcgctttgttgttatgtatatctggaaagagaaaggtaagaaaaatagatggttaaatcacattgcacaataccacagaacaggtttccaaatgaaaatcttccattttacttcaatttgctctttggctttcctgaaatgtggatggttccattaatttgctgccttcagagttttatttaacacacctggccctggccacataaatacctgtatcataatttgcccttctgggaagaaaacaattttgcttagaaagacttttcccctgaatcctgttaatgtcattaataaagggagggaggaatgagtgatgagcaagaatgggaggggaaggcaaaatgaagagcagttgaggaagagctggaggtgaatatagggggagtgtgggagagagaagagagagagagggaaagagggaagaaggagaggaggagggagagtgaagggaaaagatccatgtagcagcgagtggtggtatctaagtagaaagagagcaaagttcttcttgtcatttgctgtcccctaggcaatgtcacagagcagtctcccagatgtcacggcagaaactacagtcagggcgtacatggccaggtccagactgccagctggccgattccataggagacagggtagcacacgggtcagaagcaggggctctggtcagactgcctggctcctccacttgctagctggcctctctgagcctcgggttcctcaactcataatggcgtatttcatagggcttgttgtgagatgaagtgagataatccacaatcagggttaagacagtgcacttgttatgcagtaaatattcaagacattagctactattcaggtttataatcttttatccaaaacacaagggataatacagctttcagaatttcaaattttacagatttagaaagataatataggggctggcgtaatgcactataatcaaagttactataatcaaagtctgcatcaaaatatatgaatgtttacagtaaggaggataaataactagtataaacagccttatgtcagctcaggacagattttgccatgcaaagagatctggcaccgagttatgaaaaaactttcagttcttagaggttttctgagctcacaactgcagggaagagtttgtagcttctatgatgagtgggattactgtcagccacaaggggaagcacctttggcaagacagatcaatgctaccattttgggtttgttgggccttgatgactgaacggcaaaccccagtgaaacccaaaactaatctcttacacggaggcagcaccttcccctttgtcatgagctttcaccagcgctatagyacttgattctcacagacctgagccaggcggggaaagtgtgatgattgcttagaaagggcagggaactgaatggaatgaaggctctggggtctgaacccaggttcctctggtatttctgcacagtaatctgttacctgggccaaataccattctgtacccccatccccgccattatatattttaattactcaccttattcagtgggttgtgaatgccagctgcctccagataggctgtgatttcatataaaagtgtgttatcttctttggggtaaggaagtgaagggtcctgatagtgggcttcaatgtctgctaggagagccctaaaggaagaaaaaccctggagataaacattagtgagtaaatgaatttatacaagagttaatatagggcagtgatgtaatcttttcaagcctcagtttcctcatctgtaaaatgagagcttgatctcgctaattctcaaccatgcctgtgattggttttaagtggaaaatttgacctagaattacttcatcttttggaatcaacctcaatcaaatgcattcaccattcaaattttcatgtattgactgaactgttcttaatacctgctttgtcaaaagcactgacttggtgagtgagmagcacagattatttatctgtaagtaggcagcctcaaatgacagcaggttgctggtgaggcggaggatatgagttccctctaggacaggcctccataaccactcttggtaatcaacacacttccaactgccctctggatgatgagtgatcagccctgtaaaaagccagttgcggattttggtaataattgctttctaaaatctgtgcaagtatctagcagtgtctggtgtgtctctcactcgctctctctaatgaattcatttgttcagcagacatgtattgaatcmtgtgatcagtacctgtctgctgaatacacgaatccattagagagagtgagtgagagacagagataaacggagggacaatactgaggaaagaggctccgaagacagatttgattatccgtggcaaggaagcctgtaaattcagaccttccacccaaaaataacttaaaagagtaagaactgaagaaactggggtgcgtagataataaacaatcyaagcccacggatggctgtttcaaaccctggcacttacttattgagattctccagagcagctgccagatgtttagaatcaaaccgacaagaataatttaattcattggcaatctgttgtctcagaatctgcatctgcccaacctgtgcacaagcaagagaaagaacaggtagtgcattcaagcatttcagagtgacagtgaggaggtaaacacaaagatgacaattcttcactgggccttcacatcactctacaggaaaaaaaataaggatttcctgaactgatctcttggctaagaccagcactggatctaatgaagcaccagaggcccttcaaggaatgtctggatggaytcccataccccaacctaaaaataccccaaagtctatgattcacaaagtgatctattaatgttcagttgttcatgtatcaaagatgtcttttttgaagctatatttttaaccttttggaataagtgctccaaatttagyagctgctgtgagaagtcttacttacttccttttatttatcctaaatggaactttctcaagctctaggaatgccatttcacactagtattctcaaattgggtgaatattaagtctgtccatgccactcaggattataggttctataattatctggattacaaaataatctacataaaatctttcacgaaaattttaacaatgatagccccttaatccagggttcttaattttttttgtgtgtctgatatggtttggctgtgcccccacccaaatttcatcttgaattgtagttcccataatccccatgtgtcrtgggagggacccagtgggaggtaattgaattatgggggtggttacctccatactgttctcgtaatagtggatgagttctcacgagatctgatggttttataagaggcttttctccttttgattatatttctctttcctgttgccaygtgaagaaggacatgtttgcttccacttccaccatggttgtaagtttcctgaggcctccacagccatgctgaactgtgagtcaatcgaacctctttcctttataaattacccagtcttgagtatgtctttattatgtgagaattgactaatatagccttggacccctttgggaatctggtgaagcctatggacaccatttcagaataacgtttttgaatgtacaaaataaaacatagagggtaacagtggaagccagttgtaatgaaatataattaaccattcaaagaacaaatctgtgatatagagttatgctaggatggtgtattaactacagtactttaaaagtagctatgagcataaatgatacttggagattatctgcaatggttggatgataggaagcgatctttgggtcaggcttgagagttcagtttgccctcataatgttgtctgcatcataaggtcaacagcacactctaactttttctgcctataaatgtcttcttttctactcggacaaagtattmctaaaagactggcaaaggggagtgagggaggtggggagaggagggaagacagtattataatgcaagcagcaataaggtggaaataaatgcatttcctctgagttgctgggggcagagaagagttaaggaaaagacaggggctcacgcctgcaatcccagcactttgggaggccgaggcaggctgatcgcttgaggctaggagttcgagaccaagcctggccaaaatggtaaaactctgtttctactaaaaataaaaaaattagctgggtatggtggtggacacctgtaatcccagatacttggaaggctgaggtatgagaaacacttgaacccaggaggtagaggttgcagtgagccaagattgtgccactgcactccagcccrggcgacagagtgagactgtctcaaaaaaaaaagaaaaggagggtggccttctctaagaatgagcaaaagttacttagctaaatggagcttgtaatggtcaaaagtattaaatgacctcagatgtattatttttgaccactattcatacaagactattactctatttatgtgaaaaacgtcaatccaaaaatgctatttataaataggaagtgtttgaatttatagagtagcattatttaaaaattagaatgcagcaaatccaagaaaatagtaggttctttcaggccacataaaaatgtccctgaaaccctgtatctggcccatataattctttgcttaattttctatgtgtagtatactctgtgtcaaggatcctcttgaaaatatcaatctagaactggaaatagaaataaagtcagtttaatataacttgctctcgtttactgcacaatgaatctttgttagtgacattttctatttttggtactcacgcacttcaagctttaataagctgctgaagaggctaaggagcctgggatggatgagaaacttattctacctactcatttgcctctttggagatatctggcttatcactctttctccaagatttttctagagttgcactattgagtacagcagctcctagcgatgtgtggctatttatatttaaattaatatgaaataaaattaaaaattgcatttcactgtcccacaacccacatttcatgagctcaatagctacacagggctaggagctgctgtcatcatcgaatagcacagaacatttccattgttgttccagattattaacactggctccgtgactgtacgcaccctaattcaagacaaaaagacaaatttgtcctttggggctttatttaaagatcactgactcggtcacagtcacgtggctgttactgaattactggcaactataaccaatagttggaatagctactggactgagaaccctccagtaagcaaggggaaaaccttccagtttcttggaagaatccctgtaatccccctaacgcctcctacagagttggga

SEQ ID NO: 12603 - DNA, 40000 bp, Homo sapiens
tttaaaagcattttatgaatagtatagagataacttattattattttttctagcaatgtctttgaaaactatgacagataagaaacttgagtgggtttggtgacaattatgtagcataaatacaaaatacatagtttaaatacataaatttgatgttaaagtcaaagttgcaatgaatcaataacattatgctgctaactcttgctgaaacttagaatagattttaaaatactgacttaaggctttcattggaatttcccaactgaatgatgacaaataacatacttcttccatttaatgaaattttattgaattataaaatcctttcttctggaaagcaatgattatggagtaataagtcaattatatattgagtaaaaattaaatgtgccttgcatatgtattggtttatatgccatttcattcatgacttttgatacatgattatattttatagagaatattaaatgcttttctaagttatttttatattacctgattatttcaaataaaacaattattttaaatgaaaatcacatggttgtttaataattgctaagaaaaaatatttaaaatatttgaatataacctttcattttgtcaaaacaattgcatttgttctcattatgaaatgcataaatcacattaatgtctttattaatctatgtaacaagaatacttcaatatgtttgttgtttctataaatgcatgttaatatgcatcataaacctcacatgtgtttataattgtcattcattttatgtaaattgagtattattttgagaaggaattgtgatttaccaagtatacacatgaatattgtcagtcatttaatgtgaccaaataagttcattttggccattctgtgttgaggttctaagatttctgcccttggcttctcctcctctacccctacatatcctacttgggaaatactcttactcacatatagattcccaattctttattttcaaccaagtctttctttacatacttcagatacatgtatcctaacagtattgaaaataacgaaaatatcctcaatattttacactttaaatttctcaaacagcttataattcacttttccacatttccaccagcatccacttatggtcattttgagaagtactctctagagatgactgtggttatttgccaaatattgccaattctttgctcttttagccaaatgttagacttacatcttctggatctcttatggattattgtaactacgtgactatttatgaggctgttactgatgtgaaagttccttccagatttagcatttaatttgttaagttgttttagaatttactttgtttatattttgccatcccaactgtcagtatttaagactatgcttactccaccaccctgaaaaatttttctctttatctttgattagttgagatatttgcgggctgggtgcagtggctcacgcctgtaatcccagaactttgggaggtcaaggcgggcggatcacgaggtcaggagatcgagaccttcctgtctaacacggtgaaaccctgtctgtactaaaaacataaaaaattagctgggcgtggtggcgggcgcctgtagtcccagctactatggaggctgaggcaggagaatggtgtgaacccgggaggcagaggttgcagtgagctgagatcacaccattgcacttcagcttgggccacagagcaagactccatctcaaaaaaaaaaaaaaaaaaaaagaaaagaaaaaaaaaagaaatacatttttgctgctacaagtcactaagattttgaattttttattactacagcataactcggcttacccttgaggatgtagaaattggtatacagataggcaatgcttctataaaataatcaattgcttattatttggcaagaagagcamaagctataattgaatgattgaagaatgaaatatgtataatgtagtgacaaaacctttggtaaatagtgagctacaatagtgttataagcaaataatgtagcaatgcagtaatagacaacagaagaagttaaaaaatagaatgttaccaacctttgcttgtcatgactggctacacttcacaagatactacaaggaagaaatgaacatgtgaaataattggctgtcattataaaaaggaataaaaagaaagaagccaaaatttgacaaccaggtgtgttggaaaacacaactacttcttgtctccaatgtgtaaaatatacaactaagaaggttttgagcaaaaatgtctcttagaacttacttttctgcataaataaaataaaaaatatagtagctacactcatatactcattgcagaaacgcctcagttgtctgaggtgatgtccagtaattctttcagatgaaagatttatagcttttcttcttaatactgataggcctaatacaccataattttttccaagatatgaagaagcatgtctccaaacaataagccaaaatcgcaacaaaatatccaaaagtctatttgaaattattggcacataaaactcgttaaagtttaaaagtaggaagctaagtatgtgtaagtgccaaagaatccatcaatatggattaaaatagtttgtgactttttagaatgtaaaacagcccttggatcaaccttttgggtatgaagttatttgtagaattaatttagagaataggattatcaccttgacacctgagaatatggcttaacggtaaaggagctggatgagacttctgtttgtttctcataaagagtgggaaaatgggctttgagtgtgggaaggagtgaaaatgaggtttttgatagccagaaaggaaaactctagtagtcatgtgtgctctttacatttttatttccttcccattttgaagaaaataatataattttatttctggtcctgcttgtgattatgtgggaacatttgagtagttgtggccaatgtgataaaatcacaagtgatgcataatacttccacatcagacatttgcttgacaggtcaaaccttaggaataacatccttagtaagggcactaataatatttgattgaggcttctccatcagtttcgttgctggggccttattaggacactgccgcttcccactcactactgactttcaatggacatgcaacataagaaaaaaacacaatattgttgctttatgtcattaagacttgagagtgtctacaactaaggcatgaccaagcttttggtgaatgatgcatggaagtgtgctactttggtaaattttccattccaagggggatcaactcctgaaagtcccaagaagactatgaaaattaaagcctcatgtggcattgcatgtcataaagaaaatgaactaggataacaggattcctcgtgttttgttcacagatatggtcttgtggcctattatgtccaacttgacaaatgacttttctggtattactaggaaagacagttttaggaaagtctaggacttacagactgggrtaatccagattgtgatagaataatcagtcatatcctagactagtcattgtgatttgggctctgtgtccccacccaaatctcaccttaagttgtaataattcccatgtgtcaagggtgggactaggtggagataattgaatcatagcgacagtttcccacatgctgttctcatgatagtgagtaagttctcacaagatctgatgattttataagggaactcctccatcacttggcacttctctttcctgcctccatgtgaagaaggatgtgtttgctttcccttccaccattattgtaaatttcatgaagcctccccagcaatgtggaactgtgagtccattaaaattctttccctttaaattacccagtctcgggtatttctgcatagcarcacgagatcagactaatacagtaaattggaactaaaagggtgatgtgcttctataaagatacctgaaaatgtggcagtgactttggaactgggtaacaggtaaaggatggaacagattgggggctcagaagaaaacaggaagatgtgggaaagtttggaacttcctagaggcttgttgaatggctttgrccaaaatgctgatagtgacatggacaatgaagtccaggctgatgtggtctcagatacagatgaaaaacttattgagaactagagcaaaggtgactcttgctatgcattagcagggagactggcagcagttcacccctgccatggaggtctgtgggactttgaacttgagagagatgatttagggtatctggcagaagaaatttctaagtaccaaagaattgaagagaaagcagaacataaaagtttggaaattttgcacctgaggatgcaatggaaaagaaaacctcagtttctggggataaattaaagcctgatgaagaaatttgcataacgaaagaggagctaaacgttaatcaccaaatcaatggggaaaatgactccagggcatatcacagaccttcatagcagccccttccaacataagcccagaagccttggagggaaaaatgatttcctgggccaggaccagggcccccctgctctgtgtagcagctggatatactgccctgcatctcagctgcttcagctctagctgtggctaaaaggtgccaagatacagcttgggccattgcctcagagagtgcaagccccaagccttggtgactggcgacttccacatggtgttgagcctgtgggcacacagaagacaagaattgaggtttgggaacctctgcctaaatttcagaagatgtatgtaaacacctggatgtacgggcagaattttgctgccgtcatggagcccttgtggagaacctctgctagtgcagtgcagaaggaatatgtggggatggagcccctacagattccccacactggggcactgcttggtggagctgtgagaagagggtgaccatcctccagaccctggcattgtagatccacctacagcttgaactgtgtgcctggaaaattcacagacactcaatgccagcctgtgaaagcagagggaatgggagctgtaccctgtgaagtcacaggtgtggagctgcccaaggccatggaagcccacctcttgcatgaacaatggagtcaaaagagatcattttggaacttcaaggtttaatgactgcgtattggatattgaacttgcatggggactgtatcccttttgttttgaccaatttctcccatttggaatgggtgtatttaccaattgcctgtaacccagttgtatctaggaagtgactaacttgcttttgattttacaggttgacagatgaaaaggacttgccttctctcagatgagactttgaacttgaacttttaagttaatgctggaatgatttaagaattcaagggactgtgggaagggcatgattgtgttttgaaatgtgacaacatgagacttgaaaggggccaggggtgaaatgatatggtttgtctgtgtgcccacccaaatctcactttgaattgtaataatcccaacatgtcaagggcaggaccaggtggggataattgaatcgtayggacagtttcccccatgatgttctcatgatagtgaatgagttctcacaagatcagatcattttataagggacgtccccctttgcttggcacttccttctattgaagccatgtgaagaaggatgtgtttgcttccccttcccttccaccatgattgtaagtttcctgagaccaccccagccatttggaactgtgagtcaattaaacctctttcctttataagttactgagtctcaggtatttcttcatagcagtgtgagaacagactaatacagcagsctaagatcagaggccttccatatcacaggaggaggaattatttttttcttcctaaatataatgtaaattacagaatataattatagaactggcatgggcctgagataagattaaccatttatctaaaatttatcagtaagactaagtagcctaatttttaatatatttttataagaaaataaatttaaatgactataaaagtgttccaaagctacaggcatatatatctactagaaaagtgtcctacttccctggtataaacttatggaattctagatttaaaaaaaaatctttgggagtagactaggaggaaatcatagaagtttgaccaaattaaatagcattctcactcttggcagcatggttttttgttgtagcaaaataagatagagtctgatggataaggtagcattttgcagtttcatcctttactctggttaaggaataaaatgacaagaaagtttcaatagcattgtaacaggaaagataggatcctagattattttgaaaactttgagagagcaaaaagtcagacagccttttctcacatttttgcttgaggaaacatcatatcttattaggccactgtccataatgtggaaccagttttggctaatgatcctcactaccatcgtggccattattactttaccaatgctgataaagaaaatgaacagcatgttctcttaacctgaatatattttagcctcttttcattagtagtttgtataagctcctacatgatttaaatagcatcaacagtatgattctgtgcattcatttgccatgaatttgacatgttttaaaaatattgtagatttgagatcaatttgcaggacactagaataaaactcttagctaacctgatattcttctacacaaacagatcatatttttccaagttggggaactatggaagggttgagacgtttttctgtgtagtgtctggtggacggctcagatgatggcagttaatgaagaggtgtttcctgcaagaaaggtactaacttctctacagtgccaagtttcagtgtgctatgttttcttaaataaataaatgaatagaaacatctttccaatttatagaatggtaaaattcaaaacagaaattataaaggcacactctttgtgggtattcagaattgatagtcattcaggtggtggacacagagtcctggcaaaagaaaataatttaaaactctaaagaccaaatggtgcacatgtgaaacaagcttaaacaacaaaatgaaaagtaaaaacattcactagcaaaacagtctcaagattcaagattcctttttagagaaacagaatgtttggtttagccttgaaattatttgtcttttaacragaagatgaaatataacctttgatttccaaatctcccaactatctagactgaaagttaatttgttgcactatctgagcaaatttctctgaaatgtattccacttcataaaataacattgttagaattcttaaagttaaaaatagacatgcacagtgtttacagattatatatcatgtgtatttattatacagctgtacacatcagagacactaataaaatgctaactgataatcatttgggatacccaatttttatacctaatttctacaggaaattaattctttacaaatatgtgatgaatttaatatacaggataaaaatacctcgctttttgtaggcaaagattatgtttcagtataatgaaatatactgaatatactgaaattatacatacatatatcgggctgatagagtttgaagcatgttgaatttaaatatactgaatattctgaataaatatttatatgtatttacatgtatatatcagtatactaagtatatttatatgtttatattataaatattcagttatatatatatacataaatcaggttaatacaaagtatattgaattgaaatatgctgattgaaatatactgaatatactgaaacatataaattaatgtgtttttgtgtgtgcgcgtgtgtgtgtggctaatgaagttcatatctgttcagggcagaagcctgtcaaatatagatactaggctctttccatctgaatcaaaatttgctagaatgttcattcagtaattcagtaacactctcatctttataaatcaactctattttaatttcattttgaggtattctcagaataaatagtataacgtatttttaaatatactatttatatattagggagatcagaatatatattgggaagtctgagaatggactttttgacaaagtaatgtggagtgtaccagaaaaagtctatcatacgtcaygcacttatggtgaaatggacattgaaagatacacccgaagaatagttagtgaatggagagcagcccaagatgagtctagagatagggaggcagcaggtcatatagaatattgacaaaaacaaaacaagcacacacacataattacttatatgaataaatataatgcaaataagcatatgcatgcatgtatattaattataggtaaaaccctacacttcttccaatgttgacattagttaaatgtcaacattggaaaaaaaaaaaggtctgtttttagaaataaaataaatcatgaccattgatatgatttggctgtgttctcacccaaatctcatcttgaattatagttcccataaaccccacatgtcgtgggagggaccaggtgggaggtaatttaatcatgggggtggttacccacatactgttctcataatagtgaattagttctcacaatatccgatgatttcataaggggctttctctacttttacttggcacttcttcctgaagtgaagaaggacatgtttgcttccccttttgccataattgtaagtttcctgaggccgccccagccatgctgaactgtgagtcaattatacctctttcctttataaatcacccattcttgggtatgtctttactagcagggtgagaacagactaatacagtaaatttttaccacaggctgtaaagatacctgaaaatgtggacgtcaggttggaactgggtaacgggcagagattggaaccacttggaaagcttagaagaagacaggaaaatgtgggaacgtttggaacttcctagagacttggagtactcagaagacaagaagatgtgggaaagtttggaacttcctacagaattggagggctcagaacacaggaagatggagaaatttggaacttcctagagacttggagggctcagaggacaggatcatggggaaatttggaacttcctagggacttgaagggctcagaagagaggaacatggggaaattttgaactttagcctagagacttggagggcttagaagacaggaacatggggaaatttggaacttcctaggggcttggagggttcagaggataggaagatgtgggaaagtttggaacttcctagagtcttggtaaatgactttgagcacaatgctgatagtgatatggatggcaaagtccaggctgagggggcctcagatggagatgaggaactttatgggaattagagtaaaggtcactcttgctattcaaagagactgacaacgttttttcactgccctagagagatgtgaaactttgaacttcagagagatgatttagggtatctggtggaagaaacttcaaagtggcaaagtgatcaagagaaagcagagcataatagtttggaaaaattgcagcctgataatgtgatagaaaataaaaccccattttctggggataaattcaagcctgattaagaaatttagtaacaaggggccaaatgttaatcaccaaggcaatagggaaaatatctccagggcatgtcagagaccttcacagaagctccatctctcacacgtctggagacctagaagaaaaaaaatgattccctgagcacactcagtgttcccttgctctgtgcagccctgggacatggtgccctgagtcccagctggtctagccctggccatggctaaagaaggataatgtacagctcaggccattgcttcagattggtgcaagccccaagtcttggtggcatacacgtggtgttgagcctgttggtgagaagaaatcaacaattaaggcttagaaatctctgcctaatttcagaggatgtatggaaaygcctggatatccaggcagaagtttgctgcaggggcggagccctcagggaaaaacctctgctaggacagtgcagaagggaaatgtggagacggagccatcacacagagtctcccatgcggcctgcctgggggagctgtgagaagagggtcactgtcctccagactccagaatggtagatccatgaacagcttgtgccgtgctcctggaaaagccacagacactcaacatcagtccatgaaagcagccaggaggggagctgtaccctgcaaagccacagtggaagagctgcccagggccatgcaaatcacctcttgcatcagtgcaccttgcaagagatacatgaaaagtcataattttggaacattaagctttaatgactgtggattttggacttgcatagagcctgtagctcctttgttttggccaatttatctcctctggaatgagtgtttttacccaatgcctgtacctccattgtatctaggaagtaactagtatgcttttgactttacagggtcatagacgaaagggacttgcccttgctcagatgagactttcgatttggacttttgacttaacgctagaatgaaataatattttagaggactattaaaagggcatgattactgttttgaattatgagaacatgagattttggagccttagggttttctaagtgtagaatcatattgtcagaaaacagaggtagtttgagttcatctttttttatttggatgccttttattttttctcttgtatgattattctagctaggacttccagtactatgttaaaataggagtttttactccttacctgattcagttctcaggggaaattgtttcaacttttgtccgttcagtatgatgttggctataagtttgtcatagatggctgtaattattctgaagtaatttccttcaatgcttggtctgttgatggtgtttatcatgaagagatgctagatttttatcaaaagtttttctgcatccattgagatgatggtatgtttttggtttctaattttgttttggggtgaattttgtttttggggttttggttattcacctcgtaactatgttgagtcaaccttatattttaggaataaagtttacttgatcatgtggaaataactttttgatgtgctgctgtattctaattgcgtatattttgttggggatttttgggtctatgtttattcaggatattgacctgatgttttctttcttcattgtatctttgccagatcttggtgttaggctcatgttggcttcaaagaatgatatgggaagaagatactattccatgatttttttggaatattttcagtagtattcacaccagttattctttctatgtatggtagaatttatccatgtatctgtctggcccagggttttttttttttccttttgtgggggagggttggtagggtttttgttttgtttctgctactgattcaatttcagagtttttgtctattcaggttttyggcatcttcttgattcaatcttgaggaactgtgtgttgccagaaatgtatccctttcctctagattttctaatttgtgtgcatagagttgttcatagtattctctggggattttttatatttctatagcatcagttgtagtgtcttctttgtcgtttctgattgcacttatttcaacatatgctttttacctacgttaacctagctagttgtctatcaatgtgatttattttttcaaagaacaaattcttaattttatcaaacttttgtagagatttttatattttaatttaatcaaattcttctctgatttgtttcttttcttctgctagttagggtgtcggtttgttcattctttttttctagtttttttaggtgcaaagttagattatcagtttagatctttctaacttcttgatgaaggtcttttaaggctataaactttcctcttaacactgctttgtttgcatcccaaagattttggtaatttctgtccctaattttattagtttaaaattgtttattaatcctttatttcaatgttcactcaggagttattgaagagaaagttgtttaatttccatgtatgtgtgtacttttgagagatgttcttgatattggctttcatttttattgcactgtggtccaagagtctacttggtataacttcattttttaaaaatttattgagatttgtattaggacctagaatgtgataaaccttaaaatgtgttctatgtgcagataaaaagtaggtccaattggtcaggtgtcaaaattaagtccagagtgtccttgttagtttagtgcattgatgatataattaccaatgttatttttcacagaattggaaaaaccttttataaaatacatatgaaatcaaaatagagcctgaaaatccaaagtgatcccaaccaaaaagaaagctgaaggcctcacatcacctaatttaaaactatactacaaggctacaataagtaaaacagcaaggtattggttttggttaaacacacacacacatacaacaccccagaaaaccacacacattgacaagtgggacagaatagaaaactcagaaataaagctgcacacctacaaccacctgattttcgtcaattttgacaaagacaagcaatagaaaaagaactctctgttcaataaatgatgctggaataactacatagctacatgctgaagaatgaaactagacattttaccatataaaaaaactaactcaaaatggaggaaagctttaaatacaaaacctcaaactataaaaattgtagaagaaaacttaggaaatgcccttaacaacatcaaccttggcaaataatttatggccaaattttcaaaagcaattgtaacaaaaacaaaaattggcaagtgggacctgattaaattaaagagcttctgcatggcaaatgaaactatcaacagggtaaatagacaaccttcagaaatgaagaaaatattcacaatctatgcaactgacaaaatcckaatactcagaatctataaggtacttaaactaatcagttagcaaaaaccacatagccccataaagaatggtaaaagacatcaacagacactccttataagaggatataaaagcagccaacaaacatatgaaaaaatgttcatcatcagagaaatgcaaatcaaaaccgcaatgagaaaccatctcacaccagatagaatggctattattaaaaatcaaaaacaacagacgcttctgaggctgtggacaaaagggtgtacttatacactattggcaggaatgtaaattagtttagccactgtagaaagcagtttggggttttctcaaaaaagaaaaaaaacttaaaacacagctatcatttgacccagtaatgtcacactattgggtatatactcaaagaactataaatcatataaatcattataccaaaaacacacatgcacttgtatgttaattgccacactattcacaatagcaaagatatggaaccaacctaggtgcacataaatagtgggttggataaataaaatgtagttcatatgaaccatgaaatactatgcagccaaaaagaatgaaataatgttctttgcagcattgtaggtggagtcrgaaataataatcctaagcgaattaatgcagaaacaaaaagccaagtgctacatattctcagttataagtgggagctatacgttgaacacacatgaacatatacctgggaacaatagacactgaagactactagtggggaaggaaggagagtatatgttgaaatattacctattgggtactctaggctcacgacttgggtccaatatactcatgtaataatcctacacatgtactccctctatttaaaataacagctgaaattaaaaaaaaaataaagttctaggttcccttcagtgcatctacctgtgtttccaatgagactggggagctgtggacttgtttctcttcagaaatgctggtctgtgaagatgtagttatcttaaactagtgggggaaacaaaactcatattgaagttcccacttagatgtctctgttcctctaggttaagtagggctatgtgtgtgcacacacattagtgtctacacagacatgaatttgaggataaagtcctctgcctctacttatttgatgtagatctcatttctttgcactttatgaagtatcacagacagaagaaaagtgaaggtggagatatcctgcatgtgagagttcaatttctcatcttgacattaaaacaaaaaacctatgtttttcaaatacaaatgtgaagtaccttatgttataataagccaatttcttttctacagtggaatacaatagccccatgttcagttttctggtttaaaatatgctcaagcaaaaatttactgtaagcatcaatctgaaatgagatttaaaagaagtccctctaaccagccttctcaaatacactcatagtcagtggagacatctatgtctcatttctctgaagtgcaaatttaaaagtatatggtggttaagtctatattcatttgaaatcagcattttctcaatcactcttattgtttatttctatttttggtgcattattatttattcatcctatgaataatattgatatctaacatgtgctacaaatgcttaatgatgtctccatattgagttatgtttattcatatcttctgcatagtccctctgggttggaaatcttctggttagctgagatattttgatcttgattttatgtctctttttttatcatttattytaagttcaggggtacatgtgcaggtttgttatataggtaaatgtttgtcttgggcatttgttgtacaaattatttcatcactcaggtattaagcccagtacccattagttattttttctgatcctccccctcctcccaccgtgtaccctccaaaaggccctagtgtgtgttatctccctctatgtgtccctgtgttctcctcatttagctcccatttattttctcaataatatttgaatctccacaattaattataagctattatttgtttactttgttttgctttttgcatataccagatgtctgatggatattttctaaatatttccaaatgtaactcatttatacaatttttcacatatagtttattcatgttcttagctagttttcattctgagggttattctttatgtgtattttgggggaatattgtgtgctatgtaggcctcacagcattattttagatctatgtaaaataataaatcaaaataaataatatattatgtcttagtcacaatttctcttctctcttgaatgaatagttcctttgacaaaaataaaaaaacatgaaaagatagagaagtagtgaagggaagtgaaataatcagtgagttctatatgtagaagttgtcttgataaggttttaaagactgaaaatcaggtataccaaaatgataaagaattatactgtgcatggcttcatcaaattcttcacatgacataaagagtattatatttttatgaccagaaatgtgtcagaaagtgcatctaatgctagagaaaaagtcaactggcacttcatcaggccaattgatgaatacagttgcttctataagtgaattatggttgtaagaggtataaaattttctaaaaaaaatctttccagtgaattagaaagctcttcaaagtgtctattatttgacctgggtctcaaaatacaaagaagtattcattaacatcagtaaaggaattgacctgtctagagtaatattagccaaccttcactgagcacttaccatgtgctacacaccattctaagaactttatttataaaaacttacttgcttctcaagacactataaagtatggaattgtattatctgaatatttcctgaataacaaaatgttgaattaacttgccttaactagaatgtggtaaagtacaaaatcaaaaagtgcattatgtcattgtggaacggtaagcaccttggaatggttaaggtacacagaaatacagattataacatttttgatgttggaactgtatattatattttacacagagcctaccactgcacattgaacatagcagatgcttaataaacttaaattaagctgaaattaataattatatttattcctatttattaagaattatattttaatagtacttttaacaggaaggcaaaaagaacagaaaagtattttaaatggcagtagatacaatatcagtaaattcttaagataggcagcattattcatcaaaatgttaagctataagctcagcagtctacatggctgccataataattataaatccagctctgtgacttactacatgtgtggctttgcagaagtttctttattttcactcttcttcagctctcttatctctaaaatagaacagtaattatacttaactcaggggtttggtgagaattaattaattagcatgcatacagtgtttgtagcaatgcatagaacattcaaaatgctcaataaatgttagttatgaagacaatgatggatatgacggttctgaagatatgatgaaaacattaaaacataaacattgatttttacctttatacactacagctaaataactttctgtgacacatttcagtctgaaatcagaaattctagtttcatagttgcactttccttttactattcaccagtattaatctcatttcatttcagatatatttctttgtctatcattatttttgtaataatcacacactacatgtgtctagtctccacttaaaattcaagctcatgaaagctgggggctatgccttatattcctattgcaaccacaactgcaaacatgtctaataggtgcttaataataaacaatcaagaaataggaataaccccagcatttgtctgactgcttaatcatttcagatcatctcaggtgatgaaataggatgcaaataaatgaacttagtgatttaaacagtatgactttacataagcatccagagaaaaacttgtttgaatttgatatatcctgaaaaatcaggccaactgatacttatttcaaaatagcacaaaatttaagccctcagtgaacagcattaaagaaatgttcattttgattttgcacaggaaagaaagggcataacttagaaacaaaatctggagttgaggttaatcgtgacttgagaggagatagctgtttcataagtaaatgcctatttccttctaattcattttatctattctggatgtcgatgtggaagctgtgagttttaagtcaggtcaaaaaaagaagaagaaagaaaaaaagatatttcttaaaagaaagaatmtaggccacatttggcttcaaaaggcttctttgctcatctatttgattgttgtcctaaatttaaaaagtcaaatttcaaataaaatagtttttctctgtgtcagtttttggactacaaatgagaacacaaaataatgatgtttttggacttatgtttttaaatttctagcatatctctagtgtttattgcacacaaacaaagcttaaaaccatatatccaactgtggttcaacatttttgacttagaaacactgaatttataatgtatttattcaacaaacatttattgaatctttattaaaattttccactctacataaacttgagagtggagctaaaatctatttcatcttattaaatctataataccttagtgtagcagaaagggattctaatcatatatgtgctgaataaatcaataaattaattaaatatgccatatagtattttcattgctgttaggaaagaattgaagtctttacacataaaatacgttgtagaagataagtgaaaaagtcttacatctacttagcactatttacttgagcaaaacttctactaattatgtacaaaaagtcaaagatattttagagtaaaaaacagaaaataaaacggacgctgccctctaagagtgtacaattttctcaaagagataaaagagattaaaattgtattttacataacaatataagaaagatgataaaaattcatgcaataataaatgcacaacaaataaaatatttatgaataaaagattttttayaggcttcagaaccatatgaaagcatcatgtcaacaaaaagctcttgttttgacatttctgtgtaatgtaacaaaatctcaatgaaactggagcaagaaattaactagcctgattaatattaaggaaaagccaagagttaatcaggatttaggcacagatgaatctaaagacttaaatttcattgtcaatccctgtctctggattgattagacagattttgctacaagttaggaagttggctgtaacatactcacacacacacacacacacacccctttctttccaagcatacataaacaagaacatacatacctaatttatatttagcatattaggtaatagtggaattgcttggcttcatattccatgtatattattttcctagctatgagaccctcgccaggtttgtgtgtttttttttttttgttttgtttttgttttgttttgtttgttttgttttgagatgggttctcactctgctgctcaggctagagcgcaatggtgtgatcacagctcactgcaacctccgcctcgcgggttccagcaattctcctgcctcagtctcccaagtagctgagattacaggcatctgccaccacacccagctaatttttgtatttttagtagagatggggtttcaccatgttagccaggctggtctcgaactcatgacctcaggtgatccacccgcctcagtctcccaaagtgctgggattacaggtgtgagccactgtgcctggtcttatttttatttttattttttaaatcctatctgaggctttgatttctacctcagaatcctctgaaggattaaataagatgattcaacttgaaaggctgctatcaggcttgacaaatagtaggtattcagtataattgttgctattaatataattattattatgataattttacatgcaataaaaatgccctctccaatgcccaaatataggcaactgtttcatcttctgcagaatcctaagttgatgtcatggggcagtggttctctgaatctaggatgctcaatatgatttctcgaaatcaggtatgtttgtaatttatcatggtccagaaattctgagctaaacaataaatttaaccacatgtaacacctccaacatacgatcatagtgaaaggccagcaaaaacagcaacaaacaaaagggcaggataattatagtatcaaatgtaacttgacagtgaataaagagacacagaacacaatgtttggggttctgtagtgcatcccatgtctacctgatgtggggaattgactactcccagacttggcaatggtgtgcactctggattccatatatggttgcctctttttctattctctgaaacaacctattttgcacaatttatcaatagccatacctgaagagaggagaaacgggacctataactcattagcagggcttgtctttttaagaaccggggatttctgtaggagcaagctatatattaggcataggttgtcaggctgaaaaaaaatctggaagtataactcccttaaaactcagaaacatgcctttcattttaattactagatactatggaaacaacaaatacaaatgtcgccacttcgtaattggccatgttctgaaatctactttttctgatagtaatatagccacttcagccttttaaaaattaaatgtttttaagttatatttttacatattttaactttaaccttcttttataattaacgtgaacttattttagacagcacatagttgtgtcttcatttttataattcatccctccaaaatttgtcatatccctctctactgcctctctccacccattctgatcactggcaagcactgataagctttcagttgctttaaattagttygtgttttctgtaatttcatataaatagaatcatacaatatgtactctatctgacgtcttcaacttagcataattattttgagatttacccactttgttgcctacttgaatagttcattcctttttattgctgggtatcccattgtatgcatatgccacaatttatgtatccattygcttcttaacatacatttgggttgctttcaggttttggctattacaaataaagttgctatgaacattcacatacaagtctttggatggacatctgctttatcttctctctggaaaacattaaagagtggaaaaattgaataatagagttggaatgtgtttaactttttaaaaacggtcaacatgtttactattccaccacagcagtgtaatgagactttcagttggtccacatcctcagcagtgcttgccatttttagtgtttctacttttagagtttcttataggtttgcagtaatattttgttttggtgttatagtttgcatatccctcacagctaataatgtggagcatattttagtgttcttatgtgccatccatttatcttctttaaaattgttctccgtttaattttgttttccatttgcatatcttcttgttaattttgtactatttgttactagggtagtggctataattaacaagtaaagccaactggcagtggagttttctctgttggaacattttgaacaatgaatttaatttttgaatacatgtataagcataagactatccaagtaatttctttttcggtgaactttgcagtgggtatctttccaggaattttacttattgtgtctaaggtggtgagtatatttacataaagtactttttgtttatatagcattctacatatttttaagatatagtaaggtaagtaagtaatttatgtttttactctttattcatgatgactctggctaaagacatcaattttactaatctcaacgatatagcttttatttttactaattttctctattttatatattttaattcattaattttaactctaatctgttttatttctttcttagtttggattaatttgttaaatttttttaatatttaaaggtcaaagctgagattatttgtttcttctcttctatttatttttactgtaaaatgacaaattatagttgtatatagttatgggaaaaagtgatgttatgatttatgaatacaataaagaataattatgctgttaatatatcatcacctcaaatacttataactgtttatagtaagaacatttgaaatttactctcaacaattttgaaatagacaattacaactctgtgcaagatctcaaaataaatttattcttcctattgaactgaagctttgtaatctgtaaccgttatcttctcatttcctccagcctccagcctctgcttcctatctatgaggttgattgttttagattctacacacaaatgagaacatgtaacatctgtctttctgaggatggcttatttcacttagcatagtgttctccaattctaaacatgttccaaatgacaatttttttctttttcatggctaaataatatcccattgtgtataaggaccacattttatttatccatttatctgttgatagacacttcaatcatttacttaaaggaatactcaacatttgcatcaaatgtataaaagtgctgcaaaaaaacatgggggtacagacatttctaatacatgtgtttgtgttatttatttaactttaaacactgcttaagccgcacctctcaaatttgataagttgtatatttttactcaattaaaatacttttgatttttaagattttctttgacccacagttattcagaattgtgttttttgtttgtaaatacatgagaatatttcagaaatactccaagtatttatttgaaatttaatttcagttttgtcagagtatatattttatgatttgcaattttaaaaattgagacttttttgctttaccttatatattgggatgtatgtttgtatatatgtgtgtatttaaatttttacacattaaaatttgccatgttgacttttttaaaggtgcaattcagtagggctaagaacattcacactgatgtgcaaccaatgataagatgtttctcagtttgcagaactgaagctctaaaccaattaaacaattaaacaattcctcattcacacccatctcccaactactattctactttctgtctctatgaatttgactactccggatatctcatataagttaagtcatataatagttgtcattttatgactggcttatttcagttagtataatgtcctcaagttttatccatgttgtagctgtagcatgggtcagcatttcctttcttttgaagtatgaataatattccattgcatgtatataccataatttgtgtgtctattcattaatcagtgtatacttgcattacttccaaatttggctactacgaatcatgctactatcaactgtgagatgtgtctacatctacatctatctatctttgtgtgtgtgtgtgtgtgtgtgtattactatgcagtattagagacaaaaaaatatgactttctcttctgatcttgcttgctcaacctaacatttactttattataatatataattttaactttgactttttctaagactaccttggcctaacctaccagtttgttcttttactaaacaatgttcttctcatctttggagcacctttatcaatgagatgacaaacttcaaggaaattaaactcaggtattgctttttaccggcttttcttggaaggcaattagcaaggattttgattgaggggcttgattactgtctcaaaagaataataccactaggttacttactaagtgctttagaagatatctcaaagaagcatgcttctttccatattttttgcctctctactcttcaattgattaaaaaaattgaatttagctatataaacaccatgataattacattcatttatgcaagctgcttagcattgtgcctaattatcataaggcacaataaggattagtcacattattaaatatgctagataattttgctatatattttatttgattgaaaccctagatcctacatgtgtgtgttcagataccctattacttttttcaggaaacactatcaaatcacaactcagaaaaaaagaaagttcatagtttccttctgtttgtctttttctggtttcctgtcactctgaagttaatggataccatgaccttttatttatatagatggccctagcatgctgagggtatgtgtgggtgaaaggtcctccataatgatactctttggacttttcttatccactctttttctaggctgtggagtttctcaggaccacagcataggccatcttctcttcattcagggagagattagagggctttcatctttacacatgattttatgttccatctatacaataaagattctaaatttatatctcctgtccagactgcttgtattagagctcactagaggaacagaaccaatagggtatttatagatatataagaggggatttattataggaattggctcaggcaatcagacaagccgagaagtcccatgaaattctatcttccagttggagaacagggaaggctggtgatgtaattcagttcaaggcccaggagatgcagtgrtgtaactctcagtctgaggccaaaggtgggagaaccagggagcctgctgatgtaatttctggagtctgaatgcctaaaaacctgaaaatctgatttctaagggcagtatatgaacgagccagctcccagagagtgaattcacatttcccccacttttttgttctatcatggccattagtggattaaatgatacctgcccactctggtaaggaatgatcttctttactcagcttataaatacaaatgttcgtttctttcagaaagtcccttacagaaacacttagatacaatgttttacaagctatctgggtatcccttaacacagttaagttcacacatcaaattaaccatcaaactacttctctttccttctatttcttgactgtgatgaatcaacatctctattttgaagacaagcagtcatttacaaattaatgtgttcaaatctgaacttgtaatattccacatgtatccctcaacccatagttgtcattatctcattaaggggtacttcatatttcactcactatacaggtattaatttagtgccttttatgtgaaagacattgtgttatgcactaaatgatagctgtaagcaaaacaaaactctgcctttatgggacttaacatccccatatacctgatgcacaattcatacagttgggacacctctttcccattagccctctacatcttacctccaatataaatagcaaattagtctacttatcttgttcttcactactactatatagtgcttcttcactactactatatatagttattgatgatgccacctcaaatttattaaagtctctcactttacttgtaacacgttccctaccctagcctttatggttctgtaaattttatccctatgagaaaaagaaaatagaaaagaagaaagaaaggatmcaatgaaagatcttatctttttcctctttctatgataacctacataattttctaatcatgattttttcctaatattttcttgctatcatgaaatgttaatttgtggactcctcctactgtttattattatttttttaaaaaatgaagtattatatttagggtctagactaaactcccctaacaagtatactccaaataactgagtttaataagatagaaatttgtctcacatgggaaagaccagagataagccttccatggctgtgggcaaccctgtcatccttgacatgaggctttaatacctgaattaatggtggctgttccacttctgcctttctagcaggaagacagaaatagaaagtgcagagaagaaattttaatttttaaatgagatcaacttgaagttgcacaaacatcccattgggaacttagccacatggctctatctatctacaaaaatatattggaaaatgcatctttccttgtgcagccatcttgtcctaaaacatgttggagaaatgggttgatatcttttcaccaaaaaaagaaagacacaatgaatactgaaaatgaatcagaagtttctgtcccaattagatctttttcaaattttgcttggttaaaactataaattaactctgtctttttatgtatgtatgtatgtatrtatgtatgtatgtatgtatgtatgtatgtatttatttatttattttttgagatggagtttcactcttgttgcccaggctggagtgcagtggtgtgatctcagttcactgcagcctctgcccctctggttcaaggtattcacctgcttcagcctcctgagtagctgggattacaggcatccatcaccaggccctgctacttttttgtatttttagtagagatagggtttcaccgtgttggccaggctgatcttgaactcctgacctcaggtgatccacctgcctcggcttccgaaagtgctgtgattacaggcgtgagccaccattcctggcctttgtcttttctttctaattttcctttcgtcttttaaaatgaagcataatgtattaatctgtcaatgtgtatgactcagtgaatatttcagaaagtactcttytgacataaaattttaatccagtgattcataattttataagtgaaatatgacacattttaaattctaaaaatagtaggttatatattaaatgtaagatctatatcaaccattactaggaagctgacaaaaatagtatctgtcaataagaaaataatgaccggtatttttccatatttaatctaatttaacgttaaaaatttttattaagagttakccatattgatttccaagtaaaaatgatagtgggaagcgtagttctagattcactacacagcatgcatacttaaataactcaagcatgaaaaataagtaaatgaaaggaaatatctccacttctactaatcaaacaaataaaaaatacttcaacctcatgccatgaactttaagtagcaaaagtccaaggaaaagataagaaagcttctttataactttgttctcacactgctacaaataaatacctgagactgggtaatttataaggaagagctttaattgccacacaattctgcaggctgtacaagaagcatggtggcatcagcttctggggaggcctcaggaagcttacaatcatggtggaaggtgaaggagaagcaggcatgtcttatatggctggaacaagacgaagatagagaaagggaaggtgctacacatttttaaacaaccagacttgtgataactcactctcatcacaacaccaccaagaaggatggtgttaaaccatgagaaacaacccccatgatccaatcgccttccagcaggctcacctccaacattcaggattacaattagacatgagatttgggcaaggacacacatccaaaccatatcagcttctaacatagagtagtgaaaattttaattcactaaccacttaccagaactgtgattatataaagtagaattaagccaggaaggatatttaacaaaatctcaagagagaagacaaagattgtgtgcaattagctctagccaagctgttttcctctctattaatagttttcatttagaggacaacgtaaatcttaaaactgtgcctaagaactgaagacaatcaggtctcaaatgaagcagaaagtgcaagaagaaaaagacatccatagaccaaaaccaacagatgatctgaatagaagtctccatagacataacaaaaacatgtgacctaaaagaggcaaaagcataagacaataataaatattttaaagaaaatgggcaaaaccctgcttctaaaaaaatatgaaaattagccaggcgtggtggcacacacttgtagtcccagctactcgggaggctgaggcaggaggagaattgcttgaacccaagaggcggaagttgtggtgagctgagatcacgccactgcactccagcctgggtgacagagtgagactctgtctaaaaaaaaaaaaaacaaaaacaaaaggaattaaaaaaatgaaaaggatatttagaacttagaaaagtctggcatggaagaatatataatttaagaaataggagaacattctgtagtgttaatttcataacatagaagaacttaatatgattgtaaatttaataagaaagcgataggtgagagaccatacattcaaacaacggaatgagattaaaatagaaatagcaaaactgaagtaacaagttaatgacaagaatatcaatgtcctgagacgggcggatcacgaggtcaggagatcgagaccatcctggctaacacggtgaaactgcgtctctactaaaaatacaaaaaattagccgggcgtggtggtggctgcctgcagtcccagctactccggaggctgaggcaggagaatggcgtgaacctgggaggcgaagcttgcagtgagcggagatcccgccactgccctccagcctgggcgacaaaccgagactctgtctcaaaaaaaggaatctcgatgtcaactaaaaaacaaataataagctaaaacaaaggcaaaagacaaaagtgacattttacgttttacttgatacaggaaaagtcttgaattaataactaagtcaaagggaaaaatcacaaaatgatcatatcaattcacaaaatgctgtatcttatagaagacaggcaaaagcatccaatgaaataataattggaatcctcaatagatagaacataaatgtatttaactaaattatcggtggatgttttcttgtagtgaagaaaatatgtgtaaattaaaagaacacagaaaacttcagaaaaaaaaagaacatgattgacattaataaatcttgtaaattattagcttaatttttttaaaataagatatactcaagtgtccacatgagaggagatagggctaaaaatcagcctagtcttaaagttaactacataatattcaaagcctacaatatttagatacaaaaaaaattctaaattaagaattttcaattttaataagagaaactgaagtcttatatgctcaccattttttttacaaagtgtttttaatctaatagtcaagaagagtaataaaagagtttacattgttaaagaactatattataacatcctacataataaaatatgtatctttggctatagtatttaattttacttttaaaaatgctttatttgtatattgcctgtgtggttataattaatataaactattcattcttttaaatctaaaacaaacaaaaactttgggaattttgaaaagtagaatgaataatcatagtgattattctcttcaaacctttcaaatttgtaagaaaatcctatgtttaataagctaatttattaaatattagtgtaatsagcattttgtttaattgaattgtgacttcgccatgccttatggtattaacagtctggctccaggtctacatggaacctgatgtctgccccatattcattccctttaaaaatgttcaacactcctccttaaggtgatgtttgataatgagaaatttagctttagctcagaaactcttgtaggcttttttaaaaatgaaatatttgtgttttgcatgttctttccttatattttatatatttttttctagatttggcagaatactacatatcttgaatcacaaactctcaaccccaaactgagaatgtgccttctttactccttagctgtcctcctctctaaatgtggaaaggagatgctcttcatcctgcactaagacatatggagattgcttctcctgttcacctattcaatttaaaaagtgtatcagaaaacttaaaaataacacttaagtagaagctcagcaatatgaattagaccaccctaaatagaggtgagaagcggacaacagcactcacttcagccacaacaggcactaaattaatggccacaagatgagctgaacgtcagaacagctattgggactgaatctcctgataaaatatcttaattgaaagaatttatctggtggtagggtagaactgaggcttcagattatgatcagtaactacattttatagtagctgctattgtttgaatgtgtctccttagagttatgtgtcggaaattcaatcaaaattgtgcttatattaagatgtgagacctttttgcttgctcttgtgaatagattaatgttattacggggttggctttctcatcaagggagtagtttccttgtaaaaagggagagttcccttccccccagtcttgccctctcttgaccctttcgtcataagatgatgcagcaagaagactcttgacagatgccagcccctcggtcacggatgtcccagcccccttaactgtaagccaatgcatttccgttcattataaactacctaatgtgtagtattctgttacagcagcgcaatacagactaagacagaagccaaggaaaaattaatacagtacattttgtcaaaaatacttagctgaaaacattttgagtgccatagtgcaaaacacagtcaggaaagacattaatggtagatatcccatgaaaacattatgcttctattttgaaattactgtccatattcactagccataactactcaaataaaatactggaaccaacattgctgttagaaaatctttgccagtgaaaaaaaaaatggttttctttgaaggctgcatttggtctattgggaacagtaccaaataaaacgtgtattatttggaagatgtgctttagtgaaatactattcaagatttatttttgatttgtttgttacttgttttaaagagattattattgatagcatggtcaaaaagcttttcttaaatatatctgggtttgtgtactggatctactccatatgatatttaatattaaacaaataatctaaccactgtttctctcttctctacaaagaaatgcatttaacaacgactttacttttgtggtcataagaagttattataggttatagctactgtgaactaagctacagtttacaatactaaatttattccaacaatggatattttagagcaacttccactctaggcacttaactcatttaatacaataactgttattactaaaaaagttctatgaaatctacagtctctctctctctctctctctctctctctctctctctgtctcacacacacacacacacacacacacacacacatttctatgtaacgctaataaccccagcctcagagaaggtcatggacagttgttaaccaactttgatagacttttttgatccagaaacatgaaattaactttgctagttaaatccttacatatttggctgtctataataattagtaccaccacactttctgatgaagttactctgagttaaaaatctcaaagagaatatataacatggttgttattttgttttattttcttgtatttataaatagaatagcatcgttattatgcacaatgggcatggaaatacacacgcacgtgcacacacacacacacacacagatacacacaccctattcctacccagagaaataatcgctttaaggtcaatattacaactgttagagatcttccatagtaaaaacagctctgttgagaaatattaagttaaacgagattccaatgctcattcattttctaaaatattactcatgttagagtatttttagttaaaatattcaactaagcatcctaaacaaattatcatttaattttccaaataccaaagccaccttatggcaatcaaaactggtgatcctaatgctttttcacaacatggcaagtttttactaattccaaaaatatgtggttttgtgatattaaccacatctattcaattgacaacaatttggtttcttttttattttatttttttagttraagggtacaatgttaagattttaaccaaatcagtgaactacattagtaaatgaaaatatgatgaaaatataaaaacattacagaggtgtgattttctaatactgtatacaaatgcctcacataattgcactgtgcctttgcagaatttctttttcatgctatattcataagcactttttagctggtttgatacatgttcagtttaataatatttcataaatatttccagagctgacaataagagaaagtgaattacttatacactttaaagacaagcaagtatcctaaaactctaaaaattaattcaacgtgaaaaactactttttggagaaaatatgtatctttttttttttttacatattgctcaggggagacaaaagagctagaatttacataacagaacactggagatgagaaagctgtaggaagacagggcttcagagatctgcagaggaactcctccagttctgagtattgatcgacacttccacatgcttttgacaagcgtgtttgtggcgcagcatagacacacaagtaaagatacgatrtgatagcacctggctcttacagggatccaaacctagtactggtcttacaaaccatactaaagaaattcacgttgctcaagacattgagtagaatatacaaaagggtcctgccttacgtttgtggaataactagccctaagtcagagtttcccaaattcaacttttttgaaaaattcaaatatttgagtttaaattcaaaaattttaatattttaggctatgattatttgttgttgggggcctgccctaagcattacaaaatgttcagcagcatccatggcatctaacccttaagtgtcagttgcattcatccctaatttgacaatcaattttgattgcaaaattgattacaggccaggcgcagtggctcatgcctgtaatcccagcactttgggaggccgacgtgggtggatcatgaggtcaaggagatcgagaccatcctggctaacacggtgaaaccccgtctctactaaaaatacaaaaaattagctgtgcatggtggcaggcgcctgtagtcccagctactcgggaggctgaggcaggagaaaggcatgaacctgggaggtggaacttgcagtgagctgagatcacgccactgcactccagcatgggcaacagagcgmgactccatctcaaaaaaataaaaaaatttggttacaaaatccagaccttgccaaatgtcttccaggggtaaaaaattgcctttattaaaaactactattatagaatgaacacttctatcaccctgcctaaaaaattgttaaagcaagagccaacaggatcaaaatattttcagttaacgactgtagactagaaaaaattctgtgaatatttataaagacacaaaattacccagcccataccaaggtaaaattcacaatmtttgctatttaattttagctattttttaaagaattccagttatgcacagaatcaagaaaataaaattcaaaatattgagataaatcaatcaaaaattactcagaactgaaatggagggaggctagaaatagcaggcaagaaaattaaaacaatttttgtttctttattatatacacctaatgtaaaatagaggcaggggaaatggaaaatgaaaattttaaattgattttctatagtgagaactacaatgtctgagatatactagatgagatcaagaacttaataaatattgcagtaaaacaatattacattcagaatacaggaatacaaagtagttaaataaggcactgagagaacagagaaaaaaaagaacggagcatcaataactggtagaaagatgtcaaggagccaactgtatatatatattggaagttctgaagaaaaggaaagaggaaaagaagaaaaaaatatatttgaagaaataattggtgaattatttttaatgttttatgaaaactgtaaagccacagatctgagaagctcaacaaaccccaaacacaagaaacatgaaaataactataagaactacatcataatcaattttctcaatatcagtgataggagaacatcgtaaatgtagccagatatgaaatacaatgttatataaagacgggaagaaaatgtgacagtagcagaagatttatcactggaaacaatgaaataagagagtagatatcttgaaacttgttttatttttatttttattttattttattttatttttgagatggagtctcactctgtcacccaggctggagtgcagtgtttcagcctcccgagtagctggctcgccaccgcacccagctaatttttgtgtttttagtagagatggggtttcaccatcttggccaggctggtctcaaactcctgatcttgtgatccacctgcctcagcttcccaaatggttgggattacaggcgtgagccactgagcctggccaaaacttgttttataaagagtttcattgtagaattccacatcagcaaaataatcttatgaaaattaaggtaaagtaccctttcagacatacaaaagctgagaaaaattattatagacagtaattcaatataagaaatgcttttaaaatatcctttattacacatagaaaaatgagacctgtaggaaatttagatctgtaaaaattaatgaacattatttgaaataattgcataagtgtataacattattttattatttaaaatataaatatatgtagaaattaattaaaaataatctttaaaggatgataatttaaccaaaaatactcacaatgtaatattattattatactagccccacaactaatggctgttacaataataatgatggaataattgaattggacactagaagaggcaaagattggcagtgaccacacggcaagtcaacagaacagatcttagttaatagttcaaccaggagcacactgaccagctgagagcatttttttgcacatatcaatcttaaagactatgcctttttcttatttactcttctctattcactcccagactcccaacacaatttctctttcttttgtaccacaaactcaaggctcagattccttcactagtgaattatatcagatagctaaggaagaagtaatattgattttacacagaatactctagagtttgaaagggaagaaatactccacaactcattctataaagtcaaacttacccgatctcaaaaccaaaggcattacaaaagaaagaaagaaaagaaataaagmaagcaagaaggaagatattgatgcggatacagtatgggataacatctaaaattatttgtgacaaaaattctcagcaatttaataacaaaaggaatctcttttaatctgataaatggaatccataaaaatcctacaactgatactattctgaaagaaaagtatgtactgcctttctcataagatcagaaataagataaataatgtccacatccacttttaccacttcccatttctatccaatcatttaccaaagattctatccagtccaataaggcaaaaaccaagacagtgggcttggtggacacagtgatgatgacagagacagagagagggagaaggacacaaagagagatggagagaaagcagagagacacagacagaaagtgggggaggacaaagcccagattggaagggaagaaggcaaaaatcatttatttaatgacaaaattattgtctatgtacaaaatctgatggaatatacaaaatgtatttaaaaaaaatttaaaaaaatgaaccagacccagactttatatgcttcacaaaaattaactcaaaataaattgtagaccaaaatgtaaagcttaaaactaaaaaatctcctataatataacatatgaaaaaaatctagaggaccttcattttggtgatgatttttagagatattagtaacaccaaatatatgaaataaataattgataagctgaagtacattacaattaaaattatctgctctatcaaagatactgtcaaaagaatgaaagagcaagatacaggctgagagaaaatatttttcaaagggcatatctgacgaagaactgtaatcccaaatatgtaaagaacatttaaaactgaaaaataataaaatggacaacttgattaaaaactgagccaaaaatcttaacagatatctcagcaaaaagatatacaaatggcaaataaggatataaaaagatgcttcacatcatatatgtcattaggaatgtataaattaacacagcaatgagatagcattacaaacaagataaccactattagaatggccaaatccagagcaccagcatcaccaaatgttggtgaagatgtggagcgacaagaactcatatttactgcttatgggaatgcagaatgatacagtcacttttagaagacagtttagcagtttcttacaaaactaaacatactcataacacataatccaggaattatgtttcttggctttttctcaaaagtgttaacaagtttatgtccaagcaaaaatctgcacatagatgtttgtagtaggtttattcataattaccaaaacttggaaacaaccaagatgtccttccataaatgaatgtgtaaataaattgttacatcctcataatggggtattatccagcactaaaaaaaaaagctacccagccacaaaaagacatggagaaatcataaatgtgtattattaaatgaaagaaaccaatcaaaaaaggattgcaattatatgacatcttagaaaagacaagtatggagatagtattaataagaaaataaaatctgtgattgctatggtttgagaaggaaagggatacataggcataaaacagaggatttttagggcagtgaagctacttgtatgaaactgtagtggtggatatgcatcataaaaagttgtgcaaacaaacagaatgtaaaatgtcaagagtgaaccctaactctgggtggcatgatttgttaacatatgttcatcaatcataacaaaagtactactgtggtaaggaatgctgataatgggagaggctatgcatgcatggcaacagggtatatggtaaatctctgtaatgtccactgaggttttctgtgaatctaaaacttctctgaaaaatgaagtctattaaaaataaaaatgaatatctattaagagaatcccagtatattttttaaaattaaattttgctatttttaaatttttatagttacatattagatgtatatatttatgaggtacataaaatattttgataaaggcaccaacatgctatttttccattggtggaaattgacaaactgattctcaaatgtgaatgtaaattataagaacttagaatagtcaaaaattaatttgaaaaaggagcactaaccctatctgatttcaagatttatgttaatcttaactaacattgtgttactggcataagatggacaatttgaataatgggacagaataaagagtatataagtagccttaatcatatatggacaactagttttcaacaaatatgtgaaggcaatctagtaattaaaaaaaaataagcagtcctttaaacaaatgtggatggaatgattgaatattcatgtttaaaaatgaacttagaccaaccttgaatcatatacagtaattaactcagaatagatcatagacctaaatgtaatgtctaaaagtatactccatgtaggaacaaaacactggagaaaatatttgtgactttgggttaggtgaagaatattttaaatacaacatcaaaagcaggttccatagaagaatatactgataagtgatttttaaaaatattatatatccagttttcaatatgtattgttaagagaatgaatagacaaatcacagactacaaaagttaaatagtttattttcaattttcaagcacttcatcatcatcataatctaaaattatttatttattcattaccatacgtctggtactgtactgttttacatgcgttatttcattaagtcctttcagcaatcctataaggaagatataaattttctcatttcacacatgagtaaagagaagatttaaagaattaggtaaattgctttgggccaaaagatgtagcatctgaatataattgcctatctaatttttactttctctaacacttgatacaataaagcctcataattaatggctgatataaccataattattgaatgaattagacaccaagaaggacaaagattggcatcattcaacaagtcctcagaaacagagcttagtcagggattgaactggtcacaaacttcccagcctagagtatattgtgttatatgtgtcaatcctatgtaattagcttatttcttatttgctgctttctctttcactaccaaaattccagttaaatgtcttcctttttcctgtttttctttccagaaaattgtgctgaattgtcacttagaataaatcttaattccccaatcatcacagtacttgacaggttctcattagctcttaagcatgcatatagaaaaatactgaaaaatggaccgaattaacttttgtggctttttcctattttctttacttggggataaatgtttattcacatctatactcttttttgtccagagaaatagaagaactcataaaattgaatctattcctaccaaattcttcacagagaatttttgaagacatgattaagataaagacaaatacaattacttagtgattactattacagataaaattatgtagaaaatgtcggctggacgcggtggctcacgcctgtaatcccagtacttttggaggccgaggcaggcggatcacgaggtcaggagatccagaccatcctggctaacacggtgaaactcagtctctactaaaaatacaaaaaattagctgggcgtggtgccgcgcgcctatagtcccagctactcaggaggctgaggcaggagaacggcgtgaactcgggaggcggagcttgcagtgagctgagatcacgccactgcactccagcctgggcgacataccaagactccttctcaaaaaaaaaaaaaaaaaaaaaaaaaatttagaaaatgtctatgctcagatggtttatatctgtttttcactctccttagcagttcccaccattttgaacatgttaattcaaggtgaatttcactttcctaataaaattgtatcttaaaaaataagaaataatatctcctactgttccaaaagactttcctgaattatcctctcttccaaatagcatctatttcatttcatatttaagttctaagcagtcttcaatcatatttattgaagtgtgaattgcattacttgtctctattctgtaaaatatcagctgactttctcaagtggagctctttttctttgtttcacagaatctaagcaattaaaatacacaatttggttttttttccgatgtttattttatctttctgaagggattttgtctgactgaaaaagaatgctgttggttttttgttattctgtattttttatatctatattctagtagaaatcctgatatttgctaaataggttttacattgrcagttttatatttattgccttgatcattagactaattgacaaataaaagagtcaattacttgcccaatttttggaatctgggaaggggaagccttacttatccatctagttttcaggtattcctcttccttaactcagccttgttaagcttcttccaagtccgtgtgccaggcagaaagtaacagtgattactgaaaacactttaaaagagataggtcttatactctattaagggacagcttactgcccagaaaatataagtagccaatttgcttgttacatacaagaatcaattaaactaaaacataaacataaagtaaaatctcaatagatataaatgcatatgaacaatttaagatgaagaatttaacaaaaaaaaacataaacagaagaaaatgtgtttatcctcaccagtaaccaaataataacaagagttaggttaatctcccacctgataaattaactaattaaattattactgagtattattattgataatacttgatggccaggtgctgtggctcacacctgtaatcccatcaatgagaggctgaggtgggcggatctcttgaggtcaagagtttgagacaagcctggccaatatgacaaaaccctgactctactaaaaataaaaaaattagacgggtgtgttggcacgcacctgtagtcccagctactcgagaggctgagatcagagaattgtttgaacctgggaggtggaggctgcagtgagctgagctgaattcacaccactgcactccagcctgggtggcagagtgaggctccgtctgcttaaataaataaataaataaaataataatgcttgatggcaaaaatgcgatgagtgttgtatatctgttactattgggagcattcagcccttcacttatttaagtcatttactgatcacatacaaagtgtaataagccatgatgacacatcagtgaacaagaagaaaaggtttctgctttcatggaaaatatggttaatcaaggaaatattaaacaaatacttacatgaaaataattatcaaaattcttgcaatcttaaaataaatatcttgcctatttgaattcaaggaagtttagaatttgaaaatttattgctgaaattgaattgcctcacaatcacacatggaatatgtttataactcataagttttcctctttcttcagctgtaactgatattgattaattaattgattaatgaaggtatttgaggtatcttgattgctccaaaataatttaaggaataatcaaagttacatacagaacaatacttattgtctaaatattttaaatactctaatattcttttctgttgtccctttagattcaaagacaattcaagtaaattatcaggcatagaaaggaacagaacrggctacagagtttcttagagacatagtttaattcatgattttttaccttgatttctttcaatgttttatagcattctctaggaaacatatttttaaaactagaaagctccactcactattaattttcagtgttggggacctaacaaatctatgacttggtagcctattgttacaggccatatgttgctgtgtgtatggtaacagcactcactctgaggtcaaggaactttgtattaaaatctcaactctcacatttttttgtgacattaaccaaaacaactttttaaactcagtttattttcatttatatggtaacaataatagtaatgtagattacgt

SEQ ID NO: 12604 - DNA, 201 bp, Homo sapiens; identical to SEQ ID NO: 1395

SEQ ID NO: 12605 - DNA, 201 bp, Homo sapiens; identical to SEQ ID NO: 1396

SEQ ID NO: 12606 - DNA, 201 bp, Homo sapiens
gcattcaatgaagtttgcaccataaagccctaagaactccaggcttgaagattctctgcaaaaagtgttaccatagccagtcattttggtttgccataacygataagggcttatctttctgacagcacttaccaacctagttcctctgatttttgagtcatgtcctagaaaaagagctgagcccaaggaactacagcttgg

SEQ ID NO: 12607 - DNA, 201 bp, Homo sapiens; identical to SEQ ID NO: 1399

SEQ ID NO: 12608 - DNA, 201 bp, Homo sapiens
tgctcacttgcttttctctctccacattaaacaccaaacaggtatcctgatgtgcagactcgagtgcaggcagaattggatcaggtcgtggggagggaccrtctgccttgtatgggtgaccagcccaacctgccctatgtcctggccttcctttatgaagccatgcgcttctccagctttgtgcctgtcactattcctcat

SEQ ID NO: 12609 - DNA, 201 bp, Homo sapiens; identical to SEQ ID NO: 1404

SEQ ID NO: 12610 - DNA, 201 bp, Homo sapiens; identical to SEQ ID NO: 1405

SEQ ID NO: 12611 - DNA, 201 bp, Homo sapiens
ctctccacattaaacaccaaacaggtatcctgatgtgcagactcgagtgcaggcagaattggatcaggtcgtggggagggaccgtctgccttgtatgggtraccagcccaacctgccctatgtcctggccttcctttatgaagccatgcgcttctccagctttgtgcctgtcactattcctcatgccaccactgccaacac

SEQ ID NO: 12612 - DNA, 201 bp, Homo sapiens; identical to SEQ ID NO: 1409

SEQ ID NO: 12613 - DNA, 201 bp, Homo sapiens; identical to SEQ ID NO: 1410

SEQ ID NO: 12614 - DNA, 201 bp, Homo sapiens
gcgacctcttcagatggattattacaggtagcgggtggcgtggtaggtactttaaaggaaatcaagcgccaccgcctcgatgcccgcagcgttgtccccarattgcaggaaccgttacgcgccttgcggggaggggaagggtttggcgctgggttacagcgaggtggaaacacgccccttctcttctccaagggagagtgg

SEQ ID NO: 12615 - DNA, 201 bp, Homo sapiens; identical to SEQ ID NO: 1458

SEQ ID NO: 12616 - DNA, 201 bp, Homo sapiens; identical to SEQ ID NO: 1411

SEQ ID NO: 12617 - DNA, 201 bp, Homo sapiens
agccacccccgcccaagcgcctccggcttcccttataaagggagggcccccttcgcgaccgcaagcgcgcccaggaagaccacagagccgccggtgcgcascgaggtggcgatacgcgcccgggctcggcctgcgggtggtggcccaagcgtccgcctcgctggcctggcaggcgcgactgtgcgtgcgcagccgagggtg

SEQ ID NO: 12618 - DNA, 201 bp, Homo sapiens; identical to SEQ ID NO: 1412

SEQ ID NO: 12619 - DNA, 201 bp, Homo sapiens; identical to SEQ ID NO: 1413

SEQ ID NO: 12620 - DNA, 201 bp, Homo sapiens; identical to SEQ ID NO: 1414

SEQ ID NO: 12621 - DNA, 201 bp, Homo sapiens
ccaaacaggtatcctgatgtgcagactcgagtgcaggcagaattggatcaggtcgtggggagggaccgtctgccttgtatgggtgaccagcccaacctgcyctatgtcctggccttcctttatgaagccatgcgcttctccagctttgtgcctgtcactattcctcatgccaccactgccaacacctctgtcttgggctac

SEQ ID NO: 12622 - DNA, 201 bp, Homo sapiens; identical to SEQ ID NO: 1464

SEQ ID NO: 12623 - DNA, 201 bp, Homo sapiens
ccgacctctccacccaacggcactcagtccccagaggctggggtaggggcgtggggcgcccgctcctgtctctgcacccctgagtgtcacgccttctcctytctgtccccagcatgggcaccagcctcagcccgaacgacccttggccgctaaacccgctgtccatccagcagaccacgctcctgctactcctgtcggtgc

SEQ ID NO: 12624 - DNA, 201 bp, Homo sapiens
gtctctgcacccctgagtgtcacgccttctcctctctgtccccagcatgggcaccagcctcagcccgaacgacccttggccgctaaacccgctgtccatcyagcagaccacgctcctgctactcctgtcggtgctggccactgtgcatgtgggccagcggctgctgaggcaacggaggcggcagctccggtccgcgccccc

SEQ ID NO: 12625 - DNA, 201 bp, Homo sapiens; identical to SEQ ID NO: 1417

SEQ ID NO: 12626 - DNA, 201 bp, Homo sapiens
caaccaggggcgctgtgaggcaaaccgctgccactacactggctttccgggaagcaagctcaagtcgcggagagggaagggaggtcgtgcgctcggggcgrggcgcgctcccaagtcgagcgcagcggccggggcaggttgtaccgagcgtggttctggggacaccgtgcggcctcgattggaggtggctgtgatgaagcg

SEQ ID NO: 12627 - DNA, 201 bp, Homo sapiens; identical to SEQ ID NO: 1418

SEQ ID NO: 12628 - DNA, 201 bp, Homo sapiens; identical to SEQ ID NO: 1419

SEQ ID NO: 12629 - DNA, 201 bp, Homo sapiens
gaagggaggtcgtgcgctcggggcggggcgcgctcccaagtcgagcgcagcggccggggcaggttgtaccgagcgtggttctggggacaccgtgcggcctygattggaggtggctgtgatgaagcgcggttaccgcacaatggaaacgtgggcacctccgctcccatgaaagcctgctggtagagctccgaggccggccgg

SEQ ID NO: 12630 - DNA, 201 bp, Homo sapiens
ggcgtggggcgcccgctcctgtctctgcacccctgagtgtcacgccttctcctctctgtccccagcatgggcaccagcctcagcccgaacgacccttggcygctaaacccgctgtccatccagcagaccacgctcctgctactcctgtcggtgctggccactgtgcatgtgggccagcggctgctgaggcaacggaggcgg

SEQ ID NO: 12631 - DNA, 201 bp, Homo sapiens; identical to SEQ ID NO: 1431

SEQ ID NO: 12632 - DNA, 201 bp, Homo sapiens; identical to SEQ ID NO: 1489

SEQ ID NO: 12633 - DNA, 201 bp, Homo sapiens
tagattccttatactataaaaaaattaaaaattaaatttcatgactaccctgatataaagatgaatgcattaaaatgatgtatgaaaatattttcttctamctaaaagtgagtttttttaggtctgaagattgtaaaagacgtaaaaatattttcatgggcccctaaaaagtgttgtgagccctaggcactgtccctgcgg

SEQ ID NO: 12634 - DNA, 201 bp, Homo sapiens
ttttgctatgataatgtatagttatatataatcatttattgaactttaatgttggtcattggccttgattgcatttttaaaatttttattttaattttatrtatttacttaccttagagacagggtctcactaccttacccaggctggtcccaaactcctgggctcaagcagttctcccgccgctgtctggcaggtagctg

SEQ ID NO: 12635 - DNA, 201 bp, Homo sapiens; identical to SEQ ID NO: 1440

SEQ ID NO: 12636 - DNA, 201 bp, Homo sapiens
ggaggagcggccgcaggcagcgcccagggatatgactggagccgactttccagaagcggcgcacgcaaagcccagctccgcacgcaaaggggaggcgacascagaaacttcaacccgataaagttcgccggagcgcggagattcgcctcctcctgccactctccgccccgctcgggtcccgccccgctagctcccccaggc

SEQ ID NO: 12637 - DNA, 201 bp, Homo sapiens
ttttctctctccacattaaacaccaaacaggtatcctgatgtgcagactcgagtgcaggcagaattggatcaggtcgtggggagggaccgtctgccttgtrtgggtgaccagcccaacctgccctatgtcctggccttcctttatgaagccatgcgcttctccagctttgtgcctgtcactattcctcatgccaccactgc

SEQ ID NO: 12638 - DNA, 201 bp, Homo sapiens; identical to SEQ ID NO: 1442

SEQ ID NO: 12639 - DNA, 201 bp, Homo sapiens; identical to SEQ ID NO: 1444

SEQ ID NO: 12640 - DNA, 201 bp, Homo sapiens; identical to SEQ ID NO: 1443
  misc_feature (1)...(201): n = A,T,C or G, or insertion/deletion polymorphism (see Tables 1-2)

SEQ ID NO: 12641 - DNA, 201 bp, Homo sapiens
caacggcactcagtccccagaggctggggtaggggcgtggggcgcccgctcctgtctctgcacccctgagtgtcacgccttctcctctctgtccccagcaygggcaccagcctcagcccgaacgacccttggccgctaaacccgctgtccatccagcagaccacgctcctgctactcctgtcggtgctggccactgtgcat

SEQ ID NO: 12642 - DNA, 201 bp, Homo sapiens
tggcgcgcggctggatttggagaacgtaccggccactatcactgacatcttcggcgccagccaggacaccctgtccaccgcgctgcagtggctgctcctcytcttcaccaggtaaagcctctgggaggcgtgggccaggtcttttctcctctgaaaaaggcggagtagagacagaatatgctgagtttgcaagcagggccc

SEQ ID NO: 12643 - DNA, 201 bp, Homo sapiens; identical to SEQ ID NO: 1402

SEQ ID NO: 12644 - DNA, 201 bp, Homo sapiens; identical to SEQ ID NO: 1403

SEQ ID NO: 12645 - DNA, 201 bp, Homo sapiens; identical to SEQ ID NO: 1406

SEQ ID NO: 12646 - DNA, 201 bp, Homo sapiens; identical to SEQ ID NO: 1407

SEQ ID NO: 12647 - DNA, 201 bp, Homo sapiens
atgggtgcagcacaccaacatggtacatgtatacatatgtaacaaacctgcacattgtgcacatgtaccctaaaacttaaagtataataataataaaattwaaaaaaaatgctacagtatgaccccactcctgggtatttatcctagagaaatgaaaacacattcacacaaaagctatacatgaatgtttacagcagctgc

SEQ ID NO: 12648 - DNA, 201 bp, Homo sapiens
tagacaaagtacattctggggaaacaacatttatatgtagcctttactgtttgatataccaaattaaaaaaaaattgtatctcattacttatactgggacmccattaccaaaataataaaaatcactttcataatcttgttatgaagttttatgttgtagcaaatatagtctaatgtatcactttatttcaactattacta

SEQ ID NO: 12649 - DNA, 201 bp, Homo sapiens
gaggagcggccgcaggcagcgcccagggatatgactggagccgactttccagaagcggcgcacgcaaagcccagctccgcacgcaaaggggaggcgacagsagaaacttcaacccgataaagttcgccggagcgcggagattcgcctcctcctgccactctccgccccgctcgggtcccgccccgctagctcccccaggcc

SEQ ID NO: 12650 - DNA, 201 bp, Homo sapiens
gccacccccgcccaagcgcctccggcttcccttataaagggagggcccccttcgcgaccgcaagcgcgcccaggaagaccacagagccgccggtgcgcagsgaggtggcgatacgcgcccgggctcggcctgcgggtggtggcccaagcgtccgcctcgctggcctggcaggcgcgactgtgcgtgcgcagccgagggtgg

SEQ ID NO: 12651 - DNA, 201 bp, Homo sapiens; identical to SEQ ID NO: 1420

SEQ ID NO: 12652 - DNA, 201 bp, Homo sapiens
tgtatcctgtgaagcatcacggttatccttctctgcacatgggccagtgcattcctgttctgcttaaacaagcttaagttgttccttcgagtcaatacaakataagatattttaaacctctctctactttaaactatccctctagcttagctgttctttttgaaagttatttgcaacaaacaattcaagtttgagatttgg

SEQ ID NO: 12653 - DNA, 201 bp, Homo sapiens
caggcttgaagattctctgcaaaaagtgttaccatagccagtcattttggtttgccataactgataagggcttatctttctgacagcacttaccaacctasttcctctgatttttgagtcatgtcctagaaaaagagctgagcccaaggaactacagcttggaggatatatctgatctatctgcgatggcaggaaagcatg

SEQ ID NO: 12654 - DNA, 201 bp, Homo sapiens; identical to SEQ ID NO: 1421

SEQ ID NO: 12655 - DNA, 201 bp, Homo sapiens
ataagaattttgctcacttgcttttctctctccacattaaacaccaaacaggtatcctgatgtgcagactcgagtgcaggcagaattggatcaggtcgtgkggagggaccgtctgccttgtatgggtgaccagcccaacctgccctatgtcctggccttcctttatgaagccatgcgcttctccagctttgtgcctgtcac

SEQ ID NO: 12656 - DNA, 201 bp, Homo sapiens
gcgcacgcgccccacccagcggtgccccgacccctccggtctcctatcttgtctctatcgtcccctcccctgcttgcgagtgagaacacatttgcaaagayccctccaccccccggaaaaacaagagtttttaaatgcttggagatgagccctgatatctctctccctggcgcattacaatcagaactggaatagttccga

SEQ ID NO: 12657 - DNA, 201 bp, Homo sapiens; identical to SEQ ID NO: 1423

SEQ ID NO: 12658 - DNA, 201 bp, Homo sapiens
aaaaaaaattgtatctcattacttatactgggacaccattaccaaaataataaaaatcactttcataatcttgttatgaagttttatgttgtagcaaatayagtctaatgtatcactttatttcaactattactatggattattcaattaaaatattgcactgtaaacattttatttgtccattctacatttcaggccgag

SEQ ID NO: 12659 - DNA, 201 bp, Homo sapiens; identical to SEQ ID NO: 1424

SEQ ID NO: 12660 - DNA, 201 bp, Homo sapiens; identical to SEQ ID NO: 1425

SEQ ID NO: 12661 - DNA, 201 bp, Homo sapiens; identical to SEQ ID NO: 1426

SEQ ID NO: 12662 - DNA, 201 bp, Homo sapiens; identical to SEQ ID NO: 1427

SEQ ID NO: 12663 - DNA, 201 bp, Homo sapiens; identical to SEQ ID NO: 1478

SEQ ID NO: 12664 - DNA, 201 bp, Homo sapiens; identical to SEQ ID NO: 1430

SEQ ID NO: 12665 - DNA, 201 bp, Homo sapiens
ggccgccccccgcgacatgatggacgcctttatcctctctgcggaaaagaaggcggccggggactcgcacggtggtggcgcgcggctggatttggagaacktaccggccactatcactgacatcttcggcgccagccaggacaccctgtccaccgcgctgcagtggctgctcctcctcttcaccaggtaaagcctctggga

SEQ ID NO: 12666 - DNA, 201 bp, Homo sapiens; identical to SEQ ID NO: 1432

SEQ ID NO: 12667 - DNA, 201 bp, Homo sapiens
aaataaattataatgtgctttctagatgaaataagaattttgctcacttgcttttctctctccacattaaacaccaaacaggtatcctgatgtgcagactygagtgcaggcagaattggatcaggtcgtggggagggaccgtctgccttgtatgggtgaccagcccaacctgccctatgtcctggccttcctttatgaagc

SEQ ID NO: 12668 - DNA, 201 bp, Homo sapiens
gaaataagaattttgctcacttgcttttctctctccacattaaacaccaaacaggtatcctgatgtgcagactcgagtgcaggcagaattggatcaggtcrtggggagggaccgtctgccttgtatgggtgaccagcccaacctgccctatgtcctggccttcctttatgaagccatgcgcttctccagctttgtgcctgt

SEQ ID NO: 12669 - DNA, 201 bp, Homo sapiens; identical to SEQ ID NO: 1436

SEQ ID NO: 12670 - DNA, 201 bp, Homo sapiens; identical to SEQ ID NO: 1435

SEQ ID NO: 12671 - DNA, 201 bp, Homo sapiens
cccgcagcgttgtccccagattgcaggaaccgttacgcgccttgcggggaggggaagggtttggcgctgggttacagcgaggtggaaacacgccccttctyttctccaagggagagtgggttggggatgggaaggggcgtcttcggccatttctccagagagtcagctccgacctctccacccaacggcactcagtcccca

SEQ ID NO: 12672 - DNA, 201 bp, Homo sapiens; identical to SEQ ID NO: 1437

SEQ ID NO: 12673 - DNA, 201 bp, Homo sapiens
caattatctagagcaagtgatttaatataagattgcttcaaaaaaaatattttacctttaaaataggaattgtttttaagattctttaggctaagtgacayttttttccaaaggcaaataatcacctttcttgaataaagtgaaataatctagattatctgttatattttatagttctaaagttatgtgacagagaaggta

SEQ ID NO: 12674 - DNA, 201 bp, Homo sapiens
aggttctagtgcaccttcttttttatcagtctgaattttcagacttggtggttacctcaatctaaattaaccaaccactctaaactttctccaccatttcrctccattaggtgtaactactatatacatttaacataggagggttattctgaatagacttttgaaaagtttagtgtttctatcattttttttttgctactt

SEQ ID NO: 12675 - DNA, 201 bp, Homo sapiens
tataaaaatatttattatatatttatctataaataaatataaaaatatttattatatatttatctataaatatttaaatataaaaatatttgtttatacatttatctataaatatttaaatataaaaatatttatatatttatctatattttatatctatatatacatacctacattatcagtatgtaggtaaatatatct

SEQ ID NO: 12676 - DNA, 201 bp, Homo sapiens
gaaatgattgatatttagtaatggtgctaggacatttggaaatatatatatccatctaaatttgtgtaactacactgtgatgtttgccagtgatgaaaccrcctaaggacacatttctcagaacgtatccccgtcgcttagctatgcataactgtacatttaaaatgctattgctgcctcttcagtgagctgtctattcca

SEQ ID NO: 12677 - DNA, 201 bp, Homo sapiens
gtgatgtttgccagtgatgaaaccgcctaaggacacatttctcagaacgtatccccgtcgcttagctatgcataactgtacatttaaaatgctattgctgsctcttcagtgagctgtctattccacttttttctttgtattataacgaaaatattattgtgtccttaagttctccagacactaaatatagaaataataaca

SEQ ID NO: 12678 - DNA, 201 bp, Homo sapiens
cactaaatatagaaataataacagggcttgaaattaagagagagcagtcctaagaaactaagaaaaatgagtattagtaattgccatttatttatcacatrttatgtgtcagatactttattaaaatgattacttattgtcacaatgacccccaaaggtacataggcccatttgacaaacaaggaagcagagagtcagaga

SEQ ID NO: 12679 - DNA, 201 bp, Homo sapiens
aaattgtttttagctgttgattaatggcagcaacagggccagtgtgtgttggggtttatggctgcaagaaaatgtgctggccttttctaatgtctgcacarcctatttaagaatattcccagggaccaaggatctaactttcctatggattctgaaatgatgcaaaggtcagtgtcagctctgtctcacagttttgtttaa

SEQ ID NO: 12680 - DNA, 201 bp, Homo sapiens
aaggaaactctgagtagactgccaggtcttgtcaaatatgaacatgcaagtgatccttggttgctatattgacatttctctccccaattcatgggtttttkgttagcttctcatcttcttggggataagggttacaatggagatgctttatggttaaaattgttgtgtattgagcttagaaaggggacttcttttaaaaaa

SEQ ID NO: 12681 - DNA, 201 bp, Homo sapiens
aagcaaccctgtcctcccctgtctccatgcttatgtttatacattctctcagtcagaaatgctcttttctatagtctacaaatccccatatcctaccttakccatctcatccatgaatcttgccttggtaacacctgccatacatttctttttcctttgactttccatactctttattcaaacctgcctaatagcacttac

SEQ ID NO: 12682 - DNA, 201 bp, Homo sapiens
agcaaccctgtcctcccctgtctccatgcttatgtttatacattctctcagtcagaaatgctcttttctatagtctacaaatccccatatcctaccttagycatctcatccatgaatcttgccttggtaacacctgccatacatttctttttcctttgactttccatactctttattcaaacctgcctaatagcacttacc

SEQ ID NO: 12683 - DNA, 201 bp, Homo sapiens
tccaagtttacggactatgagctgaaggcctatgccaaagcaggggtggtggctgatgaagtcatttcatcaatgagaacagtggctgcttttggtggtgrgaaaagagaggttgaaaggttggttaattggaatctgattctttccttaatttcatcaatcagcatagtaccctgagtctctcagtttgtgcaaagcggc

SEQ ID NO: 12684 - DNA, 201 bp, Homo sapiens
gaaatattttgctctattgcaagcattcagttagtctcacacaatttcatgatgctggcagaatacatgagcatcctgaatcacagtgttcatattcgggtttttttttttttttttttttttttggagatgcagtcttgctctgtcacacgagtaccctgaaccagagacaaaggactttattattcatagcaatagcag

SEQ ID NO: 12685 - DNA, 201 bp, Homo sapiens
aaatattttgctctattgcaagcattcagttagtctcacacaatttcatgatgctggcagaatacatgagcatcctgaatcacagtgttcatattcgggtttttttttttttttttttttttttggagatgcagtcttgctctgtcacacgagtaccctgaaccagagacaaaggactttattattcatagcaatagcagt

SEQ ID NO: 12686 - DNA, 201 bp, Homo sapiens
cagagctggattcaaacccaaatctcaggctaccctgctgaaggttctgtttacctccacttttagcagcagatgacagagctcacatcttagttcccaaraagaggcattttctgaattactttcccccttttctcaactgttgtattgaaagtactttcttctgaaaaaagaaattaacaaatatttcaaacattgcaa

SEQ ID NO: 12687 - DNA, 201 bp, Homo sapiens
acattgatttaattcatgttcatcttgattcaagttttagcttatgtggatgtcctgaaaattaattcaatctcaacaaaatatctgttcttctaattgayagataggtatttgtaaatcttctctacctatttttgaaaattttagtatgttccagaaagcaaagcaaacctaaacactagtaaagctaagctaaattct

SEQ ID NO: 12688 - DNA, 201 bp, Homo sapiens
agggcggttcttctgacctgggctgactcagtcaggcttctgtgtattcttctgtctccacatggcctgtctagcagatgagcttcttttcttcatattayggcctcagagttccaagtgccacaaaagagggcaagccccactgtgcaagtacttttcaagtctctccacgcaaagaaactttctaattttctgtttggc

SEQ ID NO: 12689 - DNA, 201 bp, Homo sapiens
gaatggacccagcaaatgattgggccttattaggagcccagttgccaatctagctaagcctcaatatacatgtaaggcgtaatttgtctgcttcactttcmctgtgtccatttgacttggaaaatgtgccaatgttccaagcacagcacttgggatgtagcatgctggggaaaaaaaaaaatggatgtgagagtcgccagc

SEQ ID NO: 12690 - DNA, 201 bp, Homo sapiens
tgataaatttcctcatctgtataaggagcaagaaaatctacctcactgggttgttttgagaatcataattcctaatttaagttacagcaggttaatctacrcatttgacatgtggcacatagcaaaaggttaatgaatgttagttttctccttcaacaaacttaccattacaaaaatagcaaagatgtgtgccaaaactac

SEQ ID NO: 12691 - DNA, 201 bp, Homo sapiens
gcatacttctgaccttcccagttccctcacctggcctaaattacaaaggttctgttatgcacaaaatccatttcaccacaaggcaatgtcattggagtatrttctttcatttttcttattgtaacaagatcctcagttacttgaacagatgtctgtaaattcagaatacgtttgagtgtagtttactaagcattatacact

SEQ ID NO: 12692 - DNA, 201 bp, Homo sapiens
ccttttcatctgtgttgatgaaaaaccaacacaattgcctaaaaaggcaaaataacaagacaaaaattctgtaagtcatcaccattggttttcattcaccrggttttccgccccacagaggactgtagtacatcgtcatcatattcttagctaactttcgtttaattactagcatgtttaaagtggaaccattatttaaaa

SEQ ID NO: 12693 - DNA, 201 bp, Homo sapiens
tctgtgtttgcgatgattttatgatcattttgtaaaaccactgcatcacggcctgttttaaacattataacttgagctgtttctgccgaaattgactcaarcattttgtcttcacaggtatgagaaaaatcttgtgttcgcccagcgttggggaattagaaaaggaatagtgatgggattctttactggattcgtgtggtg

SEQ ID NO: 12694 - DNA, 201 bp, Homo sapiens
ctcaacaaaatatctgttcttctaattgatagataggtatttgtaaatcttctctacctatttttgaaaattttagtatgttccagaaagcaaagcaaacytaaacactagtaaagctaagctaaattctgtaatctttctaaattggtaaaatttctccttcagttcagtaaatgtaaagtttctgtgtggtctattaaa

SEQ ID NO: 12695 - DNA, 201 bp, Homo sapiens
tttatgaatttggacagatatataatgacatggtaagaaaaattcattttaaacatgtaaatagatttatttttctatttataataaagttactttcttgyttactatctttccaagactttttcaattcctgataaagaggaacaaaggtcacagatcaatggtgtgtgcctactttttgtagcaatgggctgtgtatct

SEQ ID NO: 12696 - DNA, 201 bp, Homo sapiens
gctcactttttctcatgtattttttccactattttgaatgagatctttttctcaattatatctgtaaatgagttgagatgaaagctgttagtttttgtatrcttatcttaaggactttccaagctctcttataagttataattttagaaatttaatagtctactgggttttctaggtatataataaaataccagatatagt

SEQ ID NO: 12697 - DNA, 201 bp, Homo sapiens
taataaaataccagatatagttctgaaatattacaggtttggtttcagaccaccgcaataaagagaatattgcaataaagcatgtcacactaattttttcrcttcctagtgcatataaaagttgtgtttacactatactgtattctactaactatgcaatagctttatgtctaaaaataaacaatgtacatatcttaattt

SEQ ID NO: 12698 - DNA, 201 bp, Homo sapiens
cagggagttattaaccgattttaaaacttttgtctgagattgattagtaaagattatttcttgaaccaaattgttctttcgtttggctactttgattaaaraagaaagaagagataataattgcaatgattcttttattttattttatagggtcgttggctgtgggttgcaattaccatgtctgactcagtaattcttcga

SEQ ID NO: 12699 - DNA, 201 bp, Homo sapiens
tcaacaatgcagcatcttttctagaataactccataatattcatatcaaaggcacaaagcagagaatactttcatgcacattgcacttcatataaaataayatatacaatccattctttttctctttaaaatattactataatttgattttaaaaaccttttggaatatcccttctaggttaggttcaaatgtcccctctg

SEQ ID NO: 12700 - DNA, 201 bp, Homo sapiens
tatgaactacagtttaggttttggatacacttaggttttagctacacattttaaagtgtgttctaattaatatcttgtccttggggggtaaatgagggatrgtagcataaacacttctcaagtataagaattaagggaaacttgaatttaactgaaaaattgtctcgtggtccagttgggttgatctccagccacgtcttt

SEQ ID NO: 12701 - DNA, 201 bp, Homo sapiens
tataacttgagctgtttctgccgaaattgactcaagcattttgtcttcacaggtatgagaaaaatcttgtgttcgcccagcgttggggaattagaaaaggratagtgatgggattctttactggattcgtgtggtgtctcatctttttgtgttatgcactggccttctggtacggctccacacttgtcctggatgaaggag

SEQ ID NO: 12702 - DNA, 201 bp, Homo sapiens
tttctttacatatgattttttttaaaagtgctgtgcaacctgccagtgctacaatagaagtacaaggaaacacatataaattttataattttacctgtctrtgagatttgttgttaatttataatcttctctttatgtttaattttgcaaaatcagagagaaaaatatttctttacagaatgactttaattattttttgta

SEQ ID NO: 12703 - DNA, 201 bp, Homo sapiens
atgttatccaccattgctatatatttgaagcagagaaagttagtgaagcataaacttcatgctgaatcgagtgtctatatcctggaattctcagcctgtamcctctataaactaatttttccactgtgaataagactaatcatgactctgtcgacatttacattttatttagaaaatgtcttccttctgttcctttgatcc

SEQ ID NO: 12704 - DNA, 201 bp, Homo sapiens
tttctgcccattggtcaagtatgacataatattatgattcagaaccctgaaagattccaaaagttgtgatgttgtgcccatgctctctaggtgaccgtggrtggccatgacattcgctctcttaacattcagtggcttagagatcagattgggatagtggagcaagagccagttctgttctctaccaccattgcagaaaat

SEQ ID NO: 12705 - DNA, 201 bp, Homo sapiens
aatattttgctctattgcaagcattcagttagtctcacacaatttcatgatgctggcagaatacatgagcatcctgaatcacagtgttcatattcgggtttttttttttttttttttttttttggagatgcagtcttgctctgtcacacgagtaccctgaaccagagacaaaggactttattattcatagcaatagcagta

SEQ ID NO: 12706 - DNA, 201 bp, Homo sapiens
agttgtactgagtgcgacagctcttggaagagccttctcttacaccccaagttatgcaaaagctaaaatatcagctgcacgcttttttcaactgctggacygacaacccccaatcagtgtatacaatactgcaggtgaaaaatgggtaagtgttggaatactatgcagccataaaaaaggatgagttcatgtcctttgcag

SEQ ID NO: 12707 - DNA, 201 bp, Homo sapiens
tgtccactctgtgtgatgaaaatgtgcaatttagaaatccaaatgcagtactacttacctctgggtactgattaaggaaaaccttactgaaaacatctcaatgataactgttgacaccacttaatgtattttaaaaattattttgtcttatttcatatatactggcctaccttacagctttagccagttactatattatag

SEQ ID NO: 12708 - DNA, 201 bp, Homo sapiens
gtccactctgtgtgatgaaaatgtgcaatttagaaatccaaatgcagtactacttacctctgggtactgattaaggaaaaccttactgaaaacatctcaaygataactgttgacaccacttaatgtattttaaaaattattttgtcttatttcatatatactggcctaccttacagctttagccagttactatattataga

SEQ ID NO: 12709 - DNA, 201 bp, Homo sapiens
ctatgttttgtttgtgtcttaggttgtattattttcaatttttaaaaaaataccaattgaataaaatgtaaaaggaaacaaaataacgacatcccaaagargtgcaaagttgcttttcaagtcctctgtaatgcctgacagtccttgccaaccaaaaattcttttttaaaaaaaattgtggtaaaatatttgtaacacaaa

SEQ ID NO: 12710 - DNA, 201 bp, Homo sapiens
gtcattgctcaccatcacaacaacacattgaaatataaaactcacagttcatataaaataatcacacaaggaagaagagaaaaaaataaaatggcataacratttcatcaaactacaaagacaaaaaaaaacagaaaaagagggaaacaatttataaaataacttgaaaacaatcagcaatatgacaggaacaaagcctca

SEQ ID NO: 12711 - DNA, 201 bp, Homo sapiens
tatgttttgtttgtgtcttaggttgtattattttcaatttttaaaaaaataccaattgaataaaatgtaaaaggaaacaaaataacgacatcccaaagaastgcaaagttgcttttcaagtcctctgtaatgcctgacagtccttgccaaccaaaaattcttttttaaaaaaaattgtggtaaaatatttgtaacacaaaa

SEQ ID NO: 12712 - DNA, 201 bp, Homo sapiens
acacattgaaatataaaactcacagttcatataaaataatcacacaaggaagaagagaaaaaaataaaatggcataacaatttcatcaaactacaaagacaaaaaaaaacagaaaaagagggaaacaatttataaaataacttgaaaacaatcagcaatatgacaggaacaaagcctcacatatcaatattaaccttgaat

SEQ ID NO: 12713 - DNA, 201 bp, Homo sapiens
acagtttggttgtatacattttagggagacacgagacatcaatcaacatatgtaaggtgaacattggtttggtctggaaaggcaggacaagccaaagcagrgaggggtcttccaggtcataggtagataagagacaaatggttacattcttttgagcttctgattagcctctccaaaggaggcaatcaggcatccctttat

SEQ ID NO: 12714 - DNA, 201 bp, Homo sapiens
agtaatggggcgtaaaaagatattccatgcaaatggaaaccaaagttgagcaaaagtagccacacttatatcagataaaacactttaaatcaaaaatagtaaaaaaaaaaaaaagacaagataattatgtaatgataaattcaacaaaacgttataacaattctaaatatatatgaactcaacatcagagcacccaaattc

SEQ ID NO: 12715 - DNA, 201 bp, Homo sapiens
tatgtatacacacacacatatacacatatatatacatatttataggcgtttataggatatatatcctattttgtgtgtgtgtgtgtgtgtgtgtgtgtgtrtatatatatatgggagtaataggatatatatcattttatatatatataggagtttattaagtattaacttacacatgatcacaaggtcccacaataggct

SEQ ID NO: 12716 - DNA, 201 bp, Homo sapiens
gaaataatatgttaataaattctttaaaaaacaaaaccaaaggaaaaaaattttaagtacaattttaaaactgaactatggtctgtgaggctcttagaagaaaaaaactcactggactgatagtgctgtactgtagcacgtctcaactcctagacagtttaaccaaaaataccaaaaatgatatggcagaatttcaacgga

SEQ ID NO: 12717 - DNA, 201 bp, Homo sapiens
tctcttatgttgagcctttgggtttgccgtcaagtataggattgttattcaggtcgtgttaactgaactctcatgatggtgggctggggagcaatcatgcrtctttgcatcaactttccatcttctctttgcagacggtgcaggttgctctagacaaagccagagagggtcggacctgcattgtcattgcccatcgcttgt

SEQ ID NO: 12718 - DNA, 201 bp, Homo sapiens
accaaaggaaaaaaattttaagtacaattttaaaactgaactatggtctgtgaggctcttagaagaaaaaaactcactggactgatagtgctgtactgtagcacgtctcaactcctagacagtttaaccaaaaataccaaaaatgatatggcagaatttcaacggatcatggaatcctttcacttagggggaaatccctat

SEQ ID NO: 12719 - DNA, 201 bp, Homo sapiens
atgtccactctgtgtgatgaaaatgtgcaatttagaaatccaaatgcagtactacttacctctgggtactgattaaggaaaaccttactgaaaacatctcratgataactgttgacaccacttaatgtattttaaaaattattttgtcttatttcatatatactggcctaccttacagctttagccagttactatattata

SEQ ID NO: 12720 - DNA, 201 bp, Homo sapiens
gaactgtgagtcaattaaacctcttttcttcataaattacccagtgtcaggaatagcagtgtgagaacagtttaatagagataccaatgaaaaagaatttyttgaaatgccgggtaaataatttaaaatattgatttttaaagatagtaaaatgcaagagaaatctgaaaaccaatacaaagaaatcagaaatcaattcag

SEQ ID NO: 12721 - DNA, 201 bp, Homo sapiens
aggcaacaacctcaatatcagatgaatgaaatttttttctctcctaaggcaattccagtcaatgctttgatagtttcttttttaatgctgtatattctatraaactaattaactggcaaattacctgagtgaaagtcatattttctttcatttagtaatagagaaagatataggtcaaaatattaatacaactttgagttt

SEQ ID NO: 12722 - DNA, 201 bp, Homo sapiens
gttagaaaattttcatggcaattttcttattgagccttaatcaaagtcatgttgacttatcccctttctaaattataagcctctgaaagttagtgatacaycttatttgtgtttgaatcaacttggttacctaacccagtgccttgcacttagtaaggcatcaggagattttaaaaattagaatgaaaacatgaatttcta

SEQ ID NO: 12723 - DNA, 201 bp, Homo sapiens
aaatttttttaaaaaatagcttggctttgtggtgtgcccctgtcatcccagctacttgagaggctgagatgggaagatcacttgggtctgggtgtttgtgrctgcagttggctgtgattacatgggtgacagaatgagaccccatctcagaaaaaccaaaagagtcatgatccctatctgtgtgaagcttaagcctagtaa

SEQ ID NO: 12724 - DNA, 201 bp, Homo sapiens
acttttacaaaaccaggtgtttggattaaagtgaagagagccaaattgcccttccaacatctctacccactttctgtgaaaattttttaaaaaaccctaayttaaaattatttttaaaaagaaataatatgttaataaattctttaaaaaacaaaaccaaaggaaaaaaattttaagtacaattttaaaactgaactatgg

SEQ ID NO: 12725 - DNA, 201 bp, Homo sapiens
aattcacagcagagggaggaagtgggagtggtaagattagctttgggctgggagtggtcaggtcagcctgggcctctgagagccacacgtttcttattgcrtgggaagtttaaaaaatgggtgtggatgtagatgaatggcaaggagaggatgagtaggaagttgaatgagttgctttgtttttagaggaggtgagcatgg

SEQ ID NO: 12726 - DNA, 201 bp, Homo sapiens
atgatgaggctagacttttacaaaaccaggtgtttggattaaagtgaagagagccaaattgcccttccaacatctctacccactttctgtgaaaatttttwaaaaaaccctaacttaaaattatttttaaaaagaaataatatgttaataaattctttaaaaaacaaaaccaaaggaaaaaaattttaagtacaattttaa

SEQ ID NO: 12727 - DNA, 201 bp, Homo sapiens
agaatctagtaactaaattaagtagtcctcctacctctcctgctcttcacccatagatgatctctgaaccctttgtttttcaagtttcggttttcttcatyaactgacatttggctgatgtttgtgggaagtttgtgtgcatttctccatggaatagcccagccaggcgtgctactcatttttggcacaatgacagatgtt

SEQ ID NO: 12728 - DNA, 201 bp, Homo sapiens
ccaccctacacgcataacctcccccattatcaacatctcccaccagaatgatacatttcctacaattaatgaacatacattgacacatcattatcacagakccacagcttacattagggttcactcttggtgttgtatattttatgaatttggacagatatataatgacatggtaagaaaaattcattttaaacatgtaaa

SEQ ID NO: 12729 - DNA, 201 bp, Homo sapiens
agtaactaaattaagtagtcctcctacctctcctgctcttcacccatagatgatctctgaaccctttgtttttcaagtttcggttttcttcatcaactgayatttggctgatgtttgtgggaagtttgtgtgcatttctccatggaatagcccagccaggcgtgctactcatttttggcacaatgacagatgtttttattg

SEQ ID NO: 12730 - DNA, 201 bp, Homo sapiens; identical to SEQ ID NO: 1496

SEQ ID NO: 12731 - DNA, 201 bp, Homo sapiens
caaaggaaaaaaattttaagtacaattttaaaactgaactatggtctgtgaggctcttagaagaaaaaaactcactggactgatagtgctgtactgtagcacgtctcaactcctagacagtttaaccaaaaataccaaaaatgatatggcagaatttcaacggatcatggaatcctttcacttagggggaaatccctataa

SEQ ID NO: 12732 - DNA, 201 bp, Homo sapiens
aaaggaaaaaaattttaagtacaattttaaaactgaactatggtctgtgaggctcttagaagaaaaaaactcactggactgatagtgctgtactgtagcacgtctcaactcctagacagtttaaccaaaaataccaaaaatgatatggcagaatttcaacggatcatggaatcctttcacttagggggaaatccctataaa

SEQ ID NO: 12733 - DNA, 201 bp, Homo sapiens
gtatattttgttacaacatcgtaaaacatttctacaaacattttaagcagaaaacctaccactttttatgtttttttttcaaagtcctctttgctcttaakctaccaaatgtaggcgttcaatattttcaacatttatttggatacctatgatgtgcctgttactgcatgagtccctgtgggagagtctaaggaccatgaa

SEQ ID NO: 12734 - DNA, 201 bp, Homo sapiens
atccaattacactcttagttatttttaagtgtacaattaaattatttattatagtcattctattgtgctatcaaatagtatgtcttattaattctttctattttttttttgcaccctttgttttaattcttataacttgatacattttagtatctggtaaggcaaatccctgcacactaatttttcctcttcgaaattctc

SEQ ID NO: 12735 - DNA, 201 bp, Homo sapiens
gttatttttaagtgtacaattaaattatttattatagtcattctattgtgctatcaaatagtatgtcttattaattctttctattttttttttgcaccctytgttttaattcttataacttgatacattttagtatctggtaaggcaaatccctgcacactaatttttcctcttcgaaattctcttatctatttctggatg

SEQ ID NO: 12736 - DNA, 201 bp, Homo sapiens
actgtgaagtttgcctcatcaattgactcttcctctcatgaaagatttatttgtagcatgtaatgctgattgatagtattttacccacagtagaatgtctytcaaaattggattgagttctcttaaaccctgctgctacttttattaacatagcattttcaccaggagtggatttcatctcaagaaaccagtttgcttatc

SEQ ID NO: 12737 - DNA, 201 bp, Homo sapiens
tgcagcaatttaatgcagcacatcttcagactccacttctaattctagttatcttgctattttcatgacatctgcagttactccctctgaagtcttgaacyctcaaagtcatctgtgagggttggaatcaacttctttcaagcacctatttatgtggatattctgacctcctcccatgaatcacaaatgttctttcataaa

SEQ ID NO: 12738 - DNA, 201 bp, Homo sapiens
cataaatatatatatacatataaagtgtatatctatatatacactgtaagttctagggtacatgttcttaatggcatctagaatggtgaatcctttccagrgggttttcaatttactttgcccagttccctcagaggaataactatggcagatgtagccttgtaaaatgttacttcttaaataaaaagacttcaaagtgaa

SEQ ID NO: 12739 - DNA, 201 bp, Homo sapiens
gctattgctgcctcttcagtgagctgtctattccacttttttctttgtattataacgaaaatattattgtgtccttaagttctccagacactaaatatagraataataacagggcttgaaattaagagagagcagtcctaagaaactaagaaaaatgagtattagtaattgccatttatttatcacatattatgtgtcaga

SEQ ID NO: 12740 - DNA, 201 bp, Homo sapiens
gaatggtgaatcctttccagagggttttcaatttactttgcccagttccctcagaggaataactatggcagatgtagccttgtaaaatgttacttcttaartaaaaagacttcaaagtgaaaattactccctgacccatgggcagcagaattcatgttgggttaacaagcacaacaacattcatctccttgtacatctccg

SEQ ID NO: 12741 - DNA, 201 bp, Homo sapiens
tccagacactaaatatagaaataataacagggcttgaaattaagagagagcagtcctaagaaactaagaaaaatgagtattagtaattgccatttatttaycacatattatgtgtcagatactttattaaaatgattacttattgtcacaatgacccccaaaggtacataggcccatttgacaaacaaggaagcagagagt

SEQ ID NO: 12742 - DNA, 201 bp, Homo sapiens
ctttccagagggttttcaatttactttgcccagttccctcagaggaataactatggcagatgtagccttgtaaaatgttacttcttaaataaaaagacttmaaagtgaaaattactccctgacccatgggcagcagaattcatgttgggttaacaagcacaacaacattcatctccttgtacatctccgtcagagcacctg

SEQ ID NO: 12743 - DNA, 201 bp, Homo sapiens
ctccctgacccatgggcagcagaattcatgttgggttaacaagcacaacaacattcatctccttgtacatctccgtcagagcacctgggtgactaggtgcrttgtcaatgagcactaatatttttgaaagctgtattttttcctgaacagtaggtgtcaacagtggcttaaaatattcaaaaaactgtgttttcaacagat

SEQ ID NO: 12744 - DNA, 201 bp, Homo sapiens
gctgatgtcataatttttgttttacatttcttgaaaattattgcctgaaaactatgcatgaatgcttctaggcaggtctttccgggaggaaattcactcaraaatggcattaaaaatagttatttaagaacaataatgccttatttttggtgctgtgagccttctttcacacatggggaaagtgaagctctgtagggtaaa

SEQ ID NO: 12745 - DNA, 201 bp, Homo sapiens
gcattaaaaatagttatttaagaacaataatgccttatttttggtgctgtgagccttctttcacacatggggaaagtgaagctctgtagggtaaagtccaraagacatgggcctgcttaagtgtcagagctggattcaaacccaaatctcaggctaccctgctgaaggttctgtttacctccacttttagcagcagatgac

SEQ ID NO: 12746 - DNA, 201 bp, Homo sapiens
agtttcttttttaatgctgtatattctataaaactaattaactggcaaattacctgagtgaaagtcatattttctttcatttagtaatagagaaagatatmggtcaaaatattaatacaactttgagttttgtcccagacaacatttccagatctcgattccctccctccctcccttccttccctttttccttcataactc

SEQ ID NO: 12747 - DNA, 201 bp, Homo sapiens
ccttctggaggccaacttgaggatttgcctcattgtctcttccttacctttataaacagtgctgataataaaaacagagtgctatttggtaggaacatctrggcatgatcaggtagccttcccctaaggtaatgagatgactgcattggtaagtcaaagaacagctgccccaagtctgcacaggaacctgaccactccacc

SEQ ID NO: 12748 - DNA, 201 bp, Homo sapiens
aatatcagatgaatgaaatttttttctctcctaaggcaattccagtcaatgctttgatagtttcttttttaatgctgtatattctataaaactaattaacyggcaaattacctgagtgaaagtcatattttctttcatttagtaatagagaaagatataggtcaaaatattaatacaactttgagttttgtcccagacaac

SEQ ID NO: 12749 - DNA, 201 bp, Homo sapiens; identical to SEQ ID NO: 1490

SEQ ID NO: 12750 - DNA, 201 bp, Homo sapiens
agttagaggcaacaacctcaatatcagatgaatgaaatttttttctctcctaaggcaattccagtcaatgctttgatagtttcttttttaatgctgtataktctataaaactaattaactggcaaattacctgagtgaaagtcatattttctttcatttagtaatagagaaagatataggtcaaaatattaatacaacttt

SEQ ID NO: 12751 - DNA, 201 bp, Homo sapiens; identical to SEQ ID NO: 1492

SEQ ID NO: 12752 - DNA, 201 bp, Homo sapiens
  misc_feature (1)...(201): n = A,T,C or G, or insertion/deletion polymorphism (see Tables 1-2)
ccacctatagttttccaggcattgtaactaatgttgggcatagagtggaggacaagaaaatcattgtgtgtttgtgtgttgcttgcacaaagctgacattntagtagggagaagctggggaagtgcatttcactgggcaatgatgttagtgtagaaggtgtagggaatagggttggatcagaaagaatccaagcctgtgtc

SEQ ID NO: 12753 - DNA, 201 bp, Homo sapiens; identical to SEQ ID NO: 1495

SEQ ID NO: 12754 - DNA, 201 bp, Homo sapiens
actccagattccaggaaaagcatgtgtgaataacaccattgtatggactaacagttccctcaaccagaacatgacaaatggaacacgttgtgggtaggttrtttttgtttttaattttttacttttttgctcatatcttaaattgtaattcaaaatgtatagaggggattttactggctgagctggagtggtatctaacac

SEQ ID NO: 12755 - DNA, 201 bp, Homo sapiens
  misc_feature (1)...(201): n = A,T,C or G, or insertion/deletion polymorphism (see Tables 1-2)
tcttttattccctcgacagatctgtattgattgtcttccccagacatggtgctgtggactggggaatgcatatcggttatgatgctttccctagtggagtnttcagtctgtgaggaagataacatcaacaaaaaaaaacccactcatcattcaacagatatttaccacctatagttttccaggcattgtaactaatgttgg

SEQ ID NO: 12756 - DNA, 201 bp, Homo sapiens
aactgtcaacttgtacaaggtgatggggccaggactagggcccaggtttaccgaatcctagtctatagaatttgccaacatatcacattgtcagagcttaktaaatgataaaagcttacattttagttccctactccatttctttctctcacatcacctctcctgaccgtaaaaatgaccccacaagcatgagttgtacag

SEQ ID NO: 12757 - DNA, 201 bp, Homo sapiens
aattatttcatagtcctagcatctctgcctataaaaatgaaggggatatgcatattttctgtgattggtaccatgaggtctgtttagaaatttggttggayttattataattttgcatagataaaatgtcttactcatgtctaatagaaatatactatatatagtatatttattatatattatatatatatttaaaatata

SEQ ID NO: 12758 - DNA, 201 bp, Homo sapiens
cctggagaaaatctcatcagaggccctatttcctcatatcatttgtaaccatgctaaagtgaacacatcaggtatgagagaaagatatcaagaccacaatytaagccagaaggaaagtaaaggaaatagactgttgccaaggcagcaattagcagaaccatgtgggtttggaaagtatttgagccttaggtggttttttga

SEQ ID NO: 12759 - DNA, 201 bp, Homo sapiens
tattctatttatagaacataggcagaggagatttagcatgcctcttaggggcctagaatttttggaatggtaagcttcaacttaaagtcatcagctgcatyatcccctaacaagagagtcagcctatttttcgtaagtttgaagtcaggcattgacttctcctctctagatatgaaagtcctagatggcatcttcctccaa

SEQ ID NO: 12760 - DNA, 201 bp, Homo sapiens
tctcaaatcaaggaggatctcatatatgggctcttatgtggacacagggagaaggagattgaaaatataaacctaaaagaaatgcagaaatgaggaataawgtccccttgcttcccacatcaaatgtcacaaattccatatttttcttatattcctaagtggatttgacatcctccatcctataggaggactcactcactg

SEQ ID NO: 12761 - DNA, 201 bp, Homo sapiens
agccacctttatcaatgaccttagctagatcttctggagaacttgtggcagcttctacattagcactgctgcttcaccttgcacttttacattgtggagaygcttttttccttaaacctcataaagcaacttttctcccaaagcttcctcacttctctcagccttactagaattgaagagagttagggccttgttctgaat

SEQ ID NO: 12762 - DNA, 201 bp, Homo sapiens
gactctctgtgatttattctcaagagataaaaatctacttactctcaccactccctccttttgcctacctcctcccaatatagttatatcattttttaggycttctatttataaatttgtaaacttctgatctgcttccgttgctcttccaccacctgtagatagttcctcttgaattctcactttctaaaagaaaaatgt

SEQ ID NO: 12763 - DNA, 201 bp, Homo sapiens
tgtggcagcttctacattagcactgctgcttcaccttgcacttttacattgtggagatgcttttttccttaaacctcataaagcaacttttctcccaaagyttcctcacttctctcagccttactagaattgaagagagttagggccttgttctgaattaggtttggcttaaggcaatgttgtagcaggtttgatcttgtc

SEQ ID NO: 12764 - DNA, 201 bp, Homo sapiens
gacctcaggtaactttctttctaggtcgttttaagtgtaacattatttttagtctttaggagaacaaagctatagggtttggacagttactggcttctgtratgtcatatcttccagctattctcttctattcagaatgtcaggaatagatggcaagaaaatccccttatgttagactgggaatagggggagtcaaatgtc

SEQ ID NO: 12765 - DNA, 201 bp, Homo sapiens
cacttcactttcttattatttgtgtgttcactagaatagcacttttaatttccttcaagaactttttttttctgcattcacagcttgactatttatttagycctatctcaggactaaatgaggctaaaatgaggcctaacttttagcctatctcagccttcaacacaccttcctcactgagcttagtcatttctagctttt

SEQ ID NO: 12766 - DNA, 201 bp, Homo sapiens
ccctcctattgtgtaagaatgtgtgttcaaggatatttatcattttttatattaaccaaaaaattaataaaattccctggaaactacccaaatatccatcacaaacagaaaaagagttgaatcaattatgatacatttatactaaggaatattgcacagctattttttaaagtgttcctatatattgatctggaaggatag

SEQ ID NO: 12767 - DNA, 201 bp, Homo sapiens
cctcctattgtgtaagaatgtgtgttcaaggatatttatcattttttatattaaccaaaaaattaataaaattccctggaaactacccaaatatccatcacaaacagaaaaagagttgaatcaattatgatacatttatactaaggaatattgcacagctattttttaaagtgttcctatatattgatctggaaggatagt

SEQ ID NO: 12768 - DNA, 201 bp, Homo sapiens
ctcctattgtgtaagaatgtgtgttcaaggatatttatcattttttatattaaccaaaaaattaataaaattccctggaaactacccaaatatccatcacaaacagaaaaagagttgaatcaattatgatacatttatactaaggaatattgcacagctattttttaaagtgttcctatatattgatctggaaggatagtt

SEQ ID NO: 12769 - DNA, 201 bp, Homo sapiens
attagaaaacacaaaccattggcttatttttatttagtttatattaaggttttagaataattttagaataatttagaataattttagaataatttagaatatttttttgccaacatgtaaaaatctggggctacaggctgggtgcggtggctcatgcctgtaatctcagcacctcaggccgaggcgggtggatcacttgag

SEQ ID NO: 12770 - DNA, 201 bp, Homo sapiens
gtgagtacgaagtcagagccattccctatgagagacaaggatggggagaagtagaatgaccagagtgtacaggttgagcatccctaatctgaaaatcccamatccaaaatgttccaaaattcaaaaatttttgaatgccaacatgattccacaggtggaaaatttcacacttgacctcatgtgatgggtcacagtcaaaat

SEQ ID NO: 12771 - DNA, 201 bp, Homo sapiens
agtgttctatctgcttcctttaccgcctcctaagtgtgggacctcaatactttcttcactgtcagcatcatcatcaccaacatcattactaccattgaagwgactagcactggattaatcatctttacacacattatctcatttgatcctgtaataatcctatgaaatatatgctatcattatccctgtgttgcagatgaa

SEQ ID NO: 12772 - DNA, 201 bp, Homo sapiens
tggtgaaaccccgtctctactaaaaatacaaaaaaattagccgggcgtggtggcgggcgcctgtagtcccagctactcaggaggctgaggcaggagaatgrcgtgaacccgggaggtggagcttgcagtgagccgagatcgcgccactgcactccagcctgggcgacagagcgaaaaaaaaaaaaaaagaaaaagaaaaag

SEQ ID NO: 12773 - DNA, 201 bp, Homo sapiens
gggagaaaggtgttacttcttcttgggggattatacaagattgatgcacgagaaggtatgtgactagaaccttgaggctgaaaggattcagcaggcatgargaaagaaaagctttgcaagacagagcaaggatattagctatgtaaaagaaaaagacaaataagatggtttccaaaagcctttatcaacactgagtaccag

SEQ ID NO: 12774 - DNA, 201 bp, Homo sapiens
ataatgccttatttttggtgctgtgagccttctttcacacatggggaaagtgaagctctgtagggtaaagtccagaagacatgggcctgcttaagtgtcaragctggattcaaacccaaatctcaggctaccctgctgaaggttctgtttacctccacttttagcagcagatgacagagctcacatcttagttcccaagaa

SEQ ID NO: 12775 - DNA, 201 bp, Homo sapiens
aggaaactctgagtagactgccaggtcttgtcaaatatgaacatgcaagtgatccttggttgctatattgacatttctctccccaattcatgggtttttgkttagcttctcatcttcttggggataagggttacaatggagatgctttatggttaaaattgttgtgtattgagcttagaaaggggacttcttttaaaaaaa

SEQ ID NO: 12776 - DNA, 201 bp, Homo sapiens
ttgctttatattcactgagagctgattaaattgtgcccaccagattaagggtgggtctgccttccccatactgctgactcaaatgttaatctcctttgtcracaccctcacagactcacccaggggatcaatactttgtattcttcaatcaagttgtcactcagtattagccatcatatgggcatatacaaagggaaagaa

SEQ ID NO: 12777 - DNA, 201 bp, Homo sapiens
tgctcgtttacatttttttcttcttgctttatattcactgagagctgattaaattgtgcccaccagattaagggtgggtctgccttccccatactgctgaytcaaatgttaatctcctttgtcaacaccctcacagactcacccaggggatcaatactttgtattcttcaatcaagttgtcactcagtattagccatcata

SEQ ID NO: 12778 - DNA, 201 bp, Homo sapiens
acatattttaaaaaatcatcaataacaacctcccaagtctgtcaagactgttagacaaccagttcagaagtccagtgattccccaggcaaacacattacaraaaggaattcaccattatatattatgttcagaatgtctaaagtcaaagtaaaagaaagaatttttaaattagcaagagtaaagcatctactcatctataa

SEQ ID NO: 12779 - DNA, 201 bp, Homo sapiens
ttctacaattttaaaaagaagtgatgtaattgtcctcacccaagtattttctacagagtgtgccaagctttggtcgtacctgcctagctgcaactgaaacracgatttggaaccattggatactctgattagtatagatataattaccacagtggtccattctccatctatattgggactgaatccattttgtccatctgc

SEQ ID NO: 12780 - DNA, 201 bp, Homo sapiens
ccgctcaaacattggaattgtttcccaggaaccagtgttgtttgcctgtagcataatggacaatatcaagtatggagacaacaccaaagaaattcccatgraaagagtcatagcagctgcaaaacaggctcagctgcatgattttgtcatgtcactcccagaggtgagtacgaagtcagagccattccctatgagagacaa

SEQ ID NO: 12781 - DNA, 201 bp, Homo sapiens
cacatacatacacagtaggattgctattgtggggatactaaattttcctgagagacatacaaacaagactctagtttttagcaagattcatagttatattwatatgtcccactatcttgctcactttttctcatgtattttttccactattttgaatgagatctttttctcaattatatctgtaaatgagttgagatgaaa

SEQ ID NO: 12782 - DNA, 201 bp, Homo sapiens
ttttgctgtgttgtctaacaggagcaaagagacacggatttgctctgtgctttaatcctctgagatagatatttaggaccgtgaccaatttttattttggytgaaaaatcttatttgaagttgagctaaagaggaatatttacacagcccagtaaaccctggaataaaagcataaatcaattcctttatttcacacataaa

SEQ ID NO: 12783 - DNA, 201 bp, Homo sapiens
tagctttgggacaattatcctttctgagattgtctatttcatctgcaaaatgcaagaaaataacgttaaaatgaagaaaacacacttaatagccacacaawgaaagcggccgctggtattactgccatcatcattatttcattacttggcaatgtgtaccgtgggtggtgggtaagttacacctgccttactgtctcttac

SEQ ID NO: 12784 - DNA, 201 bp, Homo sapiens
caattatcctttctgagattgtctatttcatctgcaaaatgcaagaaaataacgttaaaatgaagaaaacacacttaatagccacacaatgaaagcggccrctggtattactgccatcatcattatttcattacttggcaatgtgtaccgtgggtggtgggtaagttacacctgccttactgtctcttactttgccaaacc

SEQ ID NO: 12785 - DNA, 201 bp, Homo sapiens
tttataaattttgtgggtttgtggaaggctttttgtttgctcttttcacaaagtctcctaagttttaggctcttggcccagttcttacctgttagcccaawctataagcacatggaaattactatttgctgaatccagagatcaaaagcaaagattgtgtgtctcctggaagattcatttatcccacaaacccttattgaa

SEQ ID NO: 12786 - DNA, 201 bp, Homo sapiens
atggaaaagggttaataaaatttgacttatgaaatttctaatctcaagtaacattatatggtaaaatgttgctctgttttggtattttaaagtattttaayacttaactaaattccacaagcccaagcattggtgaaatcctttctttttctcatgttgatggaaaaggcctaaccttactttctgtagattgggaaatac

SEQ ID NO: 12787 - DNA, 201 bp, Homo sapiens; identical to SEQ ID NO: 1498

SEQ ID NO: 12788 - DNA, 201 bp, Homo sapiens
agagtataacattatgaagagaaatgctaagaaaattttgaaaaaggcaactaaagatttccttgtataaagcaaagcaaggaaacaagcaaacagaaatkgacagaatccaggaagttataaaaataaggactaagtattgattgcctataatttataatcccttctgttattaagttgaggtataaagattgtaaattt

SEQ ID NO: 12789 - DNA, 201 bp, Homo sapiens
gcgttatatagatggtaaaggaaacaactgaagctcaggaagctaagctatctgatcaagttacagcactaaaaccaaggcttctaactttcaattccatcccccccttttttttttttttttaaccctgcgcaaatagaagaggcttcctagagtgtgttccgcacgcagtagaagcttcatgcttattggctgagtgaa

SEQ ID NO: 12790 - DNA, 201 bp, Homo sapiens
caaacttctgccttcaggtcatcacaccaaccacgccaccctgctctcttcctgtgtgtctgtctggttacagggtgatctctgcagttgtactgagtgcracagctcttggaagagccttctcttacaccccaagttatgcaaaagctaaaatatcagctgcacgcttttttcaactgctggaccgacaacccccaatca

SEQ ID NO: 12791 - DNA, 201 bp, Homo sapiens
tacaacaaggaaactctgagtagactgccaggtcttgtcaaatatgaacatgcaagtgatccttggttgctatattgacatttctctccccaattcatggktttttggttagcttctcatcttcttggggataagggttacaatggagatgctttatggttaaaattgttgtgtattgagcttagaaaggggacttctttt

SEQ ID NO: 12792 - DNA, 201 bp, Homo sapiens
acaacaaggaaactctgagtagactgccaggtcttgtcaaatatgaacatgcaagtgatccttggttgctatattgacatttctctccccaattcatgggtttttggttagcttctcatcttcttggggataagggttacaatggagatgctttatggttaaaattgttgtgtattgagcttagaaaggggacttctttta

SEQ ID NO: 12793 - DNA, 201 bp, Homo sapiens
ttaagacctaatgaaaactctaagttttacacaatatttttaatgcagattagttaattgattatttttaagaatacaaggtaatgaaaactggacttcgsagggttaattgtcttagacaaactattctaacaaacacagaatgtgtgaattctagatatttagcagattatttgctcatatgtagaaatccttttataa

SEQ ID NO: 12794 - DNA, 201 bp, Homo sapiens
tttatagtatttctcaatgccccacacagtttatctacttggcaatggcatcaatgacagtgattattttcccctaagttgtagatgagtagctaaaaackaaagtcagctcctgaaataaacagaatgaattcagagagcaggaaatttataacatgatctaacaatgtaagagtctaatgttttagataattgatgtac

SEQ ID NO: 12795 - DNA, 201 bp, Homo sapiens
atgctaaatgtcatgtggcaataacttgcacaataatctcatgacagctactcataattttcttgtgcttaggcagctaatattgtgtcaaaaacaattcrttgtatatctccattctaagcaacaacaactacaaaaaccaactcctcagcattatacttcaatggattttgccaccgatggcctgctaagtcaaagaag

SEQ ID NO: 12796 - DNA, 201 bp, Homo sapiens
caggtgtatcaggatctgagagactccaaatttcgtgggcaagacactacaccactgtcctctaaatactacgaggtatttgcacaccagtggaaagaaayctttttaaatggagagctaagccaagggaaaaaataaatggagactaaatttttttaatattgtattttaaaattaggaaatgcaataacacatctgtgg

SEQ ID NO: 12797 - DNA, 201 bp, Homo sapiens
tacatggtggtctttctctacctgccctggtagccaaagacaaaggcccaattctcttgggaactctgtggccctgcccactgcttgggaaacctgaatasataaccaggtgtcctgagggcaactttgcattctccctataggaccatagctgatgcactcttgaaagtgccacctcctagctagaggccaaccaacata

SEQ ID NO: 12798 - DNA, 201 bp, Homo sapiens
atatagtcttttccagacaaacaaatgctgagggaacttgccactaccaagcaaatcagggaaatgcaaatcaaaaccacagtgtgttatcatctcactcytgcaagaatggctataatcaaaaaatcaaaaaagaatagatgttggcatgaatgtggtgaaaagggaacacttttacaccattggtgggaatgtaaacta

SEQ ID NO: 12799 - DNA, 201 bp, Homo sapiens
ctatagataaatcaaaattgaattctaaaaaaatgttcaagcagcccataggaaggtaagagaaagcaaacacagaaataacagagagaacaaatagaaamcaagaaagaaaatgacatatttaagccctaatatatcaaaatataagcaagattttttgtagatatagaaaagattaccctaaaatgtttatgaaaatgt

SEQ ID NO: 12800 - DNA, 201 bp, Homo sapiens
aaataatgacattaattatctaattgtagttgttttaatttagttcatggtgatctaaaagaaacccttccttattcacatttaagaggcagtttataaaktcaagaaatgtgttgttaacatggtgactatggttaataacatcacattgcatacttgaaaattgctaagaatagatttttaagtgttctcatcacacac

SEQ ID NO: 12801 - DNA, 201 bp, Homo sapiens
agctatatatgagacaaagcccattgttaatggctagatcatggaattactgaaacctattccttgcattggacttccacatagtttcagttatccatgtytcatggctgtgaacctgaccagtgtgtcacaacacagcgtctcagccacagggcagatgggtgagttatagatgagttggtgcaaacactagttccaagc

SEQ ID NO: 12802 - DNA, 201 bp, Homo sapiens
atgtgtcgagggacagacctggtgggaagtcattggatcacaggagcattttcccccatgctgttcttgtgatagtgagggagttctcatgagatctgacrgttttaaagtggcagtttcccctatgcgctctctcctgccaccatgtaagacatgctttgcttcccctttgccttcaaccatggttgtaagtttcctgag

SEQ ID NO: 12803 - DNA, 201 bp, Homo sapiens
agtagaaattggcaatactttgtggaaccaaaagacaattatctagagcaagtgatttaatataagattgcttcaaaaaaaatattttacctttaaaatargaattgtttttaagattctttaggctaagtgacatttttttccaaaggcaaataatcacctttcttgaataaagtgaaataatctagattatctgttata

SEQ ID NO: 12804 - DNA, 201 bp, Homo sapiens
aaaaaatattttacctttaaaataggaattgtttttaagattctttaggctaagtgacatttttttccaaaggcaaataatcacctttcttgaataaagtraaataatctagattatctgttatattttatagttctaaagttatgtgacagagaaggtaggccacacgcaacacaaagaaagaggtgatatctgatgtgt

SEQ ID NO: 12805 - DNA, 201 bp, Homo sapiens
caaaggcaaataatcacctttcttgaataaagtgaaataatctagattatctgttatattttatagttctaaagttatgtgacagagaaggtaggccacaygcaacacaaagaaagaggtgatatctgatgtgtggtttgcatgaaagaagatgcaattgagcaaaacacaattatgaaatttaaaatgtataattaatgc

SEQ ID NO: 12806 - DNA, 201 bp, Homo sapiens
tatatgtatacacacacacatatacacatatatatacatatttataggcgtttataggatatatatcctattttgtgtgtgtgtgtgtgtgtgtgtgtgtrtatatatatatatgggagtaataggatatatatcattttatatatatataggagtttattaagtattaacttacacatgatcacaaggtcccacaatagg

SEQ ID NO: 12807 - DNA, 201 bp, Homo sapiens
ttcgtatagccaaagcctgcttttctaataagattagcttttagtccaatttctcacatttccagaggtgaaagcctaagggtgtcagggtactggggaaygaggtacacatgtatatgggcgagtcggggggtaagggtggagatggtctgagaaaggtttggagggcattaggaaaagtggtcctataggaatcggttc

SEQ ID NO: 12808 - DNA, 201 bp, Homo sapiens
tgtaaggcgtaatttgtctgcttcactttccctgtgtccatttgacttggaaaatgtgccaatgttccaagcacagcacttgggatgtagcatgctggggaaaaaaaaaaatggatgtgagagtcgccagctctggatttgtagtaggtctctactctgtactatctgtatatatttaggtgagtgatttatccttgataa

SEQ ID NO: 12809 - DNA, 201 bp, Homo sapiens
atgaaaaagtttgaatattttgagaattactaaaatgtgatgcagaaacataaaatgaacacataccattggaaaaatggcaccaatagaattgctctgcrtatacagggttgccacaaaccttccattagtaaaaatcacaatatctgctaagcaaaaaatgcaaaaaagatcattttgtcttttcttttctttttttat

SEQ ID NO: 12810 - DNA, 201 bp, Homo sapiens
aaaaagtttgaatattttgagaattactaaaatgtgatgcagaaacataaaatgaacacataccattggaaaaatggcaccaatagaattgctctgcatayacagggttgccacaaaccttccattagtaaaaatcacaatatctgctaagcaaaaaatgcaaaaaagatcattttgtcttttcttttctttttttatatt

SEQ ID NO: 12811 - DNA, 201 bp, Homo sapiens
acagtggtccattctccatctatattgggactgaatccattttgtccatctgcattgactaaatagctgtgtattacagcagcatgtaactttgtaccaaygagcaggctaacttcaatgagaatcaaagtggtatcttataatagtcttgtatcaacttcaaaaatataattatagagcaagcattaatcttcattgaat

SEQ ID NO: 12812 - DNA, 201 bp, Homo sapiens
gctaggtgggagggagtctctggaggtgtcccagaagtttggtggcagggagtagcgttgaggagtggtttaatgcctggtcataatgagtcttggcaagrgtctgaatgtgcaagagcaaggaagagggagggcttgaggaaactgcatggtgttgaacctgggtgactaagaggatggaagtgccattaacagaaaatg

SEQ ID NO: 12813 - DNA, 201 bp, Homo sapiens
gtctcaaaattattcttgtcagcatctccttgatgccttgagatggaatcgtttaactatttaatggcttcaacaaaatgagttctctatcatgcatatartattacacaggcatggcaaacataacagagttttcctttttcacagacatctcatctctgattgggtattctttactacctaccaccataactgcactct

SEQ ID NO: 12814 - DNA, 201 bp, Homo sapiens
acaaatgggaagggtctggcctatagaaaccatcacagaccaggatcatttgatcacctgaaaaagactacattcatgcagggccactctttggcttggcratagactgtggccaatgaaacatcctctatgcgagtcacaagagtaggaccattctttggttgacagggtagagaggaggagactggtattccttctgga

SEQ ID NO: 12815 - DNA, 201 bp, Homo sapiens
taatctttacaacaatcttataaagtgagcactaacatcattttaaatataagaaactaggctcagaaaggtaaggggatttgtctgggactgcacagctrgcagagtaggattcaagtctaaggggctctgactccaaaccccactcactctccaatatgcctattgttctccatgtcctcccaagcttgggcacttccc

SEQ ID NO: 12816 - DNA, 201 bp, Homo sapiens
caaaatcttaatggggtttagcaatggaaggaaatgaaggatttaaaggactgcatggctcaagtgaggttgacaaataggtgtggaaggaggaaggaagygagaaaatgaggtacatgggcagtcacagagtgccaaggagttaaacatgtcagacagtagttcctggtgacagcaaggtccagggtgtattcatggact

SEQ ID NO: 12817 - DNA, 201 bp, Homo sapiens
aaggagttaaacatgtcagacagtagttcctggtgacagcaaggtccagggtgtattcatggactgcgtgactcaggttaagtcaagatccccgaagttgwagaggtcaaatacaggttaaacatggccttatgggaaatgaaatgaatgggaaatattaaggaaatatgattctatgaaaagtgtgggcatgttcttgaa

SEQ ID NO: 12818 - DNA, 201 bp, Homo sapiens
aaggtgtagcatacattgagactgtcctggcatgcatagttaacttaatgatttgttactgaattgatgggacacgcttcctacatggtaacagtgttcartgaataaccagtcaattccattcactgtataatgtaactgaatgtgcagatacagtcagatgtggcatagcaacatttcagtcagtgattgatttcatat

SEQ ID NO: 12819 - DNA, 201 bp, Homo sapiens
gacaacccaataattttagcaacaaaagcatgtgtgtgtaatgacaggagctggttttactattttattatattggtttccacatgtcaattgtaatctaktagatggaatttttaagttaaagccttccagatggctgtcagtgaattacactgataaggattacagagtgtcaggtctcttgattagcttatcagaatt

SEQ ID NO: 12820 - DNA, 201 bp, Homo sapiens
cagtgacccaacatcgcgccactgccctccagcctgggcaacagagcaagaccttgtctcaaaaaaaaacaaaaccaaaaaaccaaaaaacaaaacaaaamacacacacacacaaaagaactataatgacataggacctcttgacaatgaaactaaaattcataaagatttgccttcaaaattctaaggggaatcattcta

SEQ ID NO: 12821 - DNA, 201 bp, Homo sapiens
acacagtcactatgctactgttttctttgtgataagcctgacaggccaccttgtaatcagtgagtctgtcgtgtactcagggctgactcactgtcatagcrtggcctttgcagtgtgcctcatgctggctcaagttcagaacagcttatttgcacataggaacccacatattcaggttcaagaatcaagggtggggcacat

SEQ ID NO: 12822 - DNA, 201 bp, Homo sapiens
ggttttcaaaaatatagatgcaaaaaaaaaatgagctgtggatgcatgtttagaggggagaaagtttgtttctaggatctaatttcagtttttaggtcacycaagccagtgggagtcacatattgctaatggcttgagcacagagatcaaatattattcacacttcagactgggaataaaagacagtatttgtcaacattt

SEQ ID NO: 12823 - DNA, 201 bp, Homo sapiens
ttatccaccattgctatatatttgaagcagagaaagttagtgaagcataaacttcatgctgaatcgagtgtctatatcctggaattctcagcctgtacccyctataaactaatttttccactgtgaataagactaatcatgactctgtcgacatttacattttatttagaaaatgtcttccttctgttcctttgatccaag

SEQ ID NO: 12824 - DNA, 201 bp, Homo sapiens
agggctggtgctccacacaatttttagggtaggtaaatcaggtcctcagagatttcttcctgggcctcaggctgccctgaactgatctcacagtacagggrttgacattttctgcaaagagctgtatagtgaatattttaggtatgggagagagaaagggccatacattctgtcactgtagcacagaagcagccaaagata

SEQ ID NO: 12825 - DNA, 201 bp, Homo sapiens
agatgcttcaatggtggccagcagtttcctcagggtcttctcagcagtgcatggggcccacattagctcctctggctccaagcgaagagatggtctctagmcccctgtttgatttggggcacttacagtcctctcgccagctaaactctcacactcgtcagcatccagacgctgaggggaaaataccagctgcttctgtgc

SEQ ID NO: 12826 - DNA, 201 bp, Homo sapiens
aggtcactgtgcaacccacaaaataccaaacaccttgctaaatgaatggctgttatttctttatctagtcataacatagtcccagctttttaacagcatcyaatttagaacaaatacccactacattagatccttccccaaatcatctgactaaagcccgagttctgtaacaggttctttctaacaccattttactgagat

SEQ ID NO: 12827 - DNA, 201 bp, Homo sapiens
tgtttggctgttgtgaataattctgctctgaacgtgggtgtacaaatgagaaattcttgatttagcctgttagtctccaaggaagtcagcactaacacatrggaatgctttgggacacaattttatattccatttgtgtcttcaattcagtataaagatgcaaattattcctgaataacagtgccttagcatcgaatggtt

SEQ ID NO: 12828 - DNA, 201 bp, Homo sapiens
tagcaattatctctttaattattacacttctgtcattctccactctctgcttctgggattccaattaggtgaatttagaagattttcataactcccccttyctctcttttatttgtacatgtgtgtatatatgtatgtaatacatatcacggtctcctcctgtgacctccatgggtctgcatttcatcataaggaatagat

SEQ ID NO: 12829 - DNA, 201 bp, Homo sapiens
tctggctccaagcgaagagatggtctctagccccctgtttgatttggggcacttacagtcctctcgccagctaaactctcacactcgtcagcatccagacrctgaggggaaaataccagctgcttctgtgctctgcttactcttcggtacttctctgccatttctggttcctgaagatgtttatttttatttatttgagtc

SEQ ID NO: 12830 - DNA, 201 bp, Homo sapiens
taatagactcgtagttgtaatgtcctgtcctccccctgcctttccctacttcatcctctcttctatatccagaaatggacatttgcaggtgtgtttgtagsgggcagttgagtagcttgaagaatgtggggcagggggagatagaggaaagcaaaatttactttctttttctcgcattgctaaagtctcaacaaactgcat

SEQ ID NO: 12831 - DNA, 201 bp, Homo sapiens
tatatgttatatgtcatatattatacccaatcatgatatctgcatgtgtctctggcgtttgtctataaattatgcaatggccattggctaatagcaatgamctatgacatggtctaacttaacactttattagtataatgactgaaacactttagtcttacagaatgtcctatttggaatttattctttgaggaggttctt

SEQ ID NO: 12832 - DNA, 201 bp, Homo sapiens
tcattttgatatatcaacaaccagacaaccctggatgaagcttaccatagaccaaatttggaccagatttcttcctcctgtcaatgatgttacagtgagamtctaatattgtattaaacccatgccacatgttaaatgaatctgaatgacagactgacttacctaatttcttggacttcacattttcttttcttctttttg

SEQ ID NO: 12833 - DNA, 201 bp, Homo sapiens
agacaaccctggatgaagcttaccatagaccaaatttggaccagatttcttcctcctgtcaatgatgttacagtgagaatctaatattgtattaaacccawgccacatgttaaatgaatctgaatgacagactgacttacctaatttcttggacttcacattttcttttcttctttttgatttttagagtgtgtccaagtt

SEQ ID NO: 12834 - DNA, 201 bp, Homo sapiens
taaatgaatctgaatgacagactgacttacctaatttcttggacttcacattttcttttcttctttttgatttttagagtgtgtccaagtttacggactaygagctgaaggcctatgccaaagcaggggtggtggctgatgaagtcatttcatcaatgagaacagtggctgcttttggtggtgagaaaagagaggttgaaa

SEQ ID NO: 12835 - DNA, 201 bp, Homo sapiens
tttacggactatgagctgaaggcctatgccaaagcaggggtggtggctgatgaagtcatttcatcaatgagaacagtggctgcttttggtggtgagaaaaragaggttgaaaggttggttaattggaatctgattctttccttaatttcatcaatcagcatagtaccctgagtctctcagtttgtgcaaagcggcagaccc

SEQ ID NO: 12836 - DNA, 201 bp, Homo sapiens
acccttgaaagctggtttaatgcagaactacaccgactttatcttttctccaacaccgtactcatttcttcattgtcccggttttcaaaaatatagatgcaaaaaaaaaatgagctgtggatgcatgtttagaggggagaaagtttgtttctaggatctaatttcagtttttaggtcacccaagccagtgggagtcacata

SEQ ID NO: 12837 - DNA, 201 bp, Homo sapiens
taatgaattcaattatcaaatcactattcaagtccactttgggtctacaggctaccttgcttagacttcttactcatttcaaaacagttctactttgtagragagtaatattcagtaaaaaaataaagtggtattttaaatcataacagtggaaaacttggagatgctttacagaacaaaaattattttgggtatttccaa

SEQ ID NO: 12838 - DNA, 201 bp, Homo sapiens
tccactttgggtctacaggctaccttgcttagacttcttactcatttcaaaacagttctactttgtagaagagtaatattcagtaaaaaaataaagtggtmttttaaatcataacagtggaaaacttggagatgctttacagaacaaaaattattttgggtatttccaaacagccaaagagctagcttttgaacccacaga

SEQ ID NO: 12839 - DNA, 201 bp, Homo sapiens
cacctgtgttaatgtgcatcattttacttcttggtcatggctctcagttaaataattaagtaatgtgctaaatgccaaaacctcatccttgccaatgtttycttttactggtttttgatggatttcagtggacgttgctttgggggcatacataaacgcacacacagacaccgagtatcaacacaaagcatctgcacctgt

SEQ ID NO: 12840 - DNA, 201 bp, Homo sapiens
tcaagttaagagaaatgattgatatttagtaatggtgctaggacatttggaaatatatatatccatctaaatttgtgtaactacactgtgatgtttgccartgatgaaaccgcctaaggacacatttctcagaacgtatccccgtcgcttagctatgcataactgtacatttaaaatgctattgctgcctcttcagtgagc

SEQ ID NO: 12841 - DNA, 201 bp, Homo sapiens
tgctaggacatttggaaatatatatatccatctaaatttgtgtaactacactgtgatgtttgccagtgatgaaaccgcctaaggacacatttctcagaacrtatccccgtcgcttagctatgcataactgtacatttaaaatgctattgctgcctcttcagtgagctgtctattccacttttttctttgtattataacgaa

SEQ ID NO: 12842 - DNA, 201 bp, Homo sapiens
agtgatgaaaccgcctaaggacacatttctcagaacgtatccccgtcgcttagctatgcataactgtacatttaaaatgctattgctgcctcttcagtgarctgtctattccacttttttctttgtattataacgaaaatattattgtgtccttaagttctccagacactaaatatagaaataataacagggcttgaaatt

SEQ ID NO: 12843 - DNA, 201 bp, Homo sapiens
ttccaaagagaaattctgtacccttgaaacggcaactccccatcctgctctccctcccctcagccccagcaaccaccattttactttctgtgtctatgaayctgactactctatgtacctcatctaagtggaatcatatgaatttatccttttatgtctggcttatttcacataacatgatgtttttgaagtttctctatg

SEQ ID NO: 12844 - DNA, 201 bp, Homo sapiens
gtcagagctacatttttatggatgtttattttatggatatatcatgttttctttattcattcatctgtctgtggacattcaggttgtttggctgttgtgawtaattctgctctgaacgtgggtgtacaaatgagaaattcttgatttagcctgttagtctccaaggaagtcagcactaacacataggaatgctttgggaca

SEQ ID NO: 12845 - DNA, 201 bp, Homo sapiens
gaactttgctgttttctttcttctccagattctaaatgacctcaacatggtcattaaaccaggggaaatgacagctctggtaggacccagtggagctggaraaagtacagcactgcaactcattcagcgattctatgacccctgtgaaggaatggtgggtgtcttccagaaactcctcaatacatggggacagtaaagtgc

SEQ ID NO: 12846 - DNA, 201 bp, Homo sapiens
acacgttgtgggtaggttgtttttgtttttaattttttacttttttgctcatatcttaaattgtaattcaaaatgtatagaggggattttactggctgagstggagtggtatctaacacaaagagaatagaaacatgagtttacccatatttctagaaattactctgcctcaagtttccttctatcttactatgttttaaa

SEQ ID NO: 12847 - DNA, 201 bp, Homo sapiens
aattggtgttctcgaggaagaagagaaatctaaaagtttggaaaatatatctgaaggaataattgaggaaaacttccctggccttgctgaaggaagatctyttgtctagggatgtagacatccaaatacgagaagatcaaagaacacctgggaaattcattgcaaaaagatcatcacctaggcacatagtcatcagattat

SEQ ID NO: 12848 - DNA, 201 bp, Homo sapiens
agatgaaggaaagaatcttaagagctgtgaggcaaaagcaccaggtaacctataaaggaaaacctatcagaataaaaacagacttctcagcagaaaccctrcaagctagaagggattggggtcctatttttagcctcattaaccaaaacaattatcagccaagaattttgtatccaatggcacttaacttcataaatgaag

SEQ ID NO: 12849 - DNA, 201 bp, Homo sapiens
taccaagcaaatcagggaaatgcaaatcaaaaccacagtgtgttatcatctcactcctgcaagaatggctataatcaaaaaatcaaaaaagaatagatgtkggcatgaatgtggtgaaaagggaacacttttacaccattggtgggaatgtaaactagtacaaccactatggaaaacagtgtgtgattccttaaagaagta

SEQ ID NO: 12850 - DNA, 201 bp, Homo sapiens
catctcactcctgcaagaatggctataatcaaaaaatcaaaaaagaatagatgttggcatgaatgtggtgaaaagggaacacttttacaccattggtgggmatgtaaactagtacaaccactatggaaaacagtgtgtgattccttaaagaagtaaacgtagatctaccgtttgatccagtaatcccactactattaatag

SEQ ID NO: 12851 - DNA, 201 bp, Homo sapiens
aaacgtagatctaccgtttgatccagtaatcccactactattaataggcatgtacccagaggaaaataagtcattatacaaaaaagatacttgtatatgtrtgtgtatagcagcagaatttgcaattgcaaaaatatggaaccagcccaaaggcccatcaatcaacgagtggataaggaaaatgtaatatatatattacgt

SEQ ID NO: 12852 - DNA, 201 bp, Homo sapiens
atggcttattaatgggtaagttttataaaaatgccaaatgtaattgaaaaatgtcttggttgcaggttccatagtaatgaaatttgtcatgaaaatctatygacattgtgttacaattataattaaatatatatttgattaaatcaaatgaaattgccaacatttaatctttttttacttagaaagttcaactaatatatg

SEQ ID NO: 12853 - DNA, 201 bp, Homo sapiens
aatattccattatctatatgtaccacattttctttatccattcatttgttgatggacacataggtggctattgtgagtaatgctgcagtgtgcatgggagygtagatatctttttgatatattggtttcattttccttggatatatacccagtataggattgctaggttatatagcagttctatttctaactttttgagga

SEQ ID NO: 12854 - DNA, 201 bp, Homo sapiens
agtgaacacaggattgcctgttcaatttcctctcgcatagtgattcattccacattccaatttggtgtactctcatttgcaggggtggatagttcagtttyctggccgtgaagcttttgcaatttaatggttcccctgagccatgctttccacacacacaggagctatgatggttttaatggcacatgcctttgctcttca

SEQ ID NO: 12855 - DNA, 201 bp, Homo sapiens
tccatttgatattcagatgatgcaaatatttcatgtcctgaagaaaagtccataaatgagtaaaggtagcagcactcctggaccctaaacgagtgtcttcktgtgtgtgtgtgtgtgtgtgtgtgtgtgtgtgtgtgtgtgtgtagaaagatagagagagacaatatgagcaggaagaaagaaaaggcaaatagtcatttg

SEQ ID NO: 12856 - DNA, 201 bp, Homo sapiens
gtgctatttggtaggaacatctgggcatgatcaggtagccttcccctaaggtaatgagatgactgcattggtaagtcaaagaacagctgccccaagtctgmacaggaacctgaccactccacctgcatatagccagcaacaggtgagtctgggagctaggtagaatggcagtcaaaagcctggattcaaattctgctctac

SEQ ID NO: 12857 - DNA, 201 bp, Homo sapiens
gcatctgcacctgtagcctaattgtttgatttggtaaacagtgacaatctgaactttgctgttttctttcttctccagattctaaatgacctcaacatggycattaaaccaggggaaatgacagctctggtaggacccagtggagctggaaaaagtacagcactgcaactcattcagcgattctatgacccctgtgaagga

SEQ ID NO: 12858 - DNA, 201 bp, Homo sapiens
tcagcgattctatgacccctgtgaaggaatggtgggtgtcttccagaaactcctcaatacatggggacagtaaagtgcaaatggcagtatattgatcaaayagaaaggtgtagcatacattgagactgtcctggcatgcatagttaacttaatgatttgttactgaattgatgggacacgcttcctacatggtaacagtgt

SEQ ID NO: 12859 - DNA, 201 bp, Homo sapiens
aaaaagataacacaccatgatcaggtgggatttatacaaggcatgcaaggatggttcaacatatgcaaagcaataaacatgatatatcacataaacaatawtaagggaaaaaattatcatttcaatagatgcagaaaaaacattcaacaaaattcatcatcccttcttgataaatattctcaataaactaggcatagaagg

SEQ ID NO: 12860 - DNA, 201 bp, Homo sapiens
attcattgcaaaaagatcatcacctaggcacatagtcatcagattatctaaagtcaagatgaaggaaagaatcttaagagctgtgaggcaaaagcaccagrtaacctataaaggaaaacctatcagaataaaaacagacttctcagcagaaaccctacaagctagaagggattggggtcctatttttagcctcattaacca

SEQ ID NO: 12861 - DNA, 201 bp, Homo sapiens
ggaaacttaggaggatacaagtggctgtccagagagatgcataatagactcgtagttgtaatgtcctgtcctccccctgcctttccctacttcatcctctyttctatatccagaaatggacatttgcaggtgtgtttgtagggggcagttgagtagcttgaagaatgtggggcagggggagatagaggaaagcaaaattta

SEQ ID NO: 12862 - DNA, 201 bp, Homo sapiens
atatccagaaatggacatttgcaggtgtgtttgtagggggcagttgagtagcttgaagaatgtggggcagggggagatagaggaaagcaaaatttactttytttttctcgcattgctaaagtctcaacaaactgcattccaacccaaattctgaaaggctgaatctagagcatattttagatttaagtgttggaagggctt

SEQ ID NO: 12863 - DNA, 201 bp, Homo sapiens
catttgcaggtgtgtttgtagggggcagttgagtagcttgaagaatgtggggcagggggagatagaggaaagcaaaatttactttctttttctcgcattgstaaagtctcaacaaactgcattccaacccaaattctgaaaggctgaatctagagcatattttagatttaagtgttggaagggcttggaggtacttaactc

SEQ ID NO: 12864 - DNA, 201 bp, Homo sapiens
gcttgaagaatgtggggcagggggagatagaggaaagcaaaatttactttctttttctcgcattgctaaagtctcaacaaactgcattccaacccaaattytgaaaggctgaatctagagcatattttagatttaagtgttggaagggcttggaggtacttaactcttattaagaaagaaaaatattttatcttttgcctt

SEQ ID NO: 12865 - DNA, 201 bp, Homo sapiens
ttcttgaaaattattgcctgaaaactatgcatgaatgcttctaggcaggtctttccgggaggaaattcactcagaaatggcattaaaaatagttatttaaraacaataatgccttatttttggtgctgtgagccttctttcacacatggggaaagtgaagctctgtagggtaaagtccagaagacatgggcctgcttaagt

SEQ ID NO: 12866 - DNA, 201 bp, Homo sapiens
ttaaaaatagttatttaagaacaataatgccttatttttggtgctgtgagccttctttcacacatggggaaagtgaagctctgtagggtaaagtccagaaracatgggcctgcttaagtgtcagagctggattcaaacccaaatctcaggctaccctgctgaaggttctgtttacctccacttttagcagcagatgacaga

SEQ ID NO: 12867 - DNA, 201 bp, Homo sapiens
gtcaccttccatctagcaatttgacacccttgttggagaaggaggaggccagatgagtggtggccagaaacaaagggtagctatcgccagagccctcatcygaaatcccaagattctgcttttggacatggccacctcagctctggacaatgagagtgaagccatggtgcaagaagtgctgagtaaggtttgtggaagtct

SEQ ID NO: 12868 - DNA, 201 bp, Homo sapiens
accaaggcttctaactttcaattccatcccccccttttttttttttttttaaccctgcgcaaatagaagaggcttcctagagtgtgttccgcacgcagtaraagcttcatgcttattggctgagtgaattaatcaatgacaagaaagtataatacttattttcaaatgtagatagatacttcaggttctagtgcaccttct

SEQ ID NO: 12869 - DNA, 201 bp, Homo sapiens
tatacagggttgccacaaaccttccattagtaaaaatcacaatatctgctaagcaaaaaatgcaaaaaagatcattttgtcttttcttttctttttttatrtttatactcattttattttcttattatattagctagagctcattgagaaataagagtggtagtagaggtgattctctcaagcaagacaaaaactcaaaac

SEQ ID NO: 12870 - DNA, 201 bp, Homo sapiens
gggagcgtagatatctttttgatatattggtttcattttccttggatatatacccagtataggattgctaggttatatagcagttctatttctaacttttkgaggaacctacatacatatttccataatgactgtactaatttacattcccaccaacagtgtacaagtgttcccttttttccacattcttgccatcacttg

SEQ ID NO: 12871 - DNA, 201 bp, Homo sapiens; identical to SEQ ID NO: 1502

SEQ ID NO: 12872 - DNA, 201 bp, Homo sapiens
ttattggaatggctaaaattaaaaatagtgataaccctaaatgttgatgaagatgtggaagaattggatcactctaccatcactcatgccattcaaaccaygtcatagctatcctggaaaacagtttagtaattaaaaaaattctaaacactcaactaccatatgactcagcatttctactcttggggatttattccagag

SEQ ID NO: 12873 - DNA, 201 bp, Homo sapiens
aattggtcgaaccctattgaactgaattttgaggtcccctgaaagacagtcactctacagtgtagataaagcacactgaaattcaggacccctgacttccrgcacttactctgctccttactgtgaccttgagcagttatctaaccctgctggaacacaatggcctaatacctgggtgatgtcttaggttctttcttgctg

SEQ ID NO: 12874 - DNA, 201 bp, Homo sapiens
gaagcttgagtcccttttcctgagtacagttagcaacataattatcactatcttcatgtagtttgttagattactccccagtgtcaaatgacatttcatcraatagggattaatgatgttttaataggtaaatattgttttattaacagcaattacatttattgagcattcactgtttctctaggcactactaggagctta

SEQ ID NO: 12875 - DNA, 201 bp, Homo sapiens
gctaaaaacactcccaaggactgagaaattattattagagcagccacattagatagcacgttatggaatcaggcatactaaaactgtgctataaatgagamtagaatttaactgaaaaactgcatacaccctcacacatcgttgagcaataggtaccaacttcctattgctcaatagcaaaatattctcacagtgtctaca

SEQ ID NO: 12876 - DNA, 201 bp, Homo sapiens
tgtgtttgcgatgattttatgatcattttgtaaaaccactgcatcacggcctgttttaaacattataacttgagctgtttctgccgaaattgactcaagcrttttgtcttcacaggtatgagaaaaatcttgtgttcgcccagcgttggggaattagaaaaggaatagtgatgggattctttactggattcgtgtggtgtc

SEQ ID NO: 12877 - DNA, 201 bp, Homo sapiens
actcacccatttttcattctcttttgtgatctgctgtacttttttttcaaagcacttttgtgatatggaatatttgcatttatttacacttgtgcccaccygtttctaccctcagacagtaaaatctacgaggtcagggaaacaaaaaatgaaatatctgtttcatttgccctgcaagtaaatagggagtcgttttatatc

SEQ ID NO: 12878 - DNA, 201 bp, Homo sapiens
taagataaatacattgccagggaaaattgagtaggattttgatttgcaaatggaagtgattatcagaggtcaaaccataatcattccaaaccacggacttwatttcattaagaacatgataatacacaaagaacaactttttcaattcagtttatcttggcagcatgaacagctgacatcttttgaactttgttaaagaaa

SEQ ID NO: 12879 - DNA, 201 bp, Homo sapiens
taaactttaaagagatagtatggatgggaagtgttaccaattttataatttaaccacttcttaacaacttagatacagtttttacagattggaaaagccaytgaagtattgcaggtccagattttaactatagtcccttgtctttattgatccaattcctcctaagaactttgacatttaccaaaatagggatatcagtag

SEQ ID NO: 12880 - DNA, 201 bp, Homo sapiens
tctttcccaaccagaattatgaactacagtttaggttttggatacacttaggttttagctacacattttaaagtgtgttctaattaatatcttgtccttgsggggtaaatgagggatggtagcataaacacttctcaagtataagaattaagggaaacttgaatttaactgaaaaattgtctcgtggtccagttgggttga

SEQ ID NO: 12881 - DNA, 201 bp, Homo sapiens
aagcctgcacattctacacatctaccccagaacttaaagtctaataaaataaataaataaataaaatgtgtaagtattgatgaggggtaaggttgtgcgtrtgtgtgtgcaggacagccattagggatggccatacaataccacttggcttctaaattcctgctgtatatgggttcattcatacatacttggagaagacaa

SEQ ID NO: 12882 - DNA, 201 bp, Homo sapiens
gaattccttcccattcattcaagaattccacacagtgctgtttgtaaagagaaatgaatcattttttcccatttaggcattgggaattttaatgacaggcttttttttttttttttttttttttagttagggaaaatctatcagcagattagatttttgctgatgtcataatttttgttttacatttcttgaaaattattg

SEQ ID NO: 12883 - DNA, 201 bp, Homo sapiens
atctagattatctgttatattttatagttctaaagttatgtgacagagaaggtaggccacacgcaacacaaagaaagaggtgatatctgatgtgtggtttkcatgaaagaagatgcaattgagcaaaacacaattatgaaatttaaaatgtataattaatgccataacaatcgggattccattttggagagagctaaaatg

SEQ ID NO: 12884 - DNA, 201 bp, Homo sapiens
ccaaaggaaaaaaattttaagtacaattttaaaactgaactatggtctgtgaggctcttagaagaaaaaaactcactggactgatagtgctgtactgtagcacgtctcaactcctagacagtttaaccaaaaataccaaaaatgatatggcagaatttcaacggatcatggaatcctttcacttagggggaaatccctata

SEQ ID NO: 12885 - DNA, 201 bp, Homo sapiens
aaataatttattctttcaaccaatatttcttgagtccttgctatgtgcagacatggcatactatgggtctctaacattttaatcaactgattattaacctkttactcccaacgtctttctgtaagcctctgcttatatcttaagagaaaatttcctttgggaagatgaaatgcatcctttaacactatattccttgctctc

SEQ ID NO: 12886 - DNA, 201 bp, Homo sapiens
ttaatccagtacgttttgtgatacacaaaatcgttactggctgcatggtaattgggcataaatggtaagtagttcacataagtgactgtaattagtatcasttgtgcacagagaaaaaatgcactctgtggtctggtagggaaagatgaaggggacctgaatggtgcagaaggttgttctttcatgaccttcctgagtttc

SEQ ID NO: 12887 - DNA, 201 bp, Homo sapiens
actgtaattagtatcacttgtgcacagagaaaaaatgcactctgtggtctggtagggaaagatgaaggggacctgaatggtgcagaaggttgttctttcaygaccttcctgagtttcagaattcattaataaaaataaacacataatggagcgtgacattcattcagtatatacaaagtgtcaagcactgagtgacgtatt

SEQ ID NO: 12888 - DNA, 201 bp, Homo sapiens
gccaaatactttatagtagcacgttaggcatctgtgcctttaatattctaggactctttagtgaatcagctcatgtggtagatattcaagtacctggactyaactgcctaactagactgtgagttcctaggaaacagagattatattttctttacgtagcagacatagatggcttaggatggtgctttgtggcaggtgatt

SEQ ID NO: 12889 - DNA, 201 bp, Homo sapiens
tggtagcaggaagaggccctcacttttctctgattaaccagagtggttaaattctagattgggcttgttgctagcagaagaggtgaaattcaggacaacarttgaaagttggtagcatttgaacacatcatttaggaacactcagttttaatcatcatctaccatggatactcaaaagaataccctcggacccccgattgg

SEQ ID NO: 12890 - DNA, 201 bp, Homo sapiens
acagtgactcaagaatatcaccagttggtttgcctttctcatggttttaatgttttctcattaaaaataaataaagcacagataagcagaaagaataaccrtccatccaacaactagaggaaaatttatcaatggttttgctttatctttcctataattaagctataaaaaacaaccatccatgtaacaactagagaaaac

SEQ ID NO: 12891 - DNA, 201 bp, Homo sapiens
ggcagtacattcaggctaaatgaactgtatgacgctctgttgaaatgagtggcaggtcctgtctttccatgcaagtgctagataaatgacaaggcaattasaacaatcaggaagcacaggttcttcccaaccttcgcagagactgcagaaagtggaagacactgagtatagggtatgaagtggcaaaggaaagctgccatt

SEQ ID NO: 12892 - DNA, 201 bp, Homo sapiens
ttcaggctaaatgaactgtatgacgctctgttgaaatgagtggcaggtcctgtctttccatgcaagtgctagataaatgacaaggcaattacaacaatcargaagcacaggttcttcccaaccttcgcagagactgcagaaagtggaagacactgagtatagggtatgaagtggcaaaggaaagctgccattatgtaggtt

SEQ ID NO: 12893 - DNA, 201 bp, Homo sapiens
actctgtggtctggtagggaaagatgaaggggacctgaatggtgcagaaggttgttctttcatgaccttcctgagtttcagaattcattaataaaaataawcacataatggagcgtgacattcattcagtatatacaaagtgtcaagcactgagtgacgtattatgtaataaaattactgcatgtaatgctctcaatctca

SEQ ID NO: 12894 - DNA, 201 bp, Homo sapiens
ctccagcctgggcaacagagtgagaacgtgtctcaaaaaacaaacaaacagaaaaccaagaacagaaggggaagttggcaatctgttgttctttctctttaaaaaaaaaaaatgccctgagctgagtccaaagcaagccctggaaatccagaggtgatttgcgggctccctgaacctgtttggttcactgtccgctgtttg

SEQ ID NO: 12895 - DNA, 201 bp, Homo sapiens
ctaaagaataactcataaaatcaccacctagggagaatttcccattgtattggaaagggtggtctttaaatccttatgtttttctcatcaggttacaagaygagaagaaaggtgatggcgttagagttggcttctttcaattggtaataaaactgtgttgatttatggcagtgggtgtgcagctataaattgtttagatca

SEQ ID NO: 12896 - DNA, 201 bp, Homo sapiens
gtttactccaaattttctcaggatggaggcatttctaggcagaaattggcattcttcatagtcactatcagttcaacaaaacaatttatagtatttctcartgccccacacagtttatctacttggcaatggcatcaatgacagtgattattttcccctaagttgtagatgagtagctaaaaacgaaagtcagctcctgaa

SEQ ID NO: 12897 - DNA, 201 bp, Homo sapiens
ttttttaaatccctctatatccacaaatgtaatctctggtggcttgatcctacttgcaagtctgaacattcttttccctcttttgaaggttgctgaacatygagagcgaaatgatcaaatttgccagttactatgctggaattgctgtcgcagtacttatcacaggatatattcaagttagtagctcctccgtataattta

SEQ ID NO: 12898 - DNA, 201 bp, Homo sapiens
tttgggtcattgccgcagctcgtcagatacagaaaatgagaaaattttactttaggagaataatgagaatggaaatagggtggtttgactgcaattcagtsggggagctgaatacaagattctctgagtaagtagctggtaaaacagtattttagtgtgtgatttttggataataaaacccttgtttctaaattaaataaa

SEQ ID NO: 12899 - DNA, 201 bp, Homo sapiens
agatgggaatgtttaaaagggaaagactgagactttcagcaagatatttgaatgatcaaattcagttttagtgaccaaaatctttctggtttctagtgatrttaataaaatcaatgatgccatagctgaccaaatggcccttttcattcagcgcatgacctcgaccatctgtggtttcctgttgggatttttcaggggttg

SEQ ID NO: 12900 - DNA, 201 bp, Homo sapiens
cttatcagtttcaggtaagtctttatatttctactgcgtatctatatatctacgaacattacaaatagtgatttgcaggtaacacaatttacataaatggyatcatacagtatcattctgaaactttgtcttgtttgtttaaacttacgtttgttgagatttatccatgccaattcattgattttaatggctagataatat

SEQ ID NO: 12901 - DNA, 201 bp, Homo sapiens
ggttaagtcaagatccccgaagttgaagaggtcaaatacaggttaaacatggccttatgggaaatgaaatgaatgggaaatattaaggaaatatgattctrtgaaaagtgtgggcatgttcttgaatttttcatcattatcaacattatttaatgtagttgtaatatttttaagcatgaggaagctttaaaattagctaat

SEQ ID NO: 12902 - DNA, 201 bp, Homo sapiens
tcctcactgctggaattctaaaaacctaatgacctgtcatctcctctattggcagatgatagatggtcatgacagcaaaaaagtaaatgtccagttcctcygctcaaacattggaattgtttcccaggaaccagtgttgtttgcctgtagcataatggacaatatcaagtatggagacaacaccaaagaaattcccatgga

SEQ ID NO: 12903 - DNA, 201 bp, Homo sapiens
taatgataagaaatcaaggtaagtgactgatttcaacaatgcagcatcttttctagaataactccataatattcatatcaaaggcacaaagcagagaataytttcatgcacattgcacttcatataaaataatatatacaatccattctttttctctttaaaatattactataatttgattttaaaaaccttttggaatat

SEQ ID NO: 12904 - DNA, 201 bp, Homo sapiens
aatttgaggcatatacatgatactaggtgcttatgaatatttatccaatgaattaaagaatgaatctactttcaacatttgcatcatagccatctattaaraaggaattctctgtggccactcattactcactgtcttcattgttactggatcacatacctgaaggcgagcaaagaatacaaactgaggctttcagaagtc

SEQ ID NO: 12905 - DNA, 201 bp, Homo sapiens
taaatactgtcatcgtgagttattgtgatcattgacatgaatactatttgttctattctgaataacatgtttgtttagctgttttatggtaagatcaccgygatcttatgacttgggtgggacagaggagaaaagagaggacatttttctacctgtaagtagtttatatacctccaaagtcgcccaaactgtttgcaggtt

SEQ ID NO: 12906 - DNA, 201 bp, Homo sapiens
gaatactatttgttctattctgaataacatgtttgtttagctgttttatggtaagatcaccgcgatcttatgacttgggtgggacagaggagaaaagagargacatttttctacctgtaagtagtttatatacctccaaagtcgcccaaactgtttgcaggtttctttcgtggaaaaagtatatcattaaaagtacagttt

SEQ ID NO: 12907 - DNA, 201 bp, Homo sapiens
tatttaccttcattatatacataaatatataaaacataagtaaatatatattctgattacataaagtatatttttattatctattacatatgtacctaaamatcaaatgttataacatatgtaaaggtgctttgtaagctatgaattacaaagtaatacacactcagtaaatatttttgaatggatagctaaaacttatat

SEQ ID NO: 12908 - DNA, 201 bp, Homo sapiens
cattcctagaagaggtaacagtaagcctcctgatttacagcacacatcgttctatcagtttcttttcagacagcctgtctggcttttgaaaatctttcttrcctgtgattgctctatcactgcatgatgagtatgcatggaagagactaaagtggaccaagccctgggctgccatttagggtaccctggcttccaacaact

SEQ ID NO: 12909 - DNA, 201 bp, Homo sapiens
aatgttataacatatgtaaaggtgctttgtaagctatgaattacaaagtaatacacactcagtaaatatttttgaatggatagctaaaacttatattacawtggtggagagtaattgaggtttttgccattacttttaatagtgaaataaaatcttcttacttaaacctatatgtatttattcatagtacgagtatgtttt

SEQ ID NO: 12910 - DNA, 201 bp, Homo sapiens
tgtgtgaagcaaaatttttttcctgggtcctaattggtgccaaatccaatattactacatttgcgtcaactcagaagtcaacccattcagtttgcatagargaaacatctagaaatcttgcttttctttgctgaccttgatatatttgagatttgaacatataataacatataaaattatatgttataattttgggtttta

SEQ ID NO: 12911 - DNA, 201 bp, Homo sapiens
gagtaatttaggttggtaatttaggtactataagaagtcccaagcctttagcagtatgtttttaaagatgttgcagttggcaatttttagaaagccagctyagggtagatatttatttcaaactctgatggtatgtatgtataaatattatacctcatatcagtctataatgctgtttgctgtcattaaagaaaagcctac

SEQ ID NO: 12912 - DNA, 201 bp, Homo sapiens
acaatggaagacatagtccaagctgccaaggaggccaatgcctacaacttcatcatggacctgccacaggtacccctagccatacattcctgggagaaacyaagaggtcatagaaggaaaaaaagttgcacaattatacacatttcttctcgtatgattcccaagtcattaaattcttaagccatgttttagtttcatgcc

SEQ ID NO: 12913 - DNA, 201 bp, Homo sapiens
aaacagcctttgcattatattttgctgtgttgtctaacaggagcaaagagacacggatttgctctgtgctttaatcctctgagatagatatttaggaccgygaccaatttttattttggttgaaaaatcttatttgaagttgagctaaagaggaatatttacacagcccagtaaaccctggaataaaagcataaatcaatt

SEQ ID NO: 12914 - DNA, 201 bp, Homo sapiens
ttcatcatggacctgccacaggtacccctagccatacattcctgggagaaactaagaggtcatagaaggaaaaaaagttgcacaattatacacatttcttytcgtatgattcccaagtcattaaattcttaagccatgttttagtttcatgcctgaaaaagtaccatgagtgtttcctttcatctgaaaacacattgttta

SEQ ID NO: 12915 - DNA, 201 bp, Homo sapiens
gaagtgctgagtaaggtttgtggaagtcttagtccattttacaggtccatgtggaaatgcttgtgctgctgcaggaaaggcagctccttgtggggtgggarggatgggagtagttgatactacatgggttcatgcatctagtctgattgtttagaaaatattagctgactacaatcttcctcacagttgaacagaagaaag

SEQ ID NO: 12916 - DNA, 201 bp, Homo sapiens
tagcctagtagttaaagagtataaagctttagaatcagattgccttgatacaaatcccagcttctctatttacaagctttacaaactttctcaagttactytgggcccagtgtttccttattcatcagttgcaaatagcagcacttgcctcataaggtatctatgagaactaaaagagatgttatgtgtaaaaagctcaga

SEQ ID NO: 12917 - DNA, 201 bp, Homo sapiens
atccagaaatacgatctacacacagaaagtagctattaacctcctgcagagaaagatttgtacatttgagtatgaaagtctgttaaaatatctcattgtaratgctgacggatttttcttgttgtcgttaaaagatgactaaatgaagtgttaatatgtatcttgtttctttggtttcagtttttctgatggctaagttcc

SEQ ID NO: 12918 - DNA, 201 bp, Homo sapiens
atcattatgacttcttgcatttcataggcacagtatattttgttacaacatcgtaaaacatttctacaaacattttaagcagaaaacctaccactttttaygtttttttttcaaagtcctctttgctcttaatctaccaaatgtaggcgttcaatattttcaacatttatttggatacctatgatgtgcctgttactgcat

SEQ ID NO: 12919 - DNA, 201 bp, Homo sapiens
tacaaactttctcaagttactttgggcccagtgtttccttattcatcagttgcaaatagcagcacttgcctcataaggtatctatgagaactaaaagagaygttatgtgtaaaaagctcagaaccatgctttattcatagtaggggctcaattcatgttggttagtaataagcaagataagtgtctgaccactaacaccta

SEQ ID NO: 12920 - DNA, 201 bp, Homo sapiens
ctttgagattggcttctttaacttaagcatgtgttttttgcagttcatccacatgtatttttattgctaaataatatttcgttatatggatataatacatsttatgtatctgttcatcagttgatggacatttggattgttcccacttttgagctattacaaataattctgctgtgaacatttgtatacagatttttgtgt

SEQ ID NO: 12921 - DNA, 201 bp, Homo sapiens
ctaaaagagatgttatgtgtaaaaagctcagaaccatgctttattcatagtaggggctcaattcatgttggttagtaataagcaagataagtgtctgaccrctaacacctaattattagattccaatgttgtgctaggcctgtgagataatcagtaaccatcttttgtcaatgataatccttataaagctagtttgacctt

SEQ ID NO: 12922 - DNA, 201 bp, Homo sapiens
tctatgcagacgtgattcagttaacaatatcgagatgggggagactatcctggattatccaggtgggccctaaatgcagtcatgtgtgttcttaaaagggwtggttgctaagaagaaggcagagggggatttgcctgtagagagaagagtagaggcaaggtgactacagaaaaaaagaatggaatgacattgccacagccg

SEQ ID NO: 12923 - DNA, 201 bp, Homo sapiens
atcttttgtcaatgataatccttataaagctagtttgaccttttattcataatgtaaaaacagcctttgcattatattttgctgtgttgtctaacaggagmaaagagacacggatttgctctgtgctttaatcctctgagatagatatttaggaccgtgaccaatttttattttggttgaaaaatcttatttgaagttgag

SEQ ID NO: 12924 - DNA, 201 bp, Homo sapiens
tctttatatatttcacttgaattggtaaaatgacagcactagtagactgtgaaaagtgatgtatctataatgtatttcctagagcaaccacttaaaaagckatacaaagagagacacttaaaaacgctatagataaatcaaaattgaattctaaaaaaatgttcaagcagcccataggaaggtaagagaaagcaaacacag

SEQ ID NO: 12925 - DNA, 201 bp, Homo sapiens
acctcgtgatccgcccgcctcggcctcccaaggtgctgggattacaggagtgagccaccgcgcctggccaacaattttcttaaaggaagctattgtggtcraataaaggtttggaggtctgagctctccccccttcatgcttgttcagtcctcttcttactcctttttcatagaacacagtttgaaaactgccagtccctt

SEQ ID NO: 12926 - DNA, 201 bp, Homo sapiens
acatcgtaaaacatttctacaaacattttaagcagaaaacctaccactttttatgtttttttttcaaagtcctctttgctcttaatctaccaaatgtaggygttcaatattttcaacatttatttggatacctatgatgtgcctgttactgcatgagtccctgtgggagagtctaaggaccatgaagcatgtcttctgcct

SEQ ID NO: 12927 - DNA, 201 bp, Homo sapiens
aaaacagcctttgcattatattttgctgtgttgtctaacaggagcaaagagacacggatttgctctgtgctttaatcctctgagatagatatttaggaccrtgaccaatttttattttggttgaaaaatcttatttgaagttgagctaaagaggaatatttacacagcccagtaaaccctggaataaaagcataaatcaat

SEQ ID NO: 12928 - DNA, 201 bp, Homo sapiens
attacaatggtggagagtaattgaggtttttgccattacttttaatagtgaaataaaatcttcttacttaaacctatatgtatttattcatagtacgagtwtgtttttaaccctctgtgtgccacattgtactggtgctataatgataaaaaagcacatttgatgcctgcttgctctgggagcttacagtccaatacaggc

SEQ ID NO: 12929 - DNA, 201 bp, Homo sapiens
tgagctaaagaggaatatttacacagcccagtaaaccctggaataaaagcataaatcaattcctttatttcacacataaatattgattagacaataacccrtctggggaagggatatttctttcagtggaagtcggagcagtgaaaattcgtgcttgagaagaaaactatgacagaaaggacattatagtggatcactgtc

SEQ ID NO: 12930 - DNA, 201 bp, Homo sapiens
gcaagtttgactcctagtgtgaaatgaaaggcgtgaggttttgtgacacagaggaccccaaaccacattttccataatcagtacaaaaatcacctcttaaytggtgaaaatattgacagatagttatgaattagcttctcattctttcctcgcaagacctactagccagcattcagcctctacgtagcaaacacaccgtgt

SEQ ID NO: 12931 - DNA, 201 bp, Homo sapiens
aggaccccaaaccacattttccataatcagtacaaaaatcacctcttaattggtgaaaatattgacagatagttatgaattagcttctcattctttcctcrcaagacctactagccagcattcagcctctacgtagcaaacacaccgtgtatatttattaagtaagtttattcaaatggtatgttcatacaccatacacat

SEQ ID NO: 12932 - DNA, 201 bp, Homo sapiens
cagaaataagaaaggagaggatctaaggcagcttacccagttggggactgcctgagagccacaagaggcttttggatatgggcaaacagtaagagagaaayatccagggctccaaaatgggctttcacaatcttggctatggggtaaatccttgacccactagggccttttccctgacatgaagagctgcctaaagattcc

SEQ ID NO: 12933 - DNA, 201 bp, Homo sapiens
gatattaataaaatcaatgatgccatagctgaccaaatggcccttttcattcagcgcatgacctcgaccatctgtggtttcctgttgggatttttcagggkttggaaactgaccttggttattatttctgtcagccctctcattgggattggagcagccaccattggtctggtaagaatgtctttttgcatctctccatgg

SEQ ID NO: 12934 - DNA, 201 bp, Homo sapiens
caaaaatcacctcttaattggtgaaaatattgacagatagttatgaattagcttctcattctttcctcgcaagacctactagccagcattcagcctctacstagcaaacacaccgtgtatatttattaagtaagtttattcaaatggtatgttcatacaccatacacatgacggacggcttaaaatccgcaaatttcctta

SEQ ID NO: 12935 - DNA, 201 bp, Homo sapiens
tttttgattttacaggctcatagttgtaagggacttgccttgtctcatatgagactttggacttagacttttgagttaatgcttaaatgagttaagacttrggggactgttgagaaggcatgactgtgttttgaaatgtaagaaggacatgagtttttggaggggtcaggggcggaatgatatggtttggctttgtgtccc

SEQ ID NO: 12936 - DNA, 201 bp, Homo sapiens
caggtatgagaaaaatcttgtgttcgcccagcgttggggaattagaaaaggaatagtgatgggattctttactggattcgtgtggtgtctcatctttttgwgttatgcactggccttctggtacggctccacacttgtcctggatgaaggagaatatacaccaggaacccttgtccaggtaccttggacttattgaccgag

SEQ ID NO: 12937 - DNA, 201 bp, Homo sapiens
ctactagccagcattcagcctctacgtagcaaacacaccgtgtatatttattaagtaagtttattcaaatggtatgttcatacaccatacacatgacggayggcttaaaatccgcaaatttccttactgttaatccatgatcagtaaattagtactatatttctaacttaatggattttttttctttaactaattggcata

SEQ ID NO: 12938 - DNA, 201 bp, Homo sapiens
taagacttgggggactgttgagaaggcatgactgtgttttgaaatgtaagaaggacatgagtttttggaggggtcaggggcggaatgatatggtttggctytgtgtccccacccaaatctcgtgtcaaactgtaatccccacatgttgaagaagggaactggtggaaggtgactagatcatgggaggagatttcccccttg

SEQ ID NO: 12939 - DNA, 201 bp, Homo sapiens
taggcttcagtaagagcatctctaattttgatcctcccatccacaggacaacttccaggggaagattgattttgttgattgtaaatttacatatccttctygacctgactcgcaagttctgaatggtctctcagtgtcgattagtccagggcagacactggcgtttgttgggagcagtggatgtggcaaaagcactagcat

SEQ ID NO: 12940 - DNA, 201 bp, Homo sapiens
tgatcagtaaattagtactatatttctaacttaatggattttttttctttaactaattggcatagtctccttatcctagtatgtcaggagtattttaaatyagattttgggacataattttaaaagttaacatgtcttatttacttcacctgtgttaatgtgcatcattttacttcttggtcatggctctcagttaaataa

SEQ ID NO: 12941 - DNA, 201 bp, Homo sapiens
atcgccctttcaacatgtttcattgtcaggttaaaacaaactttaaaaaactacataaaggttattggagatttttctccctgaagctgctctgtgtttgygatgattttatgatcattttgtaaaaccactgcatcacggcctgttttaaacattataacttgagctgtttctgccgaaattgactcaagcattttgtct

SEQ ID NO: 12942 - DNA, 201 bp, Homo sapiens
ttttcctcagtgtcatagtaggagctttaaatcttggcaatgcctctccttgtttggaagcctttgcaactggacgtgcagcagccaccagcatttttgaracaatagacagggtatgtataagccaaaagtaaaggccattaacaggtgggggctggggggtggggcacagaatgaactcctgaagaatttaccttaaag

SEQ ID NO: 12943 - DNA, 201 bp, Homo sapiens
aactttaaaaaactacataaaggttattggagatttttctccctgaagctgctctgtgtttgcgatgattttatgatcattttgtaaaaccactgcatcayggcctgttttaaacattataacttgagctgtttctgccgaaattgactcaagcattttgtcttcacaggtatgagaaaaatcttgtgttcgcccagcgtt

SEQ ID NO: 12944 - DNA, 201 bp, Homo sapiens
ctccctgaagctgctctgtgtttgcgatgattttatgatcattttgtaaaaccactgcatcacggcctgttttaaacattataacttgagctgtttctgcygaaattgactcaagcattttgtcttcacaggtatgagaaaaatcttgtgttcgcccagcgttggggaattagaaaaggaatagtgatgggattctttact

SEQ ID NO: 12945 - DNA, 201 bp, Homo sapiens
gtttattcaaacaaattttaagaaatgctagtttgactgaatttactgaatttggcaaataacaaagcaatagcttcacattactctgtcatgtaaaaggkataaaacaatgttataggcacctggtagtaagtttagtcatgcttttctgattcgatactaaatttaaatcattcaagtcattagaatcacaacctgaaa

SEQ ID NO: 12946 - DNA, 201 bp, Homo sapiens
ccaccttgatatttgttttggtgaaatttcacttggatgcaaaatggtagagaaagatatgtgaatggattcatctagatggcactaaaacagttgatgcmggtctcctcatcactcacatctctctctttacaccatttacttcaggtgattctttctaaaacacagtcttcagcattgcctcttaaccattaagactgt

SEQ ID NO: 12947 - DNA, 201 bp, Homo sapiens
ctgaaaaaatccagaatctgaaacgtttctggtcccaagcatttctgataagaaatattcaatctgtattatgattgtggctctagaaggtcaaaggataygcaatttatttcacagtgcccctggactgtcttagttttttaagcaaaagaaatatccttcatcaacatactctttaattttggaaagtattgtattgcc

SEQ ID NO: 12948 - DNA, 201 bp, Homo sapiens
acaaaaagtagtgtatttattttcagatgtagataaatacttcaggccctagtatatcttttccttatcagtttgaattttcagacttgggttttcctatytttcttcttgagaacaagtttattcaaacaaattttaagaaatgctagtttgactgaatttactgaatttggcaaataacaaagcaatagcttcacatta

SEQ ID NO: 12949 - DNA, 201 bp, Homo sapiens
actctttaattttggaaagtattgtattgcccaatgcaatggatgctatttttgttgaatttttttgtacattgagctttagtttagcatagtggggaaamacctgagatttggagctgacctgggcttgcatccaagctttgccacttagtagcttcatagctttgggacaattatcctttctgagattgtctatttcat

SEQ ID NO: 12950 - DNA, 201 bp, Homo sapiens
caaacataacagagttttcctttttcacagacatctcatctctgattgggtattctttactacctaccaccataactgcactctgaatatatagaaatcayagtttcttgatgtaagatttttacatttttactaatagtgatttttatttgctcccactgatagtttcacttgctttttaacagcaaagtgttatttgat

SEQ ID NO: 12951 - DNA, 201 bp, Homo sapiens
ccaaattgtagggccaaattttacctttaaccttctctacttactttttaaaaatatccctgggaaaattgtttttctttataagtgattatgtttataarttttgtgggtttgtggaaggctttttgtttgctcttttcacaaagtctcctaagttttaggctcttggcccagttcttacctgttagcccaaactataag

SEQ ID NO: 12952 - DNA, 201 bp, Homo sapiens
aggaaccacctgccataattgaggacaaggaaatgaagagataatttttgtccctatgcataggctgggattctagggagaaagcgtgagtggactaaccyaccacccatgtatggcagccctggccctgttaatcatcctaatgtgtggaatgaagaggttactgaagagggagagacatggctgagaggctctgacact

SEQ ID NO: 12953 - DNA, 201 bp, Homo sapiens
ctgaatccagagatcaaaagcaaagattgtgtgtctcctggaagattcatttatcccacaaacccttattgaatagctactcatgttgggcaaggcactgkcatggagctggtttactgcattgtcctcatacagacttgcccgtggcacccttctctgagcactttgtctccacaaagacaaagcaggttttcatgggtc

SEQ ID NO: 12954 - DNA, 201 bp, Homo sapiens
atatgtttgtaaactggcatttttaatgacagtcgcttcatcacttccgcttacagtgcttgtagaataaagacaccacaggaaatttaagttatttattrttatcattttaattgtcacataagtatacatatttatgggatatagtgtgatgttttgatgcatgtatacaatgtgtaatgatcaaatcgaataattagc

SEQ ID NO: 12955 - DNA, 201 bp, Homo sapiens
gtgaatattaacttcccatatatacttagaactaactttggagattctctagtctgaattgatcaatttgacttattctatttaaaaccttattgttttarttgataattttttttaatttttgtagatagataccaagtaggtgtatatatttatggggtacatgagaggttttgatacaagcatgcaatgtgaagtaag

SEQ ID NO: 12956 - DNA, 201 bp, Homo sapiens
gatagtaaaatgcaagagaaatctgaaaaccaatacaaagaaatcagaaatcaattcaggatatgaatgagaaatttaccaaggagataaatagcattttwaaaaaataagcagaaattctggaactcaaaaattcattgaaggaaatacaacatacactttaaagcttaaatcatatactagaccaagcagagataagaa

SEQ ID NO: 12957 - DNA, 201 bp, Homo sapiens
tcatatgttgatggcctctcctgctccacaaactcctaccttggcatccattgctctgcatttgctttttaggtccttgaccttaagtctcctcctatcawgcaccttgttctcaccagctgacacaagcctattctgcacaccttctggagaagacatcctgacctctgttacctaactgggagaaatgacttcattgct

SEQ ID NO: 12958 - DNA, 201 bp, Homo sapiens
ctaagtgttgttgtttagagttaaggataacttcaggtatcagaaggttgggaaaatttctatcatgtcaggctgtgggtggaccatcctgtggggcaatsgttccagaaaatgctggtatttaatgtcacaaggaagctggcagaatttagtgagtgctaatagtcttcacaagttccaaagcctaccctttgatggtac

SEQ ID NO: 12959 - DNA, 201 bp, Homo sapiens
ttgaggtcactcataactaatcaaactatgactcttaaatctgtgaatgccaaaggatctgctgcaaaatgtcttgagtacatttagatgattaatataamcctctctctgctcaaggacaaggacattcctgtgcaggaagaagttgaacctgccccagttaggaggattctgaaattcagtgctccagaatggccctac

SEQ ID NO: 12960 - DNA, 201 bp, Homo sapiens
ttcttctcataccttttattttattattttgataagtccgctctttgttttcatgtatttagctcttttctgttagttcatttttctcatctctaaagaaygaaaaatttcctaagcctccatcacacagagggtaagaaggcaaagctgagaactctcatttgggctcgcagggcactcagacagtcattgtacctataa

SEQ ID NO: 12961 - DNA, 201 bp, Homo sapiens
aggcagcttacccagttggggactgcctgagagccacaagaggcttttggatatgggcaaacagtaagagagaaacatccagggctccaaaatgggctttyacaatcttggctatggggtaaatccttgacccactagggccttttccctgacatgaagagctgcctaaagattccacggagatgttactccaaaagggaa

SEQ ID NO: 12962 - DNA, 201 bp, Homo sapiens
atcagcaaacaaacattggacataaactggattttatatcaaacttaacagacatttacagaacattctacccaacaactacagaatgtacagtcttttcmtcaggatatggaacattttgcaagatagatcagatattaggccacaaaacaagtcttaatgaattttttaaaaactgaagccatatcaagtatcttctca

SEQ ID NO: 12963 - DNA, 201 bp, Homo sapiens
gggactgcctgagagccacaagaggcttttggatatgggcaaacagtaagagagaaacatccagggctccaaaatgggctttcacaatcttggctatgggrtaaatccttgacccactagggccttttccctgacatgaagagctgcctaaagattccacggagatgttactccaaaagggaaacccacacagaatcacac

SEQ ID NO: 12964 - DNA, 201 bp, Homo sapiens
ttaccaatgtcatttttcacagaattagaaaaaaacaattttaaaattcacatggaactaaaaaaaagagccctaatagccaaagcaatcctaagcaaaargaacaaagctaaaggtatcatattatttggctgactaaattattctaccaaggtatacaaatagacacatagatcaatggaacagaatagagaacccaga

SEQ ID NO: 12965 - DNA, 201 bp, Homo sapiens
ctttgaaaaagtcaacaaaaatattcattgaagaagtgacaccctactcaataaaaggtgctggaaaaattggatagcagtatgcagaagaaagaaattasacccatacctctcaccacttacaaaattaacacaagatagatagaacacctaaacatagacctgaaactataaaaatactagaagaaaacctaggaaaaa

SEQ ID NO: 12966 - DNA, 201 bp, Homo sapiens
tacaaaattaacacaagatagatagaacacctaaacatagacctgaaactataaaaatactagaagaaaacctaggaaaaactcttctggacatttgcttrggcaaagaatttaattcaaagtcctcaaaagcaaacacaaccaaaacaaaaatagacaaatgggaataaattaagctaaaaagcttttgcacagcaaaag

SEQ ID NO: 12967 - DNA, 201 bp, Homo sapiens
gaaccacatttcaagaggaattgtttccattagaatcttattggcctctattttttctgcccattggtcaagtatgacataatattatgattcagaacccygaaagattccaaaagttgtgatgttgtgcccatgctctctaggtgaccgtggatggccatgacattcgctctcttaacattcagtggcttagagatcaga

SEQ ID NO: 12968 - DNA, 201 bp, Homo sapiens
cctggcttaaaggagcattcctcaggaggcaagggaagcagggaaaggaaacagctcgtgttgtggaaggcaaggaagagaagtagtcaaggcaaggactyagaggagagcaagattcactttcatctggattcagatttcactttcactgcttgttacttgtcctcgcaccattttcttacctccctgtgcctaagtttt

SEQ ID NO: 12969 - DNA, 201 bp, Homo sapiens
attgtttttagctgttgattaatggcagcaacagggccagtgtgtgttggggtttatggctgcaagaaaatgtgctggccttttctaatgtctgcacagcmtatttaagaatattcccagggaccaaggatctaactttcctatggattctgaaatgatgcaaaggtcagtgtcagctctgtctcacagttttgtttaatg

SEQ ID NO: 12970 - DNA, 201 bp, Homo sapiens
aagcaaacatagtaaagaattctacttggatatggttctgtttattgtatatactaaaaaattgctcatgctgtgttgagtagatgcaactgaagatgacrtgcttgcgaggacctttagcagagggagctaccaggatagtttaaggtaagctcaagccatggggcagattacaagctttccaaatattctgaggagtcc

SEQ ID NO: 12971 - DNA, 201 bp, Homo sapiens
ttttgtgttatgcactggccttctggtacggctccacacttgtcctggatgaaggagaatatacaccaggaacccttgtccaggtaccttggacttattgwccgagacatagcatttccttctggtatctcagaaaagtccatggattagatattttgtttattactttggtgccttcaggaaaaaagcatcaatgatttt

SEQ ID NO: 12972 - DNA, 201 bp, Homo sapiens
agaaaagaaaagctctcaaaggccagtttaaggattttagcctagaagataatatcaccaacagaaatagtgggactgaagagggagaactgaagttatgragaacagcacattttcgtatttaaaaagttacagtcagtcataaagggatttttgtaacaaacagccagtatttactatgtacagtgtcctagagcttgt

SEQ ID NO: 12973 - DNA, 201 bp, Homo sapiens
gaaggagagaatctgtcgtggccacaggctgtgtcattgtacatatgtttaaatatcacatcagggtatttatttccaaatgcatattcttttaaaaagayataaatccattattaaaacagtgtaaaaatcagaaattacaactgctgtgaattacataatatttttctatatttgataataccaggaaaatgtcaagaa

SEQ ID NO: 12974 - DNA, 201 bp, Homo sapiens
ctgccctcccagctcgttggcttgctcgtgtttgttgctggataaatgtgagcttgttgtgaaaattgtcttgaaattataatttcctgtttcttaacttytttttaaggctgaactccgagcagctgtgtttttagcactagaggagcaagaaaaagtagaggtatgaagtttccagattttaacatggctgtattcgtt

SEQ ID NO: 12975 - DNA, 201 bp, Homo sapiens
acccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatac

SEQ ID NO: 12976 - DNA, 201 bp, Homo sapiens
tgaatcccctcagcagtctgaccgatttagagacagtccagccttatctgagggaagatcgaggacaaggcccgcagggtctttgaacggctctctgtcaygccaggtcttctttttgtgatctgcatcttctgcatgtggctgtacatgcttcctgggtctttcataggccatccattcacattttaagttggctctcat

SEQ ID NO: 12977 - DNA, 201 bp, Homo sapiens
agttggctctcatgtgcctccaagtctgctttgaggctgacaactctttttcctcatctagccctcagaagtcctgggagggaagggctgctgatttgcaratttgtcctttatagccttaagttgatctgaaggtgccccctctgtcagaggcttgtggtgcactttgagaaactggtaacactgcctcactattcacca

SEQ ID NO: 12978 - DNA, 201 bp, Homo sapiens
gtgcccgttttccactttgtgatattttcacttgacggttgatgaggtgaagcgctgttgtgggttgagcatctgtgcacatgcatacacctgctgtgcacacgcatacacctgctgtgcacacgcatacacctgctgtgcacacgcgtacacctgctgtgcacacgggtacacctgctgtgtacatggaggagccactga

SEQ ID NO: 12979 - DNA, 201 bp, Homo sapiens
tttattattgaaaatatcttaaagttttatctcaccaaggaggccttttctctttccctctctttctagaaggccaatgatgaggccaatcagagtgatayaagtgtctccttgtcagaacccaagagcaaaagcagccttcacttactgtcccatgaaacaaaaattggatcttttctaagcaacagaactttagatggc

SEQ ID NO: 12980 - DNA, 201 bp, Homo sapiens
ctttaaaagactctgagagtaagtgcccaaagatgtggacttcaatactcgggatattttttctctaattaaatactatgtgattattgttgatttttttycccaggaaaatcactaaaataacctatcattttatcactcagagatatttcctgttaatattttgttgtgttttgttacttctaaggtggtcctatttta

SEQ ID NO: 12981 - DNA, 201 bp, Homo sapiens
cccaaagatgtggacttcaatactcgggatattttttctctaattaaatactatgtgattattgttgattttttttcccaggaaaatcactaaaataaccyatcattttatcactcagagatatttcctgttaatattttgttgtgttttgttacttctaaggtggtcctattttatatgttgttttgtattctggccctt

SEQ ID NO: 12982 - DNA, 201 bp, Homo sapiens
ttcacttgacggttgatgaggtgaagcgctgttgtgggttgagcatctgtgcacatgcatacacctgctgtgcacacgcatacacctgctgtgcacacgcrtacacctgctgtgcacacgcgtacacctgctgtgcacacgggtacacctgctgtgtacatggaggagccactgaaactgctctcagcgttttcagtgctt

SEQ ID NO: 12983 - DNA, 201 bp, Homo sapiens
tatgtccatggacatcaaaatgaggtataggttaggaagttaccctggaagttagaattgagataattactttgattagcaaaggtttatgttagaaataygagtggttgaaggcagcgcctttcaccttgatgcctgttgtgtttagcactggatagaaaattgctatttttactgatgactactttaatgcttggttca

SEQ ID NO: 12984 - DNA, 201 bp, Homo sapiens
ttttaaagatttctattttgtggtaaaatctcattttattctcatgctcagataccaaggtataaaggacaaggtaagaagaagacaagcgggcagaaggstggtgacaaggtaacatgcatgagggcagaggagaaaagcagcctgtgggcatcaggtctcgactctggggcctcctggagcgctgggctcctgtcagat

SEQ ID NO: 12985 - DNA, 201 bp, Homo sapiens
attagttcttacaggttttgggataggtggtggagttaagagcaatgttttgagggaaggggttggatcttacaaagtacattctcaagggtggggagaaytacaaagaaccttcttaagcatgggggagattataaagaaccttcttaagggtgggggagattacaaagtacattgatcagttagggtagggcagaaaca

SEQ ID NO: 12986 - DNA, 201 bp, Homo sapiens
gcttctgtaagcaatattaaatctgagaggtggcacttatttgctagtaaactcctgtattgtcccttggctgcatgtctgggtaatggaaaagggcttcygaaaaaaatcacagtgaagaggtcaatttagtttatatcaaacagaattctaaagagaggtgagctgatttcttacgccctggctgtgccgattgtggtt

SEQ ID NO: 12987 - DNA, 201 bp, Homo sapiens
tttgggttgtttacattttaaatatacagtactctaggtattttgagtaatatgtagacagatgttagtggaccagcctaggagaataatgatgttagtgrtaagtgcttggcactgtaccaaggaattattttatttaattcatatcctatgaggtaggttttattactatctccatttttacagatgaagaatctaggt

SEQ ID NO: 12988 - DNA, 201 bp, Homo sapiens
taccagatgagcatcccaaatctgaaaatctgaaagtccgaaatgctccaatgagcagtttctctgagcattacgtcagcactcagaaagttctggatttyattcaagtttggttttcaaatttttgaatttgggatgcttaacctgtatgtattctgttaatcattttgacactggcttaaattattgtaatactaaaca

SEQ ID NO: 12989 - DNA, 201 bp, Homo sapiens
atatttgaccgggattttgaaagatgactctgacttggttctgcgagggctgaggaggaacatggtaagctccatgagaacagaagggagatcccgggacrtgtcagtgctgccctgattccagagcttcactggagggtgctgtgtgaagagacagaatgttgggaggagcagggttgttagaaggtgactttgaaccag

SEQ ID NO: 12990 - DNA, 201 bp, Homo sapiens
gtttacattttaaatatacagtactctaggtattttgagtaatatgtagacagatgttagtggaccagcctaggagaataatgatgttagtgataagtgcytggcactgtaccaaggaattattttatttaattcatatcctatgaggtaggttttattactatctccatttttacagatgaagaatctaggttaagtaac

SEQ ID NO: 12991 - DNA, 201 bp, Homo sapiens
tttgaaatgtttgcatttttcttaccagatgagcatcccaaatctgaaaatctgaaagtccgaaatgctccaatgagcagtttctctgagcattacgtcascactcagaaagttctggatttcattcaagtttggttttcaaatttttgaatttgggatgcttaacctgtatgtattctgttaatcattttgacactggct

SEQ ID NO: 12992 - DNA, 201 bp, Homo sapiens
gtcacttcctttggtatgcaagtctcgctgctgaaatgcctgaggattattcctggggcactgggattgctgtggattaagagggatcagggtgggtcagrcttagtgagaattgaccacctggtgccataggtggaagtcagtatagggtactgtgatcacaggaggaagctgagcctggagtgcagagagtgtggtcat

SEQ ID NO: 12993 - DNA, 201 bp, Homo sapiens
gcaatgttttgagggaaggggttggatcttacaaagtacattctcaagggtggggagaactacaaagaaccttcttaagcatgggggagattataaagaaycttcttaagggtgggggagattacaaagtacattgatcagttagggtagggcagaaacaaatcacaatggtggaatgtcatcagttaaggctattttcac

SEQ ID NO: 12994 - DNA, 201 bp, Homo sapiens
attttagggtgcacttgatctatctgatgtacattctccaccaaagtcaccagagggaaaaacaagtgcacagacaacaccaagtaaggtgagttagctgyggaacacggaagtcatgtctggacttaactccagagtgctctgcttttctctctctagtctttcttgttacaagttgtattgttttatataaacacatgg

SEQ ID NO: 12995 - DNA, 201 bp, Homo sapiens
ggaaggggttggatcttacaaagtacattctcaagggtggggagaactacaaagaaccttcttaagcatgggggagattataaagaaccttcttaagggtkggggagattacaaagtacattgatcagttagggtagggcagaaacaaatcacaatggtggaatgtcatcagttaaggctattttcacttcttttgtggat

SEQ ID NO: 12996 - DNA, 201 bp, Homo sapiens
attagaagtgatcaggcgctgtcaacagaaagaaaaagggccaaccactggggaagtaagtagaattctgtgttatctttttctattttaattattggctrcttagtttagccatgcagattagtgcatatatagtaaattaaggttttcatactagaagatattccttaaaaacaaaatgagatgcattcagattgtatc

SEQ ID NO: 12997 - DNA, 201 bp, Homo sapiens; identical to SEQ ID NO: 1554

SEQ ID NO: 12998 - DNA, 201 bp, Homo sapiens
tattatttcttaggtatttcatttgtcatttgtcttcatattatatatgcttaaaatgttatttctagtctgggactttttaaatgatgcaatataattawttttttttaaggaaatgtgtgtttaatggtaggtaaattgtgacgcacattagatataacatatcttttcttaaacttatcaggaactggagaagatgat

SEQ ID NO: 12999 - DNA, 201 bp, Homo sapiens; identical to SEQ ID NO: 1556

SEQ ID NO: 13000 - DNA, 201 bp, Homo sapiens
gcgccccggcatggcctccgtcctgcccgccccacagagggggtcggctcgttcgttcgtgtggtcccggagggcaccgcggactgggggtgcctggcccrtcccctgcctcattccgtgggggcgggaccgcggggcttgggggccacacgggcggcccgcagctgggccctggagtgcggccccagcgtctcttcctca

SEQ ID NO: 13001 - DNA, 201 bp, Homo sapiens
ctccacagggaaggtagaagccattagatcctaactttatgtcctcctctcctgtccctcaatctattgctcacctgtgaaaatgcttacctgtgtctatrtttatctgtacctctttccttactgctttagaagaagaggctctgtcctgtccaagaataatcactctgtcttgtgtatactttcaagtctttaattatt

SEQ ID NO: 13002 - DNA, 201 bp, Homo sapiens
ctgggagtgaggcggctcacccagaacgcaggttgtcacttcagcttgtgcatataatttcattccttcatttatcaatatccagcaagcttttattgtgygcttatttgatagatactgtgctgggtactgggcaatcaaaaacaaactaaagaacccagtctcctggggccagcagtctgtaggtcatgatgacctctc

SEQ ID NO: 13003 - DNA, 201 bp, Homo sapiens
gattatttttagggtaaggctgtaaaagaagtgactccgtctgcctacgctgagcaccttcctgctgctgctcattcagcaggtgtttgaatggcttttaygtgttcaggattacacgctatgcgagagatggctacagcaacagccatcatgttctcgtgaacctctgtcttcatggagtttaaattctggtcaggaata

SEQ ID NO: 13004 - DNA, 201 bp, Homo sapiens
ggagttaataattttggactacattccagattccttgtttcagttgagtgctttttctattattccacgggtattttacacaatactgctctctttagtaygcaaggctgaattttgggaaattgccatttttaacccataaagcccacaaattcattataatttagcttaatagcataaatattgagttaacctctggaa

SEQ ID NO: 13005 - DNA, 201 bp, Homo sapiens
gatgatatggaaggagattctttctttgatgatcccattcctaagccagagaaaacttacggtttgtgagtaaatggtttttgagctatgagactaggggyttaaaaataagataaatgttttcattttatagttaaaaaataatgaactatggaaggtttataattattggatccataaatctgactatgcgttgttaat

SEQ ID NO: 13006 - DNA, 201 bp, Homo sapiens
tttttcacttttgtggtgtttcactctgttgccaaaccttttagcttttttctctgactgctctattctcttaccaaagcgagggttttccctcctgtttstgagtggggagctgccgagaattgtcatcctcaggagggaatgtcgttgctggggctgcagagttgctgggtacaggcaggagggtggtgtgctccttca

SEQ ID NO: 13007 - DNA, 201 bp, Homo sapiens
tattcaaagaggaaatttgtaacttaaaaaatttagaaacctttcttccattaatttagtgtatctatttcataatgttaatttaaaaaattcagtttttraagatttgcttacttacctttttcttgatctttataggtcgtttagtggctagtcttgttgcagaatttcttcagttttttaaccttgactttactttgg

SEQ ID NO: 13008 - DNA, 201 bp, Homo sapiens
tggagaaagcatgaaatctttctataagaaagtaaggcgagaaggcactgtggaaacccggagggttgttgggcagttttaaaggtccccttgaggttagyggtcatgactttaaggggagttcatcagcatggctgttagtggcttctgtaagcaatattaaatctgagaggtggcacttatttgctagtaaactcctgt

SEQ ID NO: 13009 - DNA, 201 bp, Homo sapiens
ttcattcattagtaagacagtctctttgagtttaaagatgtctttaaactctgaaaatatcttctttactccttgagaataacttctgctatttttttgtrcacttgtattttaacttcttttctagctgcaaggtctcgaaggtcgagagaatttagcccgagatttaggtataattgaagcagaaggtactgtgggtgg

SEQ ID NO: 13010 - DNA, 201 bp, Homo sapiens
gattgatggagaggtctgagctggagatgtaaattaggagtcatcagtttgtagataatgtggggtgtgggagactacagaggatcaccaaggaagcaggwcctgcgcaccttgaggccagagcagggagctagaagcagcagaggagatggaaccaggagagtggtgtctgtggaggtggcggtagggaggagtagctgt

SEQ ID NO: 13011 - DNA, 201 bp, Homo sapiens
gtttcttttcccttcaaggctcaattttatagataagggcagtcctgatcatacatctggctgcatttgcacaaaacagtacagttagcccatcccttccygccttggatcctgatgttcacttctcttcctaataaatatcctctgtggcactattttcccccagaatagggcattttcgtttgccttaaaaacctgttc

SEQ ID NO: 13012 - DNA, 201 bp, Homo sapiens
ggaaatccaaagtaggctattgagtgtatgcgttgggattgatggagaggtctgagctggagatgtaaattaggagtcatcagtttgtagataatgtgggktgtgggagactacagaggatcaccaaggaagcaggacctgcgcaccttgaggccagagcagggagctagaagcagcagaggagatggaaccaggagagtg

SEQ ID NO: 13013 - DNA, 201 bp, Homo sapiens
tcacctgtcagtacccacttcaagctgtccccagctcagaggagtctaccagtcaggttggaggttgccatggctgggtggggacttgctttccagaacawggtgggattctccaagcgctgtgattgtcacacagggagaaggcctttgagagaggtagcgtttacaatgcaaccacacaatctaagtcagcagcatccg

SEQ ID NO: 13014 - DNA, 201 bp, Homo sapiens
catggctgggtggggacttgctttccagaacatggtgggattctccaagcgctgtgattgtcacacagggagaaggcctttgagagaggtagcgtttacartgcaaccacacaatctaagtcagcagcatccgtgtttgcattcttattctttcatatattttcttatttaagctttaacctttgactctcagtttcttta

SEQ ID NO: 13015 - DNA, 201 bp, Homo sapiens
tctattttgcaagagagatggtggtagtgaaaattagagataagcgtgtaaagcatatagctcagtgcttagcagaacaggcattcaataaatggtatctratactattattcattgtagtcacaatagacatttctgtcgtaggcacagatatagacttcttccctcaaatttatgcaggatcagagagagaaaagccat

SEQ ID NO: 13016 - DNA, 201 bp, Homo sapiens
agacatctctttataatcattaatttatattaataacatggaatgtgtagctctctagaaggcaataaaatttgcacagcatatatcttgcctactgtcarctagtcaagacctctacctggtgtaaagatgtaaacgtatatcataagacatgcataatgcattctgtctgtacccatatgaaaagtgaaaccatccttc

SEQ ID NO: 13017 - DNA, 201 bp, Homo sapiens
ttaatagtttgtgcatatgtatataaacaaatagataaaatatttaaaatagagacctcaaagatgtatgttttggcccttcattatttattagtgttttytattactttggaagaaaacctgttgtttataatgaaataaaaaattagagcttttattagcttttgactttgactgtagaaaactagctataggttaagc

SEQ ID NO: 13018 - DNA, 201 bp, Homo sapiens
gtatctcgggatgaaactgttgcatctctacaagatgttcctattcttgtgcgttattacctggcccaggtgttggcacacttgttctctaaaaggccatrtagtgaatattttaggctttgcaggccataactactccaccttgccattgcatggagaagacagccatagacgatgcctaagagtgtgtgtgtgggtgtg

SEQ ID NO: 13019 - DNA, 201 bp, Homo sapiens
ccagatcccaggctggctgggagtgaggcggctcacccagaacgcaggttgtcacttcagcttgtgcatataatttcattccttcatttatcaatatccascaagcttttattgtgcgcttatttgatagatactgtgctgggtactgggcaatcaaaaacaaactaaagaacccagtctcctggggccagcagtctgtag

SEQ ID NO: 13020 - DNA, 201 bp, Homo sapiens
caaaagttttccttgtgccccttatgtaaccctctcccccaccccaaacctttttaagaattatataaatggaatcgtatagtaggtactctttttttttrgtctgtttcttcaacataatgcatttgaaattcattcatgttgtggtatgtattaataaatcatttcattaatacattgtacagatatgacagtttagcc

SEQ ID NO: 13021 - DNA, 201 bp, Homo sapiens
ataaacagttgttgacatttaattgtatttcacacaggtatttgaaaatatctagcttcaaaagcagtttataaaacatttaaaaattaaaaatacaaatmttcatatatggttttgttatattaactttgagaaattactaaatagcacaaagtaagtcctgtagtaattaacagttgtagaatggattttgtaaaacca

SEQ ID NO: 13022 - DNA, 201 bp, Homo sapiens
acacgggccgtgtatggtggctcacggctcacacctgtaatcccagcactttgggaggccgaggcgggtggatcacttgaggtcagaagttcgagaccagygtggccaacatgttgaaaccctgtttctactaaaaatacaaaaattagccaagcgtggtggcacgcgcctgaaatcccagctactcaggaggctgaggca

SEQ ID NO: 13023 - DNA, 201 bp, Homo sapiens
tgaacctgggaggtggaggttgtggtgagccaagattgcgcctctgcactccacagagcgagactctgtctcaaaaaaaaaaaaaaaaaaaaaaaaaaatmcaaggaattagctgggcgtggtactcgggaggttgaggcaagagaatcgcttgaacccggcagtcggaggttgcagtaagccaagatctcgccattgcac

SEQ ID NO: 13024 - DNA, 201 bp, Homo sapiens
agtaacatatagctagggataattttgaactgttaaggattacattactattgagagagagccaaaattattcttttttcgtgtagcttttgaatttgggrgtaatcttaaggtaccacagtaactctgatactaatgcttaatctgaaacaaatggtcataggagtttcttgaagaaatggtgccattgtcaatgtgtta

SEQ ID NO: 13025 - DNA, 201 bp, Homo sapiens
aatacttaatttcttattcattaaaaaccgtcttaaaaatagtttatagtaacatatagctagggataattttgaactgttaaggattacattactattgwgagagagccaaaattattcttttttcgtgtagcttttgaatttgggggtaatcttaaggtaccacagtaactctgatactaatgcttaatctgaaacaaa

SEQ ID NO: 13026 - DNA, 201 bp, Homo sapiens
caagatgtttttgtgttctgtcatttttcagacaattgcacatttgtgatcctttattcagtgcccctgctcacagtagactgctgggggccagtgctgcrtactaccaaggccttggctgctttttcatcctctcctaaagatcacaaaaattgactaatccagtagattagctgcttatgaaatttaaatattagaagt

SEQ ID NO: 13027 - DNA, 201 bp, Homo sapiens
ctgtattcgttaatacttaatttcttattcattaaaaaccgtcttaaaaatagtttatagtaacatatagctagggataattttgaactgttaaggattayattactattgagagagagccaaaattattcttttttcgtgtagcttttgaatttgggggtaatcttaaggtaccacagtaactctgatactaatgcttaa

SEQ ID NO: 13028 - DNA, 201 bp, Homo sapiens
acctcatgtttatgaagtgcccgttttccactttgtgatattttcacttgacggttgatgaggtgaagcgctgttgtgggttgagcatctgtgcacatgcrtacacctgctgtgcacacgcatacacctgctgtgcacacgcatacacctgctgtgcacacgcgtacacctgctgtgcacacgggtacacctgctgtgtac

SEQ ID NO: 13029 - DNA, 201 bp, Homo sapiens
ttttgaaatgtttgcatttttcttaccagatgagcatcccaaatctgaaaatctgaaagtccgaaatgctccaatgagcagtttctctgagcattacgtcmgcactcagaaagttctggatttcattcaagtttggttttcaaatttttgaatttgggatgcttaacctgtatgtattctgttaatcattttgacactggc

SEQ ID NO: 13030 - DNA, 201 bp, Homo sapiens
aggtgaagcgctgttgtgggttgagcatctgtgcacatgcatacacctgctgtgcacacgcatacacctgctgtgcacacgcatacacctgctgtgcacaygcgtacacctgctgtgcacacgggtacacctgctgtgtacatggaggagccactgaaactgctctcagcgttttcagtgctttggttttaatctgcaaaa

SEQ ID NO: 13031 - DNA, 201 bp, Homo sapiens
ttgtcccctagtatgagcttggcatctttggggctgtaaacaggcttgagcactgacatggggcctggagaatgtggtttctggctaggcagctggaacawtctacaaaatctgaggggaaagctgtccttaccctaaacctggggaggtccctaggttcaagtctgcaggaaggggatctggttcaggagaaggccgtcc

SEQ ID NO: 13032 - DNA, 201 bp, Homo sapiens
tactagcattattttttgttttcattattattattaacatagacccgtctaagggcagaaagaaatctgaccaagaatggagtgaaagtcggctgtgaagsttaggactccctgaaaacaaaaaagaaaagtggtaacatcactctgtatccaagggcatggataaggatgattcagaatttttttataacattgatgtta

SEQ ID NO: 13033 - DNA, 201 bp, Homo sapiens
ttcacaggtaaaaggggaaatacagttttgaaagatctgaaattgatcagtgataaaattggatcacttggattaggtaattagatttctagtttttgtgytgatcgttttaaagtgattatttttagggtaaggctgtaaaagaagtgactccgtctgcctacgctgagcaccttcctgctgctgctcattcagcaggtg

SEQ ID NO: 13034 - DNA, 201 bp, Homo sapiens
tattttaacaactttattgaggtaaaattgacctatagtaaagctaaagtatttaatatgtacaatttgatttttaatagttaatttatgcagctgtgaartgatcatcacaatcaaggtactgcgcatatccttcaaacttttgaccttcaaaagttttccttgtgccccttatgtaaccctctcccccaccccaaacct

SEQ ID NO: 13035 - DNA, 201 bp, Homo sapiens
atctccctgaagtcctttttccacattgctcctagattggctgtttatagtacacatctgatcttgtccctccattctcttaaaatatttcagttgactcmctatcttagaattccctgaaccagcctaccaactaccttgaggatctctcctctccttgtcttttattttaacaactttattgaggtaaaattgacctat

SEQ ID NO: 13036 - DNA, 201 bp, Homo sapiens
ttctttccacctgctcagccatcacctggctctgtgtctgtcaggtgtgtatctgaagtgtccccaagggagtgctctgctgcctcctttgtgcttgtttyttcttttccagattgccttatccccttcctacttgccagtctccgtttccgtggtgtccctcaccatctccctgaagtcctttttccacattgctcctag

SEQ ID NO: 13037 - DNA, 201 bp, Homo sapiens
gaagggctttccgagaagttggaacggtgccagccaagcgtgggagcaggagagcatagccagatcccaggctggctgggagtgaggcggctcacccagarcgcaggttgtcacttcagcttgtgcatataatttcattccttcatttatcaatatccagcaagcttttattgtgcgcttatttgatagatactgtgctgg

SEQ ID NO: 13038 - DNA, 201 bp, Homo sapiens
ctgtggtcatggttgccattagatgttcttttccactaaatctcagtggctaactgccaccagagactttactcctgacctctgcaccgtgatggccgccytgtcccctttgtgttctgtttttttcacttttgtggtgtttcactctgttgccaaaccttttagcttttttctctgactgctctattctcttaccaaagc

SEQ ID NO: 13039 - DNA, 201 bp, Homo sapiens
ttagacctgtatacctaatctctaatttcatcaaaatcttcagttctttgccctttccatgtctgtgcaggcatcagtcttctcttggcagcattttgctytggaccctatgggtctggacccctaattaccttgccttaacggtcatacgtggtctggaagaaatctcagtggtcatttaacccagcaaactaactcttc

SEQ ID NO: 13040 - DNA, 201 bp, Homo sapiens
tgtgctttggctcacctcattgcagtggtgtttatgcatatttttctgtctagattgatctttcttccttaacataccactagcatggactctggaaccasgttacttgggtgaaaccccagctctgctacattctagctctgtgagcctgcagtcactcagcctccgtgtgcccaggttccttatctgcaacatggagat

SEQ ID NO: 13041 - DNA, 201 bp, Homo sapiens
ctctatatttaagtgggtaatttaactttttcggagtcccaccaaccatcctgagtaaatattctggaatttgtcaacaagaatagaaccatcatcaaagycttaaactcttgctgtatgacaaatcagtctactgtcctctcacttctttagacctgtatacctaatctctaatttcatcaaaatcttcagttctttgcc

SEQ ID NO: 13042 - DNA, 201 bp, Homo sapiens
agggcaaaaagtagatcttagagaattacaggatattatttgtctggagagtagggagaagggaagtgaggaagtaaatcctggaatggtagacctgggayagatttcagtggagaaagacagtatcctgttcaaagtgaataaatgaaatattttgcaggtaattagaatctagggatgtgtagaaggtttttgaggggg

SEQ ID NO: 13043 - DNA, 201 bp, Homo sapiens
tagtatgcaacttttcccaaaattatctgaccactcaattattttgacaatgaaaaagacagcgattattttaaaagtgcagccactactctatatttaartgggtaatttaactttttcggagtcccaccaaccatcctgagtaaatattctggaatttgtcaacaagaatagaaccatcatcaaagccttaaactcttg

SEQ ID NO: 13044 - DNA, 201 bp, Homo sapiens
taccaacattgtatagtgtttttaaatgctaaaattctattggagtgtaattggtatatttgtgttttatttttaaatgtattttaattttaaactaaaayattttagggtgcacttgatctatctgatgtacattctccaccaaagtcaccagagggaaaaacaagtgcacagacaacaccaagtaaggtgagttagctg

SEQ ID NO: 13045 - DNA, 201 bp, Homo sapiens
ccgttattctagtttagtctccgtttctcagttggcctcataaacccacttcagaaataccctagatagtccttgtgtagggttgcatctgttctaaaatraacccttattttggcacttaaaatgcaatttctctagtactaaaggacctggatttgggatccagtactttccctaccgtcttcttgctagctacctcct

SEQ ID NO: 13046 - DNA, 201 bp, Homo sapiens
cgtcggccgcgtagcccgcgcgcggagcgtaccctgctgcggccgttggccgttagcgcggcttcggcggttgtcttggagaagcaagatggcggcgacgrcggccgcagtggtggccgaggaggacacggagctgcgggacctgctggtgcagacgctggagaacagcggggtcctgaaccgcatcaaggtgaggccgga

SEQ ID NO: 13047 - DNA, 201 bp, Homo sapiens
aaagatgtaaacgtatatcataagacatgcataatgcattctgtctgtacccatatgaaaagtgaaaccatccttcaagagcgtcttgttcggtaatgtcyaacccagactttggtcaccatgcttcagtagttactactctttaattctttctcagccatccatcccttcctagatataatttgatctgaaaaatatgaa

SEQ ID NO: 13048 - DNA, 201 bp, Homo sapiens
tagttctttaaggaatctccacgctgttttccatagtggttgtactagtttacattcccaccaacagtgtaaaagtgttcccttttcaccacatcttcacygacatttatattattttttgattttttgattatggccattcttgcaggagtaaggtggtatctcattgtggctttgattttttaaaataacttaagacta

SEQ ID NO: 13049 - DNA, 201 bp, Homo sapiens
tcctaataattttctttgtgagatagttttacagcaggactatgtttggaccaagagaaagggcaaggacttatttgttgaaaaggattttacttacaacytaaatttctgaatatccgaagaataacaaaatgagaggatatgtggggggcagatgaacagacaaataaaagcatctcacagtatctcgggatgaaactg

SEQ ID NO: 13050 - DNA, 201 bp, Homo sapiens
atttttagtagagacggggttccactatgttggccaggatggtttcggatctcctgacctcatgatccgcctgcctcggcctcccaaagtgctgggattayaggtgtgagccactgtgcctggccttatattttttaaatcttatttgttagtttttaaacaatacttaaccttagttatttagcttcattttgaatcttc

SEQ ID NO: 13051 - DNA, 201 bp, Homo sapiens; identical to SEQ ID NO: 1555

SEQ ID NO: 13052 - DNA, 201 bp, Homo sapiens
gagcagctgtgtttttagcactagaggagcaagaaaaagtagaggtatgaagtttccagattttaacatggctgtattcgttaatacttaatttcttattyattaaaaaccgtcttaaaaatagtttatagtaacatatagctagggataattttgaactgttaaggattacattactattgagagagagccaaaattatt

SEQ ID NO: 13053 - DNA, 201 bp, Homo sapiens
aataactgaattatctagattaagatcgttttcagtccacgatttttcctgtattcactcttgtctgtagtttagcatttgtattaatataacactcaatyactttgtaaacgagatggaataccttactgatttcactctgtaataatgatgggaagagaaaattacagttccaaggtatcagtttgttttacagtctgt

SEQ ID NO: 13054 - DNA, 201 bp, Homo sapiens
tcatatgcattgctttcacacctgcagattcagtcgtatgtaaatggaaaaatggttataaaaaataataatacaaattttatttattatttatttatttwtttatttttttatttttttgagatggagtctctctctgtcgcccaggctggagtgcagtggcacgatctcggctcactgcaagctccgcctcccgggttc

SEQ ID NO: 13055 - DNA, 201 bp, Homo sapiens
gggtcggagagcttgtgtgactgagaacgtttcggaaggcgtttctgacctttgcacctgccctcccagctcgttggcttgctcgtgtttgttgctggatmaatgtgagcttgttgtgaaaattgtcttgaaattataatttcctgtttcttaacttctttttaaggctgaactccgagcagctgtgtttttagcactaga

SEQ ID NO: 13056 - DNA, 201 bp, Homo sapiens
aatatctttaagttgcttttgtttctgtggcagaataaaagtgtttagtggcagaacataagagcaccgattaactgtccttgtttcttgttaggaggaakgaacctaggaagcaagcaggaagtctggcctcgctctcggatgcaccccccttaaaaagtggactcagctccctggcgggagccccttctttaaaagact

SEQ ID NO: 13057 - DNA, 201 bp, Homo sapiens; identical to SEQ ID NO: 1549

SEQ ID NO: 13058 - DNA, 201 bp, Homo sapiens
cgtgggttgatggagctttggggagaggaaacagacagcagggaggcgagttgggggtagcagagagagcaagatggggatcggatgaggtggactcagakatgaggagctggacggcttttctttgagactggaagccctgaggatcttgatctggcgtacattacagaaggatcctgaggttgctggggaaggttggtc

SEQ ID NO: 13059 - DNA, 201 bp, Homo sapiens
acggaggttggagataagaggagagtggagaaagcatgaaatctttctataagaaagtaaggcgagaaggcactgtggaaacccggagggttgttgggcarttttaaaggtccccttgaggttagtggtcatgactttaaggggagttcatcagcatggctgttagtggcttctgtaagcaatattaaatctgagaggtgg

SEQ ID NO: 13060 - DNA, 201 bp, Homo sapiens
tctaccaaaatacaaaaaattggccaggtgcggtggctcaaacctgtaatcccacattgggaggctgaggcgggcggatcatttgagaccagcctggccamcatagtgaaaccctctgtctactaaaaccacaaaaattagctgggcatggtggtgtgcacctgtagtcccagctactcgggagggcgaggcaggagaatt

SEQ ID NO: 13061 - DNA, 201 bp, Homo sapiens
ttttgtttctgtggcagaataaaagtgtttagtggcagaacataagagcaccgattaactgtccttgtttcttgttaggaggaaggaacctaggaagcaascaggaagtctggcctcgctctcggatgcaccccccttaaaaagtggactcagctccctggcgggagccccttctttaaaagactctgagagtaagtgccc

SEQ ID NO: 13062 - DNA, 201 bp, Homo sapiens
ggaattggggtagttatgcaggtgagaactaccagttcactagctggatgtttgtcatttagctaggcattaggattcagtagaaataaagttttatttcrttttgcaacaatgttgttttctgtttgggttgtttacattttaaatatacagtactctaggtattttgagtaatatgtagacagatgttagtggaccagc

SEQ ID NO: 13063 - DNA, 201 bp, Homo sapiens
tgttaggaggaaggaacctaggaagcaagcaggaagtctggcctcgctctcggatgcaccccccttaaaaagtggactcagctccctggcgggagcccctyctttaaaagactctgagagtaagtgcccaaagatgtggacttcaatactcgggatattttttctctaattaaatactatgtgattattgttgattttttt

SEQ ID NO: 13064 - DNA, 201 bp, Homo sapiens
tgtggaccaaggtctctgttaagcacatcatgtacctgaatccttatgttaactctgattggtgtggctttggctgtacgtcagagcagaggacatggccmagaaagggcacctcacattcccaggtcacagagctgttgagtggcaggtctgaggcctgagcctggctctgtctgactgaaggtgcccttatttgctgtg

SEQ ID NO: 13065 - DNA, 201 bp, Homo sapiens
cacttcataaaacttttcaaaatcttacaagttcccgtcgatttgtatgaagcttgctatcacagggatcctttgtttccctttcaagactcaaaatgtaygttttagatatttttattttgtgatgtaaaatctatttttatagttttgaactaagttggtcactttgagttcttattctaaaactaaggaggcatgaaa

SEQ ID NO: 13066 - DNA, 201 bp, Homo sapiens
gtgtagctctctagaaggcaataaaatttgcacagcatatatcttgcctactgtcaactagtcaagacctctacctggtgtaaagatgtaaacgtatatcrtaagacatgcataatgcattctgtctgtacccatatgaaaagtgaaaccatccttcaagagcgtcttgttcggtaatgtctaacccagactttggtcacc

SEQ ID NO: 13067 - DNA, 201 bp, Homo sapiens
agtctggcctcgctctcggatgcaccccccttaaaaagtggactcagctccctggcgggagccccttctttaaaagactctgagagtaagtgcccaaagaygtggacttcaatactcgggatattttttctctaattaaatactatgtgattattgttgattttttttcccaggaaaatcactaaaataacctatcatttt

SEQ ID NO: 13068 - DNA, 201 bp, Homo sapiens
ttaactttctagtttacaagtagtttaaacagaagtagaaatgagtcgtttcttacaacactttgtgaacccggggctgggagtctgagactccatgggcygtcctgtctgcccttctgttttcacttcatgatctggcttcaggtggcacagtgttaaagtgtgtcacaccatgtcgagtttgatgttagaaacttaacg

SEQ ID NO: 13069 - DNA, 201 bp, Homo sapiens; identical to SEQ ID NO: 1553

SEQ ID NO: 13070 - DNA, 201 bp, Homo sapiens
cttgaactcctgacctcgttcctgccttagcctcctaaagtgccgggattacaggcgtgaaccaccgcacctggccagtactacatccattttattgaatrattttgaatgacttaaagttcaactatgaaaaagctttcttttcacatgtactttttgattaggtattatcaacttatgaaacttgaagatgtgaagtga

SEQ ID NO: 13071 - DNA, 201 bp, Homo sapiens
ggaaaatgtcaagaaagttgttaggaaatttttgaaagtttccatccctttgaaaatatgttgtctaaaattataacttgctatttattttttcagacatytctttataatcattaatttatattaataacatggaatgtgtagctctctagaaggcaataaaatttgcacagcatatatcttgcctactgtcaactagtc

SEQ ID NO: 13072 - DNA, 201 bp, Homo sapiens
ccaataactgaattatctagattaagatcgttttcagtccacgatttttcctgtattcactcttgtctgtagtttagcatttgtattaatataacactcaattactttgtaaacgagatggaataccttactgatttcactctgtaataatgatgggaagagaaaattacagttccaaggtatcagtttgttttacagtct

SEQ ID NO: 13073 - DNA, 201 bp, Homo sapiens
caagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctct

SEQ ID NO: 13074 - DNA, 201 bp, Homo sapiens
tccagtactttccctaccgtcttcttgctagctacctcctaccaaatcagccttgagggcccacggagaatgctagaaactctccaagagtagggtccacscaacctttaggaaccagctttgtgtgctcctgagaaaggtcagatgaggtcaggacaagtcttcaaggaagttgcctaggaactcaagtgaggcttattt

SEQ ID NO: 13075 - DNA, 201 bp, Homo sapiens
atgctttttcacattacgtgtaggttttggggcatatgtttttgtatctttggcagtcacctgaggattttccaaaccaggcgttaccattccctgtcacdctctcacaccatcctgaatgaatggatacatggatgcatgaatgttcccacacttagccctgtagtaaaattacttctctaaataattcattagtaagtc

SEQ ID NO: 13076 - DNA, 201 bp, Homo sapiens
tccaagagtagggtccacgcaacctttaggaaccagctttgtgtgctcctgagaaaggtcagatgaggtcaggacaagtcttcaaggaagttgcctaggarctcaagtgaggcttatttagaatgccgctaaaatgtagcatgaaagagctgattctccacccagtagaagctgagcaggtggaggctaaggtatctgtgt

SEQ ID NO: 13077 - DNA, 201 bp, Homo sapiens
taggaaccagctttgtgtgctcctgagaaaggtcagatgaggtcaggacaagtcttcaaggaagttgcctaggaactcaagtgaggcttatttagaatgcygctaaaatgtagcatgaaagagctgattctccacccagtagaagctgagcaggtggaggctaaggtatctgtgtttgacctagtaactattggaaacagt

SEQ ID NO: 13078 - DNA, 201 bp, Homo sapiens
tacttgccagtctccgtttccgtggtgtccctcaccatctccctgaagtcctttttccacattgctcctagattggctgtttatagtacacatctgatcttgtccctccattctcttaaaatatttcagttgactcactatcttagaattccctgaaccagcctaccaactaccttgaggatctctcctctccttgtcttt

SEQ ID NO: 13079 - DNA, 201 bp, Homo sapiens
ttcatcatccagatgctatgttgcatgtggtggttgaggttgtacacagcaagactccagatggagccatccgcatggtaggtgagtggcatctcccaagrtatgcaaagccatcatgggagccctgcctgtcctgcagacgtgaactgggcatgcgatgcaggagggcctagggtaccgctgctcccggagctctggagc

SEQ ID NO: 13080 - DNA, 201 bp, Homo sapiens
ggagtgtacctcaaaatgagacccagtagcatgcctgtgtagtgggtgtgatgtgaaaatggacacagaatcactgttcttcagtacttcattctgactcrtggatttgaggcctcccctgaagtttgccctgactttttcatagctgtgattctgtcaaatagagccaggataggaattctgtatcctcaaaaggtagtt

SEQ ID NO: 13081 - DNA, 201 bp, Homo sapiens
aaataaaataaagattaaagataaaagatttggtatacaaggagtataaatatgaaatgagagggcattttaaaaatgaattaataattttgaaatatatrttaatacttgctgacttccaaagtatcatctgtgataatttatctcattgtattccatttcgttgtaccaaacatcctaattgtttggaaaaaaaaaaaa

SEQ ID NO: 13082 - DNA, 201 bp, Homo sapiens
cctacatgaacagtttggaaaaaaattcttttttttttttttcaggttcttaagtcagtctgatacaattcagtttttgactactgaaaaattaaggtttytcattgtgaaacttctctagtgctgactttttgttaatctagaaatgattggcttctttattatatgagtgtactattggataatttaaatatatactaa

SEQ ID NO: 13083 - DNA, 201 bp, Homo sapiens
ttaaaaatgtgaaatcaaggttcgcggagggctgtggctcctgttctagcttctggtggctgctagacccagatgctgtttggcttgtagatggattactycagtctttgcctccatcttcacatggacttctccctgtgtttctctgtgtctcttccccccagcaaggataccactcattaggttaggacccaggcccac

SEQ ID NO: 13084 - DNA, 201 bp, Homo sapiens
ggcggcgattacagctcactgcaacctccaacttcctggttcaagcgattctcctgccccagcctcctgagtagctgggattacaggcacgtgccaccacrcccagctaatttttgtatttttagtagagacggggttccactatgttggccaggatggtttcggatctcctgacctcatgatccgcctgcctcggcctcc

SEQ ID NO: 13085 - DNA, 201 bp, Homo sapiens
caataactgaattatctagattaagatcgttttcagtccacgatttttcctgtattcactcttgtctgtagtttagcatttgtattaatataacactcaawtactttgtaaacgagatggaataccttactgatttcactctgtaataatgatgggaagagaaaattacagttccaaggtatcagtttgttttacagtctg

SEQ ID NO: 13086 - DNA, 201 bp, Homo sapiens
taactgaagtttatgtacgtaacataagttcgtcttaactcatgataagggtttttaaagcagattcccgggtatacatacgtatacagatggtccccaaygttacaacagtttgatttatgcttttttgactttatgatggtacaaaagtgatatagattaagtagatagcatacgttgagttttgatcttttcccagga

SEQ ID NO: 13087 - DNA, 201 bp, Homo sapiens
tccaataactgaattatctagattaagatcgttttcagtccacgatttttcctgtattcactcttgtctgtagtttagcatttgtattaatataacactcwattactttgtaaacgagatggaataccttactgatttcactctgtaataatgatgggaagagaaaattacagttccaaggtatcagtttgttttacagtc

SEQ ID NO: 13088 - DNA, 201 bp, Homo sapiens
ttttcacttgacggttgatgaggtgaagcgctgttgtgggttgagcatctgtgcacatgcatacacctgctgtgcacacgcatacacctgctgtgcacacrcatacacctgctgtgcacacgcgtacacctgctgtgcacacgggtacacctgctgtgtacatggaggagccactgaaactgctctcagcgttttcagtgc

SEQ ID NO: 13089 - DNA, 201 bp, Homo sapiens
atttaggtagaggtcattctctggaagattgaaaggagagaaccagtgattttgaagaaggggaacaacgtggaggatcttttttatccatagctcagttwgcaagtatgaaatgcacattgactatagaccctgccttgcctgacatcatttattcatgcattctccactcaatcatttgttccacacatctgatgtgcc

SEQ ID NO: 13090 - DNA, 201 bp, Homo sapiens
tggataaactagaatgtgcacatgaaggaaaagaacagggtgctctgagggaaaccaatttagtgaggattgaaaatttgggaacagcttttctgtggatwtgacacttgagcttgggggtaagaaaatgttagtctgggggtgactgaagggaaaagcatttggggtaatgggaacagcatgtgggaaggatccaaggca

SEQ ID NO: 13091 - DNA, 201 bp, Homo sapiens; identical to SEQ ID NO: 1572

SEQ ID NO: 13092 - DNA, 201 bp, Homo sapiens
aggtgtctggtgaagcaagacagtttggaatccacaaagccatcctcagaaacaaagatacaagtgtttccccaactgttagcttgcagttccctctaaayagttttcacgcctccatttaaaaatagttggcataatgatgttttctttctctaggctttgtgaccacgtttccatgggggaaaatgtgaatagacgtag

SEQ ID NO: 13093 - DNA, 201 bp, Homo sapiens
ccctttcctggtaacccagtcccatcaccccagactcaccttttacaacaactgggccctctaatcccacattcagccaatggccaagtttccctggtttygccaaggactttttccttcagttcaactaaagcgagggatctgattggtcttttaccaagctgtcgtgaagtaagctatagtaatcagattatctgctac

SEQ ID NO: 13094 - DNA, 201 bp, Homo sapiens
tccctcccagcatccaagaagagctcccttttatgttctttgtacatgggaggtctaggtagagttttgttcaagaaaaaaaaaaagtacttcaaaaaaarcaaataaatttgaaagctacacacctaattcagtccattctttgaattacagtttgtgaagctgagccccagaaaggtcaaattgagtgagttaagagtt

SEQ ID NO: 13095 - DNA, 201 bp, Homo sapiens
aatcctggagtttggtttcaggcttaccaagcagatagaacaggggtagcaccttgagtaaatgtcttattgtctaggagggtagagaatcttttgaattyttggctcaatctgtgggttataagatctattccccacctcactacatgggctttggattttagcactggaactgacctttagaatcacccctctcattct

SEQ ID NO: 13096 - DNA, 201 bp, Homo sapiens
cttgtgagataggaagaaatgataagatgttgctctttgccatgcatttgatgttctctattaatgttttaccattttagacagataactttcagtggttstgatttctataagttggacagcacagtgaatagagagacctgtattatcaccctcccaaattatcatgaaaaagaaaaagatagacagtgataatactgg

SEQ ID NO: 13097 - DNA, 201 bp, Homo sapiens
ttcgaggtcaggagaggtaatcgcatcaaacttacattttaccgattaaatgaggcttcatttttagaatctagattgaggggagagatgttcaaaaggcyccatttccagacccaatttccagttctctcctaagtgaattcattggaggtgttttaagagagggaatttgcttcattctttattcatttccaaactcat

SEQ ID NO: 13098 - DNA, 201 bp, Homo sapiens
tttggccagaaatgaggaagacttctaacatgattgaaaccatggcctccaggaaaagactgaatttcaaatgtgacagtgatggatcaatgctcagttcrgatcatggtcaagtagatcttccccgagatgtagtgctgatgaaggaagctttcgggatggtctaaagttctttttctccctcttgtctgatacttcagc

SEQ ID NO: 13099 - DNA, 201 bp, Homo sapiens
ctgattcacatattcttatccagtgttctgcctcttttactggtgaagatgttaagacatatgagcagcccatcaaaccaattaattgttggaaatgtgayggttttcttccatgttttttttttttttcatatggaaaaaaaccctgtgggttgactttcacaagctcgatttgatccctgtgacaaacaccaccttcct

SEQ ID NO: 13100 - DNA, 201 bp, Homo sapiens
ccctttccagccagtgatctatggtatcctaagacttcttccctgagggtgtgagatggagcaagatggcattctagcctccaagaattcatcacatcctkggcagaaacaagatccctaaaagcaagcataggatttggcccagaagtcactggcaggagccccgtggttctcatcctaggctgattcacatattcttat

SEQ ID NO: 13101 - DNA, 201 bp, Homo sapiens
accctctgccttgggctcctagctcatcattctcccctctgcctcccagaggccggtagctttacccgttggttctcctggtagcatcttacctgccacascttgcctattctttgctagaactacagggacctgatgagagaaccacattccttcctgctggcctcctaaggaaacaggctgcagtttacctaccaggct

SEQ ID NO: 13102 - DNA, 201 bp, Homo sapiens
ggcctagaaggaaacagggtcatgggagcacaaaggttgaaagcggaactcgtgtgggtggtaagatcccttcctgacctgcattcttctagaggtttggmccattccactctccctagcccatctcacactcaccaacacacccacccactaaaacagagtcctggaacttcctcttcaagttttccccattgaaaacaa

SEQ ID NO: 13103 - DNA, 201 bp, Homo sapiens
ggtttggggcagacttctcactttcctggccatattgtgaagctcctttacaatgcgggaagtaaacagtgtcgaggccaatatactcatacaatatgctstgtgtagacacagagcgaaggctgagaattttctgtaagaaactgcagaaaagcaaactaatgaaggaatgctaatcccaaataatcttaacttagaaga

SEQ ID NO: 13104 - DNA, 201 bp, Homo sapiens
ccaggtctcttagtaattacggtccttggccaccagcaagctattgggggaaatcatctcttgaatgggcagagagaggtacatttttggtagctgtaaartgatatcacagagtcattcattctcattcattcttgtgttcagaagaagagcccatcttttaagtacagtgaattctgttagtgacatacaggtgtacag

SEQ ID NO: 13105 - DNA, 201 bp, Homo sapiens
gctcagcatctctctgactgatgtctactgctaattccttaaatttacatatcatctttcttccctggagctcatagcacttaacagacaagtggggcacraatgatttaacgaagtgaaatccagaggcctgctcgtctggagattctgcagactagtggattagctcagatgtcagcactgaattatgatccttcagct

SEQ ID NO: 13106 - DNA, 201 bp, Homo sapiens
gatattgaacagagctttgactgcctggtcaaagcctatgggattgagggaacagaacctttactctaggctcaaaaacaagctcaaatgggagtaagtcragaatcttaatgttataaaatacccaaattttacaaacagtggctggctattccttcaaatgtaagaagtaagattgttaacacctcactggggctattt

SEQ ID NO: 13107 - DNA, 201 bp, Homo sapiens
ttttctgtttgagagaggagaggactgtgtgttccatctaacctagtgactcatatactattcctcttatggtcaggacagcaggagtcctctcttgatcmgggcataaaatcagccttttcactcaaaaaatggaaacagagaaatcagggggcaggcaaggtatggaaagttgatgttgaaacactgccaaccataggc

SEQ ID NO: 13108 - DNA, 201 bp, Homo sapiens
tattaaatgttcattaaacaaaatgagggaagattggcaaagagactagagaagtgatggagacataaagatataggtagatggcaaaatctgtggaaccygcaagcacagccgtttgacagttagaggaactacactgatggagtggatgactccagaaaatggctacaaagaagaatgggaggaaagccaagaataaat

SEQ ID NO: 13109 - DNA, 201 bp, Homo sapiens; identical to SEQ ID NO: 1621

SEQ ID NO: 13110 - DNA, 201 bp, Homo sapiens
cctgggtttaacattctttacaccaatcagctgacccattttgctacctaacatttccagaaactgttctccataggtcacgtggctatgtttgcttttcraatttccatctgtttctcacactcatcttcggttcacttcttcatccctatcccaaaggataacaggaaaaataatgggctgggctgagctgctgcagct

SEQ ID NO: 13111 - DNA, 201 bp, Homo sapiens
tgtgccgcatttaatcaggatgcctccatgcgtcccaagaaagcagacgcaagagctcaggagagaaacaaggccatccacaccacaaaggagccagaagmcttccaaatgtcaatgcactgctgcatttttccaaacttgttgccggagcggcctttaacatccccaacggcctgctgtgatccaccagctaaaaacatc

SEQ ID NO: 13112 - DNA, 201 bp, Homo sapiens
agtggtcagtcacactgttgctggggcattgcaagcctcctcctggcaaacgcagcctggttacacaggccacatgcacagcacatcccaaatctttatcyaattccacatgccataaatatggaacctatgattctcatacagggtgggcccgccttatgtatatttatggcataaccacaaggcagagagctcatctgc

SEQ ID NO: 13113 - DNA, 201 bp, Homo sapiens
agagatttcttaagtgttgctttaacaggttgatgcaaaataaataaacagaaagggagggagagggagatggatggttttcagtaaataatggtgcagcrgccagcagttggaagggagctggtgggaggaagtttcccacctaagcagttgtgacaggagtattaactgggagcccaaaagcagcacaaacgcagcaca

SEQ ID NO: 13114 - DNA, 201 bp, Homo sapiens
cgttcccagcaggctcccgttttttggacagacggggaagttatgatttgccctcacaattggatcccctgggagccagaattagtgtgaacacctattcsggagggaactgttcaccctgccgagtaaaggggcactgccagcacaccaggggccccagacgctgtgctctgattgcccttcagtgaccacccatgcagg

SEQ ID NO: 13115 - DNA, 201 bp, Homo sapiens
aatttttcgtttaggagagattatggataatgaaatgcaaacactctagttaatatgtctgttagctggtttatgttgccttctggaaaacgagtgatacrttctaagaggagcagcttttcaagttatcctacttgactatcgttggggtgagctctgagtctgtaccccggattcctttaccaaacactggatattaga

SEQ ID NO: 13116 - DNA, 201 bp, Homo sapiens
gcctggtgagtggtggggagaggtgatattaaatggccctctctattcagggactgtcactacagatagcgttctttgtccttagattagcatcttggcartgacataaaccgggatctctgcttaaggttaataatccaaactactcttttactttgttaaatatttaaggcttggagtcattctttacaattgagcttt

SEQ ID NO: 13117 - DNA, 201 bp, Homo sapiens
tctgttttcagtattcttacctcctattttctttttaatctctcatttcctttccttttcctccccttccatccttcaacactgagagtgtgctcagcagrgaacaccgtgtttaaggcgctctcccgaatgtgtaataacttctactctggcactaaggcccttcagcagctgaactcaaaaaagtcatcataaagacaa

SEQ ID NO: 13118 - DNA, 201 bp, Homo sapiens
aatgccgcatggctacttcctccaataattgcatttttacaggggaccacacctgaagccaggtctcttagtaattacggtccttggccaccagcaagctrttgggggaaatcatctcttgaatgggcagagagaggtacatttttggtagctgtaaaatgatatcacagagtcattcattctcattcattcttgtgttca

SEQ ID NO: 13119 - DNA, 201 bp, Homo sapiens
gaaaggagccccagagatgcctcattcgccttggccaactgtggcctaagaggatgagccccatattagtgtttacaggggtcctgggcccacaaacccaycactgctttctggctctgcacctcctgatgtggctagggtctccacctctttctctgtggaggagctggtcaccactcatctgcctttgtgccaggtgca

SEQ ID NO: 13120 - DNA, 201 bp, Homo sapiens
gctttgcatcagaatcacctaagatgtgtgttaaaaatacagattcccaaagaccactccagacccaaggaatttcacctgcaggaaaatggttcccaggratcagaatttttaacacttcctccaggtgatgctgatataccctaaggtttgggactgtctagctgggaacacttaactttccacaggggtgtggcttgg

SEQ ID NO: 13121 - DNA, 201 bp, Homo sapiens
ctctaagtgtcagctccccagagctgtggtggctgtgtcactggagttaattctgtccctgggttcatcaggcagagtcctgttctccatgattaatgagwtccacttgctttcttcaaagaatgcctgtgctgtgccatgctgttatttatttatgttttctactaaaaaatttatgtaaaaaacatcccttaaggtcag

SEQ ID NO: 13122 - DNA, 201 bp, Homo sapiens
ccaaagtcagtgtttcccttaactggttgctaatttgaggaccttagcagagataggcagaccttggaaggccagctgagggctgactcatgttttaagcrtggactatgcaaagagactacatctcctacagcactaaatattctttcagatggtcgttctagtaggagggcaagatgctagccaggagatgtgcgtgtt

SEQ ID NO: 13123 - DNA, 201 bp, Homo sapiens
tcatttgacatcttgagggtaattcagtacatactaatgcatctaccccatcctttatatctgcagcatagcattccatattgtgttgatatgccagagtrtattaactgctcccctgttgatgagtgttcagactgtgtctagttttttttttttttactattataaacaatactgcaatgaacatccttgaaattgctt

SEQ ID NO: 13124 - DNA, 201 bp, Homo sapiens
ctataaaactttgaggagaggcacttggggaaacttactcagaaggccaggtctttcttgatgagtatttttctttggtcctcctctttagatggtgaccyagttatataaaatatttctatcagaagggaactgggttgggccaggtgggggaaaatctaggaaaggcagcctcccagcagttcatggtttctagatagt

SEQ ID NO: 13125 - DNA, 201 bp, Homo sapiens
aagggtttgaagtgtttcttttagcctgtctccccaaaatgtgagatggccattggcgagcataataatttgcaagtaaactgtaaactcctagattttaygcagacggcctgctctgggctctagggattggtctcatgcccacattaaatgggtacccagtaaacatttcccccgtgatcagctcctggaggtagggaa

SEQ ID NO: 13126 - DNA, 201 bp, Homo sapiens
cgcctccatttaaaaatagttggcataatgatgttttctttctctaggctttgtgaccacgtttccatgggggaaaatgtgaatagacgtagttacagtascatttggatgagacgccttcaagcacctatactttttcgggggaacttgatggaatccaatttaattacctgaagaaattatttgctgaagaaagtcttt

SEQ ID NO: 13127 - DNA, 201 bp, Homo sapiens; identical to SEQ ID NO: 1649

SEQ ID NO: 13128 - DNA, 201 bp, Homo sapiens; identical to SEQ ID NO: 1631

SEQ ID NO: 13129 - DNA, 201 bp, Homo sapiens; identical to SEQ ID NO: 1633

SEQ ID NO: 13130 - DNA, 201 bp, Homo sapiens; identical to SEQ ID NO: 1636

SEQ ID NO: 13131 - DNA, 201 bp, Homo sapiens
tacaggaagttctgttagtacagatggttcagtatagatgtcactatctgtcccttgcaggagaataaagtagaatgtcagtgatcagagcattttttgtktccccagtgacaagctcaattaccccttttgtctaaataacatttggctttccttaaagccatttgttcccattagtaaagaatgaaataaaaatatctc

SEQ ID NO: 13132 - DNA, 201 bp, Homo sapiens; identical to SEQ ID NO: 1648

SEQ ID NO: 13133 - DNA, 201 bp, Homo sapiens
ccaccatggccacaaatatgagagagagagaggcctttctcagctatggtaatgaaactagtaaaagacagaattagtttggggacaaagacaaagagggyaggcaataaggtgggagaagaggaagatgtataaagggacattcaggggatcctgggattctggggtcatttctaccccaggggttgtggatgtggctgt

SEQ ID NO: 13134 - DNA, 201 bp, Homo sapiens
aataagatagtagctgtatccccaagtggagacttccctcgcatccagccacgcaggatcagcctgttaccttatatagcggtaactggttttcttatagaaaaaaaaaagggtaaaaaaaaaaaaaatctaagtagttctaagattcacattggttcttgatagctgtgctacacaagtagagtctcaaagtcagtgtca

SEQ ID NO: 13135 - DNA, 201 bp, Homo sapiens
gggaaggtgctttgggtatggatttaacccctattgatttatcgtcttccttttctctagttggcaaaccacagcctcattagcatacagctctccaaggytggaacagggccagattctaaaccagcacactccacctgcctttggagttgagtctttttagctagtgaatgttctgagaaacttctagcccccagctgc

SEQ ID NO: 13136 - DNA, 201 bp, Homo sapiens
gatttggcccataggccacagtgagctgacccctgggttagagcacaggctgggattttgtccacctggttctagccgtgactctgacacttgctagcagkgtacagttcctcaggggaccctgggccatctcttgggtttcactgaatgcttctctgcccttctccacaattatcctccaagtgaaaccaggagaaaatc

SEQ ID NO: 13137 - DNA, 201 bp, Homo sapiens
tctgagcagagcacgggcagagagacgatctggtgccctacctgttagagactcacggaaatcccagctgggtgcacctgtggaaggtggttgtcagaggraaggattcagaatgactgtcctacgctagtggatgctaaaaggaacatcaatgtctcccgtttcagctgggaatgtggggtttatgactcagaccattcc

SEQ ID NO: 13138 - DNA, 201 bp, Homo sapiens
gcaagaggaggcaggacaccattttccaatgcagtcgttacccagtgggtggggcagccacagtctctgcaaggtaaggtgtgggtgtagttgtgtcttargctgggttcagggtgggaaggggtgtgaggtaaggggacggcttatatccctgttcccaatcagaaatagacatgcactaagtacatagaggttcagggt

SEQ ID NO: 13139 - DNA, 201 bp, Homo sapiens
ttgggtaggagtagacacactgtggaagaggtgactgagaaccagccaaagcattaaccttctcctccccagacgaggagcagcaacagatggctggtgcrgcagccaactgctcacccagcttgccagaggacatgtgctagtttgcagagaggaacctggggagggcgagcatgagaaatgactgaagaccacagagcc

SEQ ID NO: 13140 - DNA, 201 bp, Homo sapiens
tagagggagaagaagggcacgcacacaaccagccaagacataaggcagctgtgccgggtgctccatgtgaaagagatggaaaggaaatgataccgagaaayaggcaggagggaccgatttgacttagagactcttaagaaaacacagcatttgaatcaaggctctgaaggagccttaagaaagggtcacagagcctggaga

SEQ ID NO: 13141 - DNA, 201 bp, Homo sapiens
ggcatagaaaaagctaggaatccaaatgccaattcatatgcagtgaggcacgaatacaaatgacagtgagggaggggtctggggtcagtgaggagagacaycagggaccagatgattctggggaccctggtgtttttcatttcactcaagtcttccctaaagcaatcaggaaaatgaactgactcagggtgacctgagtgt

SEQ ID NO: 13142 - DNA, 201 bp, Homo sapiens
gcacagagtgcacgaggctgccggccagctgagtgcacgtggccgtggtaccctgctcccgcctccacaaatcctgcgataaccagtaaccagttctggcragtctttcagcagagaagataatgggaattgcaaattactagaccgaatgctaataataattgtttggatacaggagaaaaaataaaacagatgttcccc

SEQ ID NO: 13143 - DNA, 201 bp, Homo sapiens
caagtccaggatattcacagtccctgtggagtaagaaagctctgtgcatctgtcccaggttaacatgacctcacactaacatgatcctaaggcatctgacrtgcccacattccatgctgcatatgtggtagaaaagtggccctgccatcttgcagaagtattcagcctaagacgcccctatgtttcagggccaaaaagagg

SEQ ID NO: 13144 - DNA, 201 bp, Homo sapiens
tttttaatctctcatttcctttccttttcctccccttccatccttcaacactgagagtgtgctcagcagggaacaccgtgtttaaggcgctctcccgaatrtgtaataacttctactctggcactaaggcccttcagcagctgaactcaaaaaagtcatcataaagacaaaatagcttttacccagcaagggtcttaataa

SEQ ID NO: 13145 - DNA, 201 bp, Homo sapiens
agtattcttacctcctattttctttttaatctctcatttcctttccttttcctccccttccatccttcaacactgagagtgtgctcagcagggaacaccgygtttaaggcgctctcccgaatgtgtaataacttctactctggcactaaggcccttcagcagctgaactcaaaaaagtcatcataaagacaaaatagcttt

SEQ ID NO: 13146 - DNA, 201 bp, Homo sapiens
cccattttccttctccctacagagcttgatattgggctttaagcaggagaggagagaaagccctttctgttcagggtggtccttacttcttctccataggraaaaaaaaaaaaggagggggaggccctgaggggattggggagaagggaagcagctggcttggttgggggcagagcaactgctaatgggttcagagcggct

SEQ ID NO: 13147 - DNA, 201 bp, Homo sapiens
cactgagtgactttgaattctcctgtacttctggcctggacctgagacctccataagcactggagaggagaggggtgaattccggaaatttagtagatcastttgccagggtacaataggaaaaggctagaaaataaaagagggaaagggaccttcccttctgcaggcttccttagaactgcttctcaccccaagcactgg

SEQ ID NO: 13148 - DNA, 201 bp, Homo sapiens
agtgaagatacggcagtcatctgggtgatggagcgcgatagttgggttaatccagcagttacctgtgacttaattgtgtttccctgtgtctttcaccgccrccaatttgagaaagtataacagtgatgattctataagatagtgcactgtatcctctataactggagtgcagatcagagacaaaggcggaaatgtaaaaag

SEQ ID NO: 13149 - DNA, 201 bp, Homo sapiens
cctcactatcttgcttgtctgctaaaggagaaccattcttatccttagaattcacagctctgatagtttttcctgttaagctgtgtgtgtatgctacagcsaagtgaagatacggcagtcatctgggtgatggagcgcgatagttgggttaatccagcagttacctgtgacttaattgtgtttccctgtgtctttcaccgc

SEQ ID NO: 13150 - DNA, 201 bp, Homo sapiens
gaactgcagctttgaggatggtaagcacaaattgcctccagatggcatgggtgcggactagtcagagtgggagctggcctgtggctggacagggacctagkggtcccccagatcagagatccaggggatctcaaagaagtggtaagagaggtgggggcacttaggggtttggggcagtggctgtttacaaccaatgtagaa

SEQ ID NO: 13151 - DNA, 201 bp, Homo sapiens
cacttgaacttgccacaccctgacctaaagacatagccccaaatcactttcaccatgtagggtctgagcctctttaaatccatattcccgtccatccagtkttgtgcaaacatgagccagagtgtgctttggtccttccttggagtcagcgtcgcctgtagccccctccattattgtctcgtggccttttgtgctaaactc

SEQ ID NO: 13152 - DNA, 201 bp, Homo sapiens
cacttacagtaggtgtttggatccaggaaacacttgaacttgccacaccctgacctaaagacatagccccaaatcactttcaccatgtagggtctgagcckctttaaatccatattcccgtccatccagttttgtgcaaacatgagccagagtgtgctttggtccttccttggagtcagcgtcgcctgtagccccctccat

SEQ ID NO: 13153 - DNA, 201 bp, Homo sapiens
atctggtttcaatttcaggggtagcgttgctgtttgatgggcagttaccttggagcacccagtacaaacatagtacaaacagtataaacaccgaggcctcsgtgcccgccgttcctccactttcatttacacgccctgccctccggtgcctcattggcccctgggtttaacattctttacaccaatcagctgacccatttt

SEQ ID NO: 13154 - DNA, 201 bp, Homo sapiens
tcagtgccatgccctcccagtctggccagtgggacagttgctaatgacctctttccttcattgctccccaatcccaacatgccccaaattacactggtgayggtcagtgacaggtttcttatttcaaagccctgcctggccattccttggaagatcagagttgaggagcgttcccctctgcccagcctcctttcctttgaa

SEQ ID NO: 13155 - DNA, 201 bp, Homo sapiens
aggccctaccttcctttccttgggtcgccagccctcctccctcagcagagctggcaccagatcttacccagagctcactcactgcctgccaaaaggagttygtgggagccactggggctcagggactgagcctgatgccagcaggagcagccaccagcctgagctatcctgccctcctccgccagagccccaggtatcccc

SEQ ID NO: 13156 - DNA, 201 bp, Homo sapiens; identical to SEQ ID NO: 1613

SEQ ID NO: 13157 - DNA, 201 bp, Homo sapiens; identical to SEQ ID NO: 1615

SEQ ID NO: 13158 - DNA, 201 bp, Homo sapiens; identical to SEQ ID NO: 1617

SEQ ID NO: 13159 - DNA, 201 bp, Homo sapiens; identical to SEQ ID NO: 1618

SEQ ID NO: 13160 - DNA, 201 bp, Homo sapiens
taagcaggagaagtcgctgatggttgcagagttggctgtaagtagatttacagagtcccttggttgttacagctatgacagaaatgatttagaagtgatgsttggttagttggtttttccctctacccttattcaggaaaaccaagggaaactcacatatactttgctctagttacttttttttttttttttttttgagca

SEQ ID NO: 13161 - DNA, 201 bp, Homo sapiens
acatttgttcctgacactagttttaaaaacatgcttctggcttcccccagcctctgtcctgcattcctgccacttttctcttctgcctgctttgttttccyccttcttgagtgtctgtgccaagtacattgaaagggagaactttggaggcaatgaaacatttattagtggagagaaatatttattttaaaaaagaagagg

SEQ ID NO: 13162 - DNA, 201 bp, Homo sapiens
ttccccttattccttttgtggtagtaattttgtttgttgaatatgagatgaggacaatacctcacactgtaatgggcaccagccttcagaagtcatgttgygtgtgctctgaagggggctgataccccttccaagttcaagtccctcagtttatctgaccctctcaattataatggagaaggatccagtgccctaggtaat

SEQ ID NO: 13163 - DNA, 201 bp, Homo sapiens
acgataaggaaagtgaggtacttagcaattgaaagatgtgccaggccaggtctggtttcccactgacttggtttcagaaagacttaccaagcatccgttgkgaatgcccagcctgaattggcactgggtgccaggagcttgggggctgagacctggttccaccccacccttttcaattataaaccggtagatctcggaagc

SEQ ID NO: 13164 - DNA, 201 bp, Homo sapiens
gtagaacaataacaatgtggcatttaggatagagaagagtaggattgagaagaaaggagagaaataggagttggcaaaaaacaaaaaaacaaaacaaaacaaaaaaaacaaaaaaacccttcgatgttgtgatacatggtttcagacctgaacttcctatccatcacccgccctccccggccccatgcctagggtttccag

SEQ ID NO: 13165 - DNA, 201 bp, Homo sapiens
tggtacagataaccaatatttaaagttgcctttggaagtgtgggggttggagtgaaggggacaaaacccctgagataaattaattttactagtattaaaawtaaaatggccaagcatggtggctcatgcctgtaatcccagcactttgggagaaggaggtgggcagatcacctgaggtcaggagttcgagaccagcctggc

SEQ ID NO: 13166 - DNA, 201 bp, Homo sapiens
gccttgatgagaaatggtcagaggcttaatggtttcattgcctaacaggattcagtggagtaggattccaggacacagtggccttgtatcatggctggccytccaggagaaagcatcttctaaaggtttaggaagctgtcaagtttagataaggctgagctccgatcctctgggaccttggttgtattaataaggagaaat

SEQ ID NO: 13167 - DNA, 201 bp, Homo sapiens
taaaagtttaaacctggggtgtggggaattgagggagaaaagttcccctttcaagagtaattggagagaagtagaggaagggatggggaaaggagggagasagtgtgggtagggagagtggagagtatgtggaaaccataacagttactaaacaggagctcagctcaggtttcctctgacgaattccaaggcaaaaaagtg

SEQ ID NO: 13168 - DNA, 201 bp, Homo sapiens
atcctgtgtgatcagatacttagtctatgtgcctcggtttccttgtctgtaaatgtgtttggtaacaatacctacttcatagggttgttgggctatgtcarattatgtagaatactgtttggcacatatgaagcccattctgaagtcactgaatctttaaaactgtttcagtggggttagtggaatctcgtgatcgtagaa

SEQ ID NO: 13169 - DNA, 201 bp, Homo sapiens
aaaggcagggaggcatgttgagtttgcagtcctcttgtttttttaatcacagaccatgtaattgagaatatttatggccatgttctggaatactttcatctgtgtgtgtgtgtgtgtgtgtgtgtgtgtgtagttgggtgggtagggggagggatgagccggaataatctcttccaccgaatgagtaagtaggttagtctt

SEQ ID NO: 13170 - DNA, 201 bp, Homo sapiens
tgatgttcctttggtcacttcttaattggttaattcaccaaatcttgatgagtctgacttttgggaaaggttctggtttgatcctgtaagacttgccaaaratggatcagcaaggagtcatgacctcaagttgctggtggctcagtagactggatgaggccctccagaactctcacacatctcagaagatgctaaagagct

SEQ ID NO: 13171 - DNA, 201 bp, Homo sapiens
ccattttccttctccctacagagcttgatattgggctttaagcaggagaggagagaaagccctttctgttcagggtggtccttacttcttctccatagggaaaaaaaaaaaaggagggggaggccctgaggggattggggagaagggaagcagctggcttggttgggggcagagcaactgctaatgggttcagagcggctg

SEQ ID NO: 13172 - DNA, 201 bp, Homo sapiens; identical to SEQ ID NO: 1630

SEQ ID NO: 13173 - DNA, 201 bp, Homo sapiens; identical to SEQ ID NO: 1634

SEQ ID NO: 13174 - DNA, 201 bp, Homo sapiens
gatccgcacgtttgcagctctttctttgccataagtggtcttcagggcagctgcaaatcctgccaaagggatgggtgggggtcccacttggggagattttytgggcctcccccgttcccccttgccttatttctaaattcccagcttgaagcggaattaaattaccactcacagacctggatgctgcgtaaattatgtatg

SEQ ID NO: 13175 - DNA, 201 bp, Homo sapiens
aagtggtcttcagggcagctgcaaatcctgccaaagggatgggtgggggtcccacttggggagattttctgggcctcccccgttcccccttgccttatttytaaattcccagcttgaagcggaattaaattaccactcacagacctggatgctgcgtaaattatgtatgtttgtgtgattcgctgtgtgtgtgtgcacacg

SEQ ID NO: 13176 - DNA, 201 bp, Homo sapiens; identical to SEQ ID NO: 1638

SEQ ID NO: 13177 - DNA, 201 bp, Homo sapiens
accaatatttaaagttgcctttggaagtgtgggggttggagtgaaggggacaaaacccctgagataaattaattttactagtattaaaattaaaatggccragcatggtggctcatgcctgtaatcccagcactttgggagaaggaggtgggcagatcacctgaggtcaggagttcgagaccagcctggccaacatagcaa

SEQ ID NO: 13178 - DNA, 201 bp, Homo sapiens; identical to SEQ ID NO: 1591

SEQ ID NO: 13179 - DNA, 201 bp, Homo sapiens
atttattgaactcttgccagacatcaggtcctaccctaagttttctatgtttaaccgccacagctggtactggtactactattatcccatttaacagatgkagatactgaggccctgagagatcacacagatagtaatcgtggggctgggtttgaagccaggcagcccaaagctgcctttgtatacctgtgtcaatctgct

SEQ ID NO: 13180 - DNA, 201 bp, Homo sapiens
gggaaatggtattcacccaaaggaccagtgcagaagttggggaggctttgttgcgtgcccttaattctctgaaagttcaccttcagagagacttatcagaygcgttgtctggagtggcctccttcctcacgtcaggaggcattcttggcagcctgctccatgaggaacaatgagattggcggggccctcaccatcatcgca

SEQ ID NO: 13181 - DNA, 201 bp, Homo sapiens
aaggcagggaggcatgttgagtttgcagtcctcttgtttttttaatcacagaccatgtaattgagaatatttatggccatgttctggaatactttcatctgtgtgtgtgtgtgtgtgtgtgtgtgtgtgtagttgggtgggtagggggagggatgagccggaataatctcttccaccgaatgagtaagtaggttagtcttc

SEQ ID NO: 13182 - DNA, 201 bp, Homo sapiens
tgtatccccaagtggagacttccctcgcatccagccacgcaggatcagcctgttaccttatatagcggtaactggttttcttatagaaaaaaaaaagggtaaaaaaaaaaaaaatctaagtagttctaagattcacattggttcttgatagctgtgctacacaagtagagtctcaaagtcagtgtcatggatttatttaac

SEQ ID NO: 13183 - DNA, 201 bp, Homo sapiens
atctctcccgtggactcttaaaattaacttcactgtcaaaatttcccatggcccaaatgtaggtttggggagagaaatgtaagactttgaagttgagaaasaaagtagagaaagcattctctagacaaatgctcaccatgcagacttcagaatctgtgaggagacaaataaaaaggcactcggggaaccgttttagagaga

SEQ ID NO: 13184 - DNA, 201 bp, Homo sapiens
tatggtggcatctgagtttagaggtgcccacatcctcttgccaggaagaggttgatgagaaaagaacacatttcaatctgggtgcttctttctttaaaaaatatatatatgtgtgtaacaagaattagttattttcagggaaagtcatggtaccatctcatacctcagtttcctcatctatgaatgaaagagaggctagtt

SEQ ID NO: 13185 - DNA, 201 bp, Homo sapiens
agctcaaaatatcagcgatttgtggtgggaagaaatgaaggaagaaaatacaactgcaaacagccactattaaaaaggcgcttggtactgatgcagatacmcaaacaaatacagagtttggtaactgtttgagcccttggcgttaaatagcaaacaagaataacagcagcagtaacaacaaatggctattcatggagcatg

SEQ ID NO: 13186 - DNA, 201 bp, Homo sapiens
atggtggcatctgagtttagaggtgcccacatcctcttgccaggaagaggttgatgagaaaagaacacatttcaatctgggtgcttctttctttaaaaaatatatatatgtgtgtaacaagaattagttattttcagggaaagtcatggtaccatctcatacctcagtttcctcatctatgaatgaaagagaggctagtta

SEQ ID NO: 13187 - DNA, 201 bp, Homo sapiens
atggcctggcccatagtaaatgctcaataaaatgtgaacagtttgcagatataccagctttttagtaaatgggtggtacagatgcaaggcagaaattcaargaaatgaaatttactttaaaaagtctgacctgacagtgagctgacttctccataaaggctaggtgactgtactgagcctaaggagcaggtggcctggctt

SEQ ID NO: 13188 - DNA, 201 bp, Homo sapiens
agctggaactacaggcatgcgccaccatgcccagctaatttttgtatttttagcagaggtggggtttcaccatgttggctagactggtctcgaactcctgscctcaagtgatctgcctgccttggcctccccaaatgctgggattataggtgtgagccaccatgtccagccccacataactttaaagactgaagaagcact

SEQ ID NO: 13189 - DNA, 201 bp, Homo sapiens
caacaggagttagcagaaaagcaaagcagagatgaaggcaaccgcctgctctgctctgctctgctcagagcagagggaaggtttgcaaatgccttcccggygtgcagggaaggaagagggaatagtgacatttgggacagaaatgtgggaactcgatttcaactccctggtcactgtcaacagcaatgcagcataccaaag

SEQ ID NO: 13190 - DNA, 201 bp, Homo sapiens
atgccattctaagcacctaagatgtaacatattttattatcctcataaggactccatgggtattattctcctcactttacagatgaggaaaccaagacttaaagagctaggtcactcaccagtaagtggtagagccatggtttgaatctaggcagttccagtccaaagcccttgctttcaaataacactctctgctgcctc

SEQ ID NO: 13191 - DNA, 201 bp, Homo sapiens
gctttcaaataacactctctgctgcctcaaccgggggccaagagctgtgcatggtgctgtggacacaaaggtgggcacaacagactgttctgtgtgggcayatggacaagttgggcagacatactgataaactcataaataaatataaaatcaaaactatgatcaatgtctggacatagaggcttatggtccttggaagta

SEQ ID NO: 13192 - DNA, 201 bp, Homo sapiens; identical to SEQ ID NO: 1627

SEQ ID NO: 13193 - DNA, 201 bp, Homo sapiens
cataatgaatgatctagaagtagaggtgattctctagctgcctgccagaatggggagtcattctcgtaaagattgcctccctgccttttagccatggtgayagaacttgttattaacttgtttttattttctttatattatagtggacatcccagaaatacatgagagagaaggatatgaagatgaaattgatggtgagta

SEQ ID NO: 13194 - DNA, 201 bp, Homo sapiens
aatgaatgatctagaagtagaggtgattctctagctgcctgccagaatggggagtcattctcgtaaagattgcctccctgccttttagccatggtgatagwacttgttattaacttgtttttattttctttatattatagtggacatcccagaaatacatgagagagaaggatatgaagatgaaattgatggtgagtactg

SEQ ID NO: 13195 - DNA, 201 bp, Homo sapiens; identical to SEQ ID NO: 1569

SEQ ID NO: 13196 - DNA, 201 bp, Homo sapiens
cacaaacggaagcggttccagctgactggcccctgagtgctagattcagaatctccgccctggcgtggcagcagccctttcctgcttggacattagtgcakgcccatcatttccacaccatggtgttttttgcacagtagtgacaagtttgcccctggagccaggagaagctccaagctctgtaatctgaagctccaagta

SEQ ID NO: 13197 - DNA, 201 bp, Homo sapiens; identical to SEQ ID NO: 1573

SEQ ID NO: 13198 - DNA, 201 bp, Homo sapiens
actttaaaaagtctgacctgacagtgagctgacttctccataaaggctaggtgactgtactgagcctaaggagcaggtggcctggcttcaggcctgaaccraccagagacctcagcattgtgcagatctgccttgcggcctttttagacatcgtgcagcttctttgttgggaagttgtatgtgacagtgctgttttttttc

SEQ ID NO: 13199 - DNA, 201 bp, Homo sapiens
taaacgtgtgtcacccgtcctctcacaggtgcagaaaacctccccccgatacaagctggcttcatttatgtgccctggaatcaggggctcagcgctgtagkggatccaggagcttgtaagccagtggctttcacacacttctgcccatgatacacaatttaaaataattttccttcacaacccgcttcacttataagcact

SEQ ID NO: 13200 - DNA, 201 bp, Homo sapiens
ataatcatagctatgaaagaagtaagatgatggtgagatagagaataagggcatgccatctgaaatagggtggtgacagcaggcttctctgtggaggtaamatttgtccttaagcctgaaggatgagcaacaaccagccctggaaagcaccaatgaggagtactgcaggcagaggaaagagcgcttgcaaaggccctgggg

SEQ ID NO: 13201 - DNA, 201 bp, Homo sapiens
actggaaaagaaaaggatagaggcccttctttaaggaaggtagaaaaacatcccgggctttgcagaaaaaaataacagcaggaagaagctttctttacccttttttttttttcctgcaaatcatgattggttgagtcccccagcagtgtgtggattgataacgaaggggcagaatgacaagacagcctcaatggcaaaacc

SEQ ID NO: 13202 - DNA, 201 bp, Homo sapiens
gtccacagggcagaaccagaagactggaagttggggggatttcagctgccgaactgtaactctgtgtcacttcccctcaagcaaaccttatagaaaaatcyagtttttctaagaagttcaagtaaggtttgttgattatttgcttcacaaaaggattcagcagaggggtcctttaactaacaagctcagagaaaaaattta

SEQ ID NO: 13203 - DNA, 201 bp, Homo sapiens
catttttccataaaaacaaaaaattctagacctgcagactattgattgtagcaggagagtattccattttataaatatcccagatggattcaccctccctmtacggttgggctttgaaaccatttataagcaaaatatcctcccactttttatattttttcaaaatatatgcacaaagatgcatatgcatctttgcacaat

SEQ ID NO: 13204 - DNA, 201 bp, Homo sapiens
gctcccggaatggagttctgttatctctgccccacagagcaggagactgaggcacagatgggtatgttcagccgtggttgcaacttgggtaggagtagacacactgtggaagaggtgactgagaaccagccaaagcattaaccttctcctccccagacgaggagcagcaacagatggctggtgcggcagccaactgctcac

SEQ ID NO: 13205 - DNA, 201 bp, Homo sapiens
ttatccccttaaatatgcgtttgatttgaacaaactcattttgaattaagatttcaagagctgtagccatgtggtcaacagatgtgtaccaggtgcaataacacacacacacacacacacatacacacacacgctttaagctgcagctaacagaaacttggaaatccttgcaccgtttggactaggagactcagttaacca

SEQ ID NO: 13206 - DNA, 201 bp, Homo sapiens
tatccccttaaatatgcgtttgatttgaacaaactcattttgaattaagatttcaagagctgtagccatgtggtcaacagatgtgtaccaggtgcaataacacacacacacacacacacatacacacacacgctttaagctgcagctaacagaaacttggaaatccttgcaccgtttggactaggagactcagttaaccat

SEQ ID NO: 13207 - DNA, 201 bp, Homo sapiens
taagataatgtgagtttaatcgtccaatggaattgcaaactgatactaattacaagtatgtctcagtgaatcacagatacaggttggaagcaaagtctaaygattgtgtcctttggaaaaaaacaagacactgccctgtgttgggaatggtggtctcttactccagccctctattccccaggtggacctgcgctttttaac

SEQ ID NO: 13208 - DNA, 201 bp, Homo sapiens
gcttttgcaggtgagaattttaaaggtaaaaaaaaattttttttttgcatgctttttccttcccccatgtgatgtgaatttgatggggggaatcaacctcmaaatttgtcaaatctcgcaagagaaaagagacgccacaccttcctgccgctagatggcactagcaacacctgtagatgcgggaaggggattgagagcctc

SEQ ID NO: 13209 - DNA, 201 bp, Homo sapiens; identical to SEQ ID NO: 1644

SEQ ID NO: 13210 - DNA, 201 bp, Homo sapiens
gttacagataaacctttcagccttgcattgtccaacggggagcaatgaggctgaaaatgcaggggtggtgagaaaggagagactgtgggaagactgaaccaaaaaaaaaaaaaaatcagtataaattaaaagtgaaatgaggtggcaatgatttattttagcctgaagatggtttctttccagttccagggtaccaaggca

SEQ ID NO: 13211 - DNA, 201 bp, Homo sapiens; identical to SEQ ID NO: 1586

SEQ ID NO: 13212 - DNA, 201 bp, Homo sapiens
gtaagtaggttagtcttctggactgccataaaaggtctgtaaaatagttttaatcagacactggtacagaagagaaggagggagtgtggggggaagaaagytgtaacatatttgaagttctttgggttgttgatttctctttcagacccaccgtgcggaggtcgtttgaattccaaagatgctggctatatcacctctccc

SEQ ID NO: 13213 - DNA, 201 bp, Homo sapiens
gtgaatccgcagacctcctgggcaaacactgtgggaacatcgccccgcccaccatcatctcctcgggctccatgctctacatcaagttcacctccgactaygcccggcagggggcaggcttctctctgcgctacgagatcttcaagacaggtcagtgtggtcacacgtaggggccgggagatgggcgtcttagagaagaag

SEQ ID NO: 13214 - DNA, 201 bp, Homo sapiens
ttcatcacattaatgtaaggatgacctccaagggactcagaaaatcctcaggcaccagcttattcactagagtatttcacagagtttcacaactgtggaaytgaagctcttagagattaagtgccttgctgcagggactaggaaactggagcctgcatggacggcgcctggtcaccagacttggatgtccagactggcgct

SEQ ID NO: 13215 - DNA, 201 bp, Homo sapiens
atcaatcttttaagtggggtcttggcaagttgttttgtgcatcccttactagcgaccgagggggatgagaatgtgctttagcactttggccagaaatgagraagacttctaacatgattgaaaccatggcctccaggaaaagactgaatttcaaatgtgacagtgatggatcaatgctcagttcagatcatggtcaagtag

SEQ ID NO: 13216 - DNA, 201 bp, Homo sapiens
ctttttacttttgttttggaaatgaggaagcatgttttcaaagtcagcaccatctcccacactgaaaccacagacctaaacagattccccaacctcacggycttctcaatctgtgaccatctctccatttctccctgggggttgaaactgccattttgacttctccagactctaaggagcttcagcggttctttttggact

SEQ ID NO: 13217 - DNA, 201 bp, Homo sapiens
ctggccagtttgactctgcttcaaatgagcacaggcctccacttcaggagggcagcctgccctgcctctcactgaggctaatagttgtgtgcacgtagacrgtgggcccctggagactcacccctgcttttggagaaaggtttttatcgccttatctaacatgaggctgattccttttaagaacacatgttgactagacac

SEQ ID NO: 13218 - DNA, 201 bp, Homo sapiens
attcattcatagaaacaaaattttcttgaggagtggcatatatatagcactatctaggggtagagagaagaagcaatgttaaaccttattatttgtaagaycagcatttacaatataactggggtgataaaaaagacatgaaaaaaccagttaaattataatgccaggcagtgagtgattacctgctgaaatccatggaaa

SEQ ID NO: 13219 - DNA, 201 bp, Homo sapiens
ggcgggctgtgggcgggggggtgggggtggggtcaaaacagccattgtttgtggtattagacaaacagaaaaacacttcttgaaagaattggatttttgtrtgttttttaaaatcaaaataatcttcatgggaaaaagcaaaactctgatgactttctcacgattacttcatggtctaatgatgtctttatttggaactac

SEQ ID NO: 13220 - DNA, 201 bp, Homo sapiens
acctggagtgggggttctagctaaatgacaatcaaaggaaaaattaagggttctgctgcaaaatttcagaagtttatttttaatatgattttcccgtttcyagtggtttgtttcatttgaggtttctttgatggttcctcccttttctttttgcaaaagttttttttgtagaatttggttcctgagatacagtatacatgt

SEQ ID NO: 13221 - DNA, 201 bp, Homo sapiens
cttcactaaggatagcttgagagaaattacaggaaggctgtctactttcttggaaatatttctttagaaaaggataggagactaaatagatacttggaaargatgagaaaacttaaagtgttcatttctactccaaattgtcaggatagaaggtggctcagtggctaacccctgtgacaaaacagaaggactccagagcca

SEQ ID NO: 13222 - DNA, 201 bp, Homo sapiens
tttgggagtttcccctgagaacaaatgaagcgtctttttacttttgttttggaaatgaggaagcatgttttcaaagtcagcaccatctcccacactgaaaycacagacctaaacagattccccaacctcacggccttctcaatctgtgaccatctctccatttctccctgggggttgaaactgccattttgacttctccag

SEQ ID NO: 13223 - DNA, 201 bp, Homo sapiens
ctgcagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtcagagaaagagagagtgagaaagaatggaaagggccataagagagggccttcttatttgaggacta

SEQ ID NO: 13224 - DNA, 201 bp, Homo sapiens
cggagagtgaacgaggggggaaatggtggaacaaataattgttttattggaaaggaaaggaataaataatatttcagcccaggaactggcagtttgaaagrgatggttgagagcttggagcagaaggattcgtgatgcaggttttaatggaagagattttctttgtctcaaagtaggaggtttcgtccccacccgaccccc

SEQ ID NO: 13225 - DNA, 201 bp, Homo sapiens
gaggaacaaatctttcacttttgtagtcattgtaagttttttctaatataaaggagacttgatgactaagcaaaaagagcaatttcatttcctgggtaaakcacaagacttagtcagaaaacttgggttgtaggcccagctctgctatttcctagcagtaagaataaagaaatcacatgcgctctccaaacttcagtttct

SEQ ID NO: 13226 - DNA, 201 bp, Homo sapiens
tgcagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtcagagaaagagagagtgagaaagaatggaaagggccataagagagggccttcttatttgaggactaa

SEQ ID NO: 13227 - DNA, 201 bp, Homo sapiens
agtctgtggccatttttttccctctcaaaatctcaggggcaattgtcacaaaagtgaaccattttaaacctctctttctctggattttttgacattaaccrtctctgggcctgggtaatgttttcctgactagattggtacaactgcttagacttggacttcacccttccaccaaagatagtttgtggagcttctagtatg

SEQ ID NO: 13228 - DNA, 201 bp, Homo sapiens
gcagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtcagagaaagagagagtgagaaagaatggaaagggccataagagagggccttcttatttgaggactaaa

SEQ ID NO: 13229 - DNA, 201 bp, Homo sapiens
cagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtcagagaaagagagagtgagaaagaatggaaagggccataagagagggccttcttatttgaggactaaat

SEQ ID NO: 13230 - DNA, 201 bp, Homo sapiens
ctgtgccgggtgctccatgtgaaagagatggaaaggaaatgataccgagaaataggcaggagggaccgatttgacttagagactcttaagaaaacacagcrtttgaatcaaggctctgaaggagccttaagaaagggtcacagagcctggagaacaaggacatgaataaaccaaagacaccgaaactcagtcccaactttc

SEQ ID NO: 13231 - DNA, 201 bp, Homo sapiens
ctacctaggtagtacaataagttccctggcaagggggagggagacacttcattatgaacctccctccccatggaagctctgaacctgagccaaatttgccrccatcctggggctctgtttaccctgaaaaggaaatttgtttcggtctcttatttaagaaatgtttttgagcagttcctgattttgtaagctcttagagct

SEQ ID NO: 13232 - DNA, 201 bp, Homo sapiens
aacacatcagagggcgtgaccacattcttctactatcttctgtaaacttctctagaggagccaacctttttcgtttgtttaatctcacaaattaaataaamctttatgtgaaatgttccttcaccagcacttcatttttaacctgtacagaaaggactgtgcagacaggccagtcctaaaacaattctgacatgcaatgag

SEQ ID NO: 13233 - DNA, 201 bp, Homo sapiens
ttaagaaaacccaaacatctgtgttaggaggtttccaggggtggagggcccaccccacccagctagaatgtcctagaatgtccgagtttctccttccctcytcctaggacattgactgttccccccaagcccgctcattgctctgatcctgtgctcctcccccgcctgctcttctccagccccacccctgagctgccctcc

SEQ ID NO: 13234 - DNA, 201 bp, Homo sapiens
acataagtgcccttcgcttatccatctgaaacaccttaacttctgcaaatgaatagagagacataagtgggagcgacacagtggtccttctcatgtccttsgagtgatcttttcttgtctgtgccatccccacccaggtatgactttatcgagattcgggatggggacagtgaatccgcagacctcctgggcaaacactgt

SEQ ID NO: 13235 - DNA, 201 bp, Homo sapiens
gtgacagaggccacaaagaaaggcatcttcttcttagtgctacagttctcttttacatacaggctctgaagattgctcaaaaaacttcacaagccccaacsggaccatcgaatctcctgggtttcctgagaagtatccacacaacttggactgcacctttaccatcctggccaaacccaagatggagatcatcctgcagtt

SEQ ID NO: 13236 - DNA, 201 bp, Homo sapiens
ttgacctggagcatgaccctttgcaggtgggagagggggactgcaagtacgattggctggacatctgggatggcattccacatggtgagtgatgtcatgargcattcctcagtagcttggcctttgcctgttaattgctttagtgatgataaagaggaagaacaaagacttcaaagctcctatgagttcttatatgaccca

SEQ ID NO: 13237 - DNA, 201 bp, Homo sapiens
atcacctagttatatttcagtgtgagccccagaggacacttcctgacagtaaacacccagtttatcgagtatttctggttggttgtgttttttatgcttasagtgtctattatcctcctcaaaaatcctgcttccttttcttcttttaaaatctgaacataacgagtgaaatcaattctaattgtccagcactttcattca

SEQ ID NO: 13238 - DNA, 201 bp, Homo sapiens; identical to SEQ ID NO: 1639

SEQ ID NO: 13239 - DNA, 201 bp, Homo sapiens
aggctgcccctctcctcactgcgccgcctcgccagaccgcagtgcagccgctagcctgcctccctccctgccccgggcgcccccgccagtcccctgcgctycgctctgcgcggcaggctcgccgcgacccctagagagacggctttgagtggcgggaggccgaggccggctggcttgggaatccaagcgctggcccaacta

SEQ ID NO: 13240 - DNA, 201 bp, Homo sapiens
tttgatttccactgacttctctttgtcttgaatgtccagttggccccctgattggcaagtactgtgggaccaaaacaccctctgaacttcgttcatcgacrgggatcctctccctgacctttcacacggacatggcggtggccaaggatggcttctctgcgcgttactacctggtccaccaagagccactagagagtgagt

SEQ ID NO: 13241 - DNA, 201 bp, Homo sapiens
gaggtatgaggttggaaggcctaactgcatttgaccgtctgctttccccagactttcagtgcaatgttcctctgggcatggagtctggccggattgctaaygaacagatcagtgcctcatctacctactctgatgggaggtggacccctcaacaaagccggctccatggtgatgacaatggctggacccccaacttggatt

SEQ ID NO: 13242 - DNA, 201 bp, Homo sapiens; identical to SEQ ID NO: 1624

SEQ ID NO: 13243 - DNA, 201 bp, Homo sapiens; identical to SEQ ID NO: 1625

SEQ ID NO: 13244 - DNA, 201 bp, Homo sapiens; identical to SEQ ID NO: 1626

SEQ ID NO: 13245 - DNA, 201 bp, Homo sapiens
gccttgtgacccactgacaagcctgtcctagctctgaggcgacacagtgacctctgctctaagaaggatattgcaaagcagacaacaggaaagggagaaasaccacttagaaactccagggagtccacagaggttctaacagtaagccctggggccatttgtcattgtctcttctctctgcctctccaaaaatccatctcc

SEQ ID NO: 13246 - DNA, 201 bp, Homo sapiens
tgatactatagttcaggagttaccgagctctggaaatgaaagggcacaaatcctgagagggaatcacaatgtcctggagaagaaaaaggacaataaataaygaggagaaattcagtttgttggggatgggctctgaactggcaatcatgcttagcggcgaggcattgaattctctctgctggtgcctcccgcatctgcggc

SEQ ID NO: 13247 - DNA, 201 bp, Homo sapiens; identical to SEQ ID NO: 1678

SEQ ID NO: 13248 - DNA, 201 bp, Homo sapiens
tgtgtgggtaggattggggtatctgtgatgggaacacagggcacgatgccccctgcagagcaggagctggtgcagaggtctggaaggagagtgtgatgtcygggggattcctaggggctgcctgtccttccctaaaaaggaggtagggagggaggaagagggtctctcctgtagcattacagttccaccaagccctggtct

SEQ ID NO: 13249 - DNA, 201 bp, Homo sapiens
cagaagtgtgaccctgggtggtgttaccattatttattgagtgctgccccctagaggattgaaaaatggtctggccgcttgagtccccagggatggaaacstgagactcactctctgtccaactgcaggaaatgaggccttcactcaaggggagtgggaagtcttgcagccctggtacagaggactcccaggaagtaagtg

SEQ ID NO: 13250 - DNA, 201 bp, Homo sapiens
tcattataccctgtggtttgggagggcttttcagagcaagctcacaaagtgggcagaattccaacctttggctgaatggatggggacagagagaaaattasggccataaggaactgctaaatctaatgttgttcctcccttaagatattgaaagggaaagtaattattttcctattccagaggaatcccgaagtttgggaa

SEQ ID NO: 13251 - DNA, 201 bp, Homo sapiens
gtgggtattctagtgttaatgtgtgtgtgcatgagtgtgtttgtggtttctgtgcatgggtgtgtgtgtgtgtctgtgtggtatgtacctcagcagaggckcttggaataaaaggatatagccggggtcctctgcaggctggggaggttggctggctcttattcagtgtctgtcctcaggttcattctaatgattctggcc

SEQ ID NO: 13252 - DNA, 201 bp, Homo sapiens
tggaagaactcagaggcctctgtgctgtgcctttcccaaccaggcatctgagattaacagtgtgatactcagcctgtggatttccactctaaaatcccgcsccaccccccaacacagcttggctcaactatttgcaaatcacttctgattcaattttgttttggttatctcagtgtaaataacagttaagtgggagttaca

SEQ ID NO: 13253 - DNA, 201 bp, Homo sapiens
acccatgggtatctagcagagctgcctggcacttggcctctagaagagtattgctgtaagtcctggatacattgttaagcccaccattttagtttcagaargccagatttcagaagcttctcctggcactgctgacaagaaggggttgcctctatcccttctaaacaggtagcaagagttgtctgctatctctgctgttac

SEQ ID NO: 13254 - DNA, 201 bp, Homo sapiens
gtagccgttgggggaggctcccgccgggggaacccggcgaggacaagagcagggcggccgccttccactcgggctgtccggcggcggctgcctccgcccgygtgtccgtcaagggtgccgcgggatgtgtgtcagtttacgcctctgagatcacacagctgcctgggggccgtgtgatgcccaaggcaagtcttggtttta

SEQ ID NO: 13255 - DNA, 201 bp, Homo sapiens
ctattccggagggaactgttcaccctgccgagtaaaggggcactgccagcacaccaggggccccagacgctgtgctctgattgcccttcagtgaccacccrtgcaggcagccccaccgggcacaaaggcatgattcctgttcccttttgtcaaatgaggccaactgaggcacacaagcatgattgatccaggccagcgtag

SEQ ID NO: 13256 - DNA, 201 bp, Homo sapiens
agaaacctctgcataagacgttgtaaggaggaaaataaaagagagaaaaacacaaagatttaaacaagaaacctacgaacccagctctggaaagagccacyttctccaaaatggatatgtttcctctcacctgggttttcttagccctctacttttcaagacaccaagtgagaggccaaccaggtaagccactgaaagttt

SEQ ID NO: 13257 - DNA, 201 bp, Homo sapiens
tgaaaaagtgaaagtgctttttgatgtgcaggaaaaatattagccattgttcttgaaacatatctttggtttttatggcaagatgtacaaagtgtgctccrctgaatgaaatgcaatgaggggaagggaaaacggagtgaaaaccaagtttgacattttgatttccactgacttctctttgtcttgaatgtccagttggcc

SEQ ID NO: 13258 - DNA, 201 bp, Homo sapiens
agggctttacctcaaggttcaagtaaataaaaaagtagccccccgcccccaccataccagctcttttgacggtccaagtaatcagtagccactgtataccyagaacatcttctgtgtctgacagtggtgggccataaatcgggagattccagaagaacaaacttcagttgcagcacgtgtttgatctcaatatctatgtgt

SEQ ID NO: 13259 - DNA, 201 bp, Homo sapiens
cttggattccaacaaggagtatctccaggtacttgtgcagataccagaggatgtgagagtgtgtatgtattgctggggtaggagggtagctcctcaaatayagtaggcagaggacacaaagaaaataaacacagcatacctgagaactccattcattcattcatccaaacagatgtgtatgccaggcactgggttacatgc

SEQ ID NO: 13260 - DNA, 201 bp, Homo sapiens
atttttaagcttgagggaaagaaaatttgacagaactttcccatccccttcaaagactgctcaagtggctgaactacaaacaggggtttcaataacatggytttgcatcttacgctacaggtatttcaagccaacaacgatgcaactgaggtggttctgaacaagctccacgctccactgctgacaaggtttgttagaatc

SEQ ID NO: 13261 - DNA, 201 bp, Homo sapiens
tctgtaaaaccccttcccatcattcattcagagctgacctctttctctcactgtgctgatctgcaacagctggggaagggatgggtgttggagatcgggarggcagaggtctgactctcacatagatatatgcaaggtggaagatttgtggcaaagctaggtgatcgctttgaattccttgatgagcctgatacgaatgaa

SEQ ID NO: 13262 - DNA, 201 bp, Homo sapiens
cctttcttaaaagatagagcaaaagaagaatatctttttaatttcttgaactgacaagaaaggacttgaaaagtgtcatctgggcaatggcttgtagtgtyattaacatatttgaggtattttattatctgaccatcacttgcaactggataatctttgagataccttccttgagtggcagataagtatattgatcaccag

SEQ ID NO: 13263 - DNA, 201 bp, Homo sapiens
ctctttaaatccatattcccgtccatccagttttgtgcaaacatgagccagagtgtgctttggtccttccttggagtcagcgtcgcctgtagccccctccrttattgtctcgtggccttttgtgctaaactcggggcctctgctgtggagtaaagaatgtgggtttgtgtccctacctctgtcactgctggttctgcaacc

SEQ ID NO: 13264 - DNA, 201 bp, Homo sapiens
atcttccaagacatgtttcagatagtttgagagccaaaagtggaatgcatagggagttaacatacgatattggatttacagagttagcttgttgggggacmtggagtgggggttctagctaaatgacaatcaaaggaaaaattaagggttctgctgcaaaatttcagaagtttatttttaatatgattttcccgtttctag

SEQ ID NO: 13265 - DNA, 201 bp, Homo sapiens
cctatgattctcatacagggtgggcccgccttatgtatatttatggcataaccacaaggcagagagctcatctgcctgatggaatccatatccaacccacrtgctcctttagattatacaaattgctttgcatacatttcttcagaaaccacaagcagaaattactgcttttggtttccccagctatattaataacaccct

SEQ ID NO: 13266 - DNA, 201 bp, Homo sapiens
ctgctcgtctggagattctgcagactagtggattagctcagatgtcagcactgaattatgatccttcagctgcttgtgctaagcatgtcactagcattaastccctggtcttgcaatgttcccctaaatcatgcatagagattgtcattttatcgtgagagggagatgggagagaaggagaaaggagagaagaggggaagg

SEQ ID NO: 13267 - DNA, 201 bp, Homo sapiens
tttgcagctctttctttgccataagtggtcttcagggcagctgcaaatcctgccaaagggatgggtgggggtcccacttggggagattttctgggcctccsccgttcccccttgccttatttctaaattcccagcttgaagcggaattaaattaccactcacagacctggatgctgcgtaaattatgtatgtttgtgtgat

SEQ ID NO: 13268 - DNA, 201 bp, Homo sapiens
tcaagtccctcagtttatctgaccctctcaattataatggagaaggatccagtgccctaggtaattaagtttgtcccttatccatttgccatgggatgagstcagacctttagcctctccacttaggaagctcaggggaaaatttcattatacagaagcttgaaccttttctctatcaggctcccgcggccagcgtcaccc

SEQ ID NO: 13269 - DNA, 201 bp, Homo sapiens
gggcctggttcagccgccgccgccggcgacgagaaccaattctgggaaggagcaagatggggcagaaggtgcgcgcgggggagcaactgagcaaataacamggcggtcgcggcgcgcggcaccttgggctggcgcgtggctgggaggccgcatgggcgacgcgcaccaggctgcccctctcctcactgcgccgcctcgcca

SEQ ID NO: 13270 - DNA, 201 bp, Homo sapiens
cacagaagcattgagaaagtcataaagatgtataatatatgatagcatttactagctataaataggggagatgcagggagaaaaatagagaccttgtaaamccattgggtcaggataaatagaaactgcttaatatttcattaaaaatggattttcataaattgcactttgatatctttgggcaaaagacaatatgtaagg

SEQ ID NO: 13271 - DNA, 201 bp, Homo sapiens
aattcacccttccgtctggactggatgatcagataagaggtgtaaattggctgtgggagacaggtctgggttcagacaaatcctgaaagagaagcaatgayggtctaggcgccggataagggtttgaagtgtttcttttagcctgtctccccaaaatgtgagatggccattggcgagcataataatttgcaagtaaactgt

SEQ ID NO: 13272 - DNA, 201 bp, Homo sapiens
tgaggagagacaccagggaccagatgattctggggaccctggtgtttttcatttcactcaagtcttccctaaagcaatcaggaaaatgaactgactcaggrtgacctgagtgtaagacaattctgagttgacagaattcaagagccaggtaaagaggtttccaaatatattctccaaaggtccagtttggaaagactttag

SEQ ID NO: 13273 - DNA, 201 bp, Homo sapiens
gaccttggttgtattaataaggagaaattaatttttaaccactgggaacattgccaaattatgtgacctttggcagaccagctgtgctataaaaataaatyccccatttctgaaaatgctactcctatccagtagaacaataacaatgtggcatttaggatagagaagagtaggattgagaagaaaggagagaaataggag

SEQ ID NO: 13274 - DNA, 201 bp, Homo sapiens
cttgaatcatgcctcaccgtgtacctactctgtctctcgatgatgcagagagaagggacactgaccaaaataaggtgactttttggcctgagactgatctycatatgaaaatgaccagagttttgtgaagttgggttgtatttgtttttaagcagtagctactgtgcccacttgattactcaagctctgtaaaaccccttc

SEQ ID NO: 13275 - DNA, 201 bp, Homo sapiens
tcacagggtaggaccactaatgcatgaaggagcccgcagcacttcccacccatggctcccctgctggggcaccccatgagtagagaggatgcatctttccrgcttaatgcaaacagctagggaggcatttttcataggagaagcatatatcatttttcagaagtaaagatcatgtctggttttggcaagctcaaaagctcc

SEQ ID NO: 13276 - DNA, 201 bp, Homo sapiens
agcctccttggcatccccagaacatcagctagtggatcctagccttgcatctggtactgtcacccttccttctcctcacgccccccaccagcacacacacsactttaagcttgggcatttatttgaggggggaagaaaattcaggaatgcctttgccacccagatccgcacgtttgcagctctttctttgccataagtggt

SEQ ID NO: 13277 - DNA, 201 bp, Homo sapiens
taaatgggtacccagtaaacatttcccccgtgatcagctcctggaggtagggaagctgtggccagttgccagcagagcacacagtgcaagacagtggcaaraggagcactccccaaagggccccgggcaggcccctactcgtccaagcggtgcctggtggaattgtgaatgcgccagtgcacatcaggtttggagttttat

SEQ ID NO: 13278 - DNA, 201 bp, Homo sapiens
ggtttcaggcttaccaagcagatagaacaggggtagcaccttgagtaaatgtcttattgtctaggagggtagagaatcttttgaattcttggctcaatctrtgggttataagatctattccccacctcactacatgggctttggattttagcactggaactgacctttagaatcacccctctcattctatagatgagaaaa

SEQ ID NO: 13279 - DNA, 201 bp, Homo sapiens; identical to SEQ ID NO: 1588

SEQ ID NO: 13280 - DNA, 201 bp, Homo sapiens
aacagggggctggagggagatgggaaaataaacaaatgtctctgaaacatcccccgtgtgcctggcacagtgcctagccccttacatatatattttttttyattctatcttctccccagccttgtggagtggatatttttatcctcatcttacagatgaagaaattgatgctcaaaggggttcagcagcttgcaatgtcac

SEQ ID NO: 13281 - DNA, 201 bp, Homo sapiens
aaccttttcaaaattcctcttggccccctgaagacccgccagctggcttggctttgctgaattgcctcatcccgggccattgaggaggccctcaggagtcygaagcccaatcataaacaaagctgggggaggcagccccagctcatccctccaggactagctgcccattgaaaactcggcctgacctgctgctgccatgca

SEQ ID NO: 13282 - DNA, 201 bp, Homo sapiens
ctgatactaattacaagtatgtctcagtgaatcacagatacaggttggaagcaaagtctaatgattgtgtcctttggaaaaaaacaagacactgccctgtrttgggaatggtggtctcttactccagccctctattccccaggtggacctgcgctttttaaccatgctcacggccatcgcaacacagggagcgatttccag

SEQ ID NO: 13283 - DNA, 201 bp, Homo sapiens
aggaaattggggcccgagggaggtagagatatttgcccacacttatgagctaattagccgcagagcacagctcctggcttctgattcagtagtgttttgtrtgtgtgtgttgtttttcccactataccacactcagagtgagaggtgtgttaaaaaatctaataagatggtgttccttcaccatccaaagaacagaaggca

SEQ ID NO: 13284 - DNA, 201 bp, Homo sapiens
tgtatccatgggaagactgaccccctccctcagctcatacatgcgagtgcgtgcagcccatgcccatgtgagccacactcatgcacacaccgccatcccamagacagtccaaatacacaatcatttactcattgaggaaagaaaaggtctcttagcgttgcctgccaaggctgagaaatgcaggggtcggataagataaaa

SEQ ID NO: 13285 - DNA, 201 bp, Homo sapiens
tgcaatgttcccctaaatcatgcatagagattgtcattttatcgtgagagggagatgggagagaaggagaaaggagagaagaggggaaggggctacctggyggggtgggtcactggaaggggcagactgtgaaacctttggcctggctgtgcctggagtttcagtaacaggaagggtaagtagaacagacccagatacaat

SEQ ID NO: 13286 - DNA, 201 bp, Homo sapiens
gcccatgcccatgtgagccacactcatgcacacaccgccatcccaaagacagtccaaatacacaatcatttactcattgaggaaagaaaaggtctcttagygttgcctgccaaggctgagaaatgcaggggtcggataagataaaattggatattaacaacacataagacatgctgtgtttctaaacggtaccagcgtggt

SEQ ID NO: 13287 - DNA, 201 bp, Homo sapiens
ccacattccatgctgcatatgtggtagaaaagtggccctgccatcttgcagaagtattcagcctaagacgcccctatgtttcagggccaaaaagaggtacygagatttcctcaccaaatgccaccttgttctctgtacaagtggccagaatggtcctgcacaagttggatttgaaggtgcaggtcacacctgtgttctgca

SEQ ID NO: 13288 - DNA, 201 bp, Homo sapiens
cagcctaagacgcccctatgtttcagggccaaaaagaggtaccgagatttcctcaccaaatgccaccttgttctctgtacaagtggccagaatggtcctgyacaagttggatttgaaggtgcaggtcacacctgtgttctgcaaggcacgtagtctgccaacagcaacaagaactcggtcttccacatgagtgtctgatga

SEQ ID NO: 13289 - DNA, 201 bp, Homo sapiens
ggggagggaagcgcagtagctgtggccgcagaataatttctgatagaactctcagagtctgtcctatctagtgatacctttgatgttcctttggtcacttmttaattggttaattcaccaaatcttgatgagtctgacttttgggaaaggttctggtttgatcctgtaagacttgccaaagatggatcagcaaggagtcat

SEQ ID NO: 13290 - DNA, 201 bp, Homo sapiens
gggaaggtgtgagtagagaaatggatgctgggttggtttggggaacactcagaagctgcagtttagaatgtatggtgggaaataattgcaaacaagattakaaataatagcttgggctcaattcaaggcccaaattgctaggcaaagaggtttgggtttcacttgctaaccaatggggagccattaatgtttcaacataag

SEQ ID NO: 13291 - DNA, 201 bp, Homo sapiens; identical to SEQ ID NO: 1646

SEQ ID NO: 13292 - DNA, 201 bp, Homo sapiens
accaacgggcctcaatttggctggctagatgacattaggttcccagcatgggtgagtggtgtgggcacctggaaagcctatgggtattggctgcagaggarctgggcctcatggctggcctcatgtggtctgggtgggagggatgagctcattgtcttcatgggctggggtgggtgcagggtcattaggtaagaagatgat

SEQ ID NO: 13293 - DNA, 201 bp, Homo sapiens
aggcatctgagattaacagtgtgatactcagcctgtggatttccactctaaaatcccgccccaccccccaacacagcttggctcaactatttgcaaatcayttctgattcaattttgttttggttatctcagtgtaaataacagttaagtgggagttacagatttttcaaacactaaaagtgataaagctaatgggcaagt

SEQ ID NO: 13294 - DNA, 201 bp, Homo sapiens
acagggggctggagggagatgggaaaataaacaaatgtctctgaaacatcccccgtgtgcctggcacagtgcctagccccttacatatatattttttttcmttctatcttctccccagccttgtggagtggatatttttatcctcatcttacagatgaagaaattgatgctcaaaggggttcagcagcttgcaatgtcaca

SEQ ID NO: 13295 - DNA, 201 bp, Homo sapiens
ccctgtcactgccccgaggcagcttgctctgactggtgcagctggaaacctcagacccagaaaattctgaactgtgatgttggcagtctcacttgggaaaygggaaaaggagtagatttttaaaaaatcaaaatcaccatagtaacggggtaccactcatctgaaaaccatggcttctggatattaccaggtatctcacac

SEQ ID NO: 13296 - DNA, 201 bp, Homo sapiens
gggtaccactcatctgaaaaccatggcttctggatattaccaggtatctcacacacatgcacacaattgcccgatttccacgataaggaaagtgaggtacktagcaattgaaagatgtgccaggccaggtctggtttcccactgacttggtttcagaaagacttaccaagcatccgttgggaatgcccagcctgaattggc

SEQ ID NO: 13297 - DNA, 201 bp, Homo sapiens
aatgcccagcctgaattggcactgggtgccaggagcttgggggctgagacctggttccaccccacccttttcaattataaaccggtagatctcggaagctyagctagcagacgagggccagaagccaggcaggggtggtccccggggagaggagtggggctcacctgattgtctccctgtccaggcgcaatgactaagcag

SEQ ID NO: 13298 - DNA, 201 bp, Homo sapiens
ttccaccccacccttttcaattataaaccggtagatctcggaagctcagctagcagacgagggccagaagccaggcaggggtggtccccggggagaggagyggggctcacctgattgtctccctgtccaggcgcaatgactaagcagcacaggcccagagggatactgtagcataagctgttttaaaagcatgcagatgga

SEQ ID NO: 13299 - DNA, 201 bp, Homo sapiens
cctagatgcagacatggcattgttaatacaacagtagaaggttcatgtatgtttacataattataggcacaattatgtacatacataccaagaagggcgcrtggagagcaatgggaagagctcagaggcacaaggtcttggtctagttcctgccctcctgagatgctgattccatgattctgcactggggataggctgtgc

SEQ ID NO: 13300 - DNA, 201 bp, Homo sapiens
actggagcctgcatggacggcgcctggtcaccagacttggatgtccagactggcgctctccacaatccgccctaggccttactcttcatcttgagggaaaktggcttcctacatgttcagtccaaggactgagaggtacacattttcctggaaagcctcctcttcagtgaagttctgcatgcaggatgagcctgtacatgg

SEQ ID NO: 13301 - DNA, 201 bp, Homo sapiens
ccagctcccgtgggtgctgaactgtctccagtagctgaggcgcgcctccctggcgctgatagccttgatgttaaactccaaggccccggctgtgcacagargccagtgacaaggagcacacagaggggatgtggaagggcgctgtgattctgcttgggctgtggaatcatgttccttgccccaaccccaactaatgtagat

SEQ ID NO: 13302 - DNA, 201 bp, Homo sapiens
tgatggttttcaggttctgggctactgaaaacaaatcagaggtctcaagaatcaattgaaaaatgctggattatattcagaattcagagaggcacccaatrgattatccagaccactttgtgccctgaatcgctttttaaacttggtttgcagagatgcacttgaagaaatctttatgttcaacttagctctttttaaata

SEQ ID NO: 13303 - DNA, 201 bp, Homo sapiens
gaagctaagttgaaaagatccttcatttgattcaagggtgggagaagagtgggcaaaatgaaagggcagactgaagttcaattgaagcagtcaggtagatrgcctaggggacacaaactgtgtgcttgcctcccttcctgagtggtgctactgtaagcagagattagggggttcacccagagcctgtggccacatgtatcc

SEQ ID NO: 13304 - DNA, 201 bp, Homo sapiens
cagaaagcctctgcctcatgctgaattctcagagaactgatgaatctcttttctttggatccagttccccatccctttcctgagagctgtggagccctttwtcagtacgaaggaagtagggtcagtcaccactccccttgggccttctccagggtgtctggccctaaccttctttccttccctttgcttggcttttctcct

SEQ ID NO: 13305 - DNA, 201 bp, Homo sapiens
catccctttcctgagagctgtggagccctttatcagtacgaaggaagtagggtcagtcaccactccccttgggccttctccagggtgtctggccctaaccytctttccttccctttgcttggcttttctccttccctcgctaacttggtcttctcactccttctcatccacaatcgctatacaggaagcagcaaaatcaaa

SEQ ID NO: 13306 - DNA, 201 bp, Homo sapiens
tggtctgggtgggagggatgagctcattgtcttcatgggctggggtgggtgcagggtcattaggtaagaagatgatgtgctgtgtaccagcctgaggaaayggctgcttttgttttccacccagtaggaaatggacctgaattcattccattctgggcagttcaatacggcacagtttgagctcgtggaggcttgatgccg

SEQ ID NO: 13307 - DNA, 201 bp, Homo sapiens
gcgtgcctatgaagaggtgcagcatgatacactaaatggacatcccagtaaaggcagctgctgttgggcataagatgccattgaaggtgccttaaatgaawcctgtgttcctaatgaatgccagtcattaaaaaggcacagtggcaggggttgcttggcactgaagacccagagtttcttcttagttctgtgttactggtt

SEQ ID NO: 13308 - DNA, 201 bp, Homo sapiens
tggagcctttgaaggtggctcccttccctcccaggccacatgaagctgtctgcctccagccaggcactgcaggtacagggagccagcccttcctgcaaacrgccagttatggctggacaaagcagcagcacactctggtggtggtgaccaggcaggagggacagtgggcagacagcgcagaagaaacagatgttcattcaa

SEQ ID NO: 13309 - DNA, 201 bp, Homo sapiens
ataaaaggtctgtaaaatagttttaatcagacactggtacagaagagaaggagggagtgtggggggaagaaagttgtaacatatttgaagttctttgggtygttgatttctctttcagacccaccgtgcggaggtcgtttgaattccaaagatgctggctatatcacctctcccggttacccccaggactacccctcccac

SEQ ID NO: 13310 - DNA, 201 bp, Homo sapiens
gcatgactaacaagttctttcccggtgctccctgctgtcaaccttaggacccgggtgggaggacttcccaggggaggagagggagcagcaggctgggtgckcagggggcacccccagatttggtggacttcgcaccagatcaatggtttaaactgaatatggtggaccagcgaaaatctgcttccctgtttgtcttcagcc

SEQ ID NO: 13311 - DNA, 201 bp, Homo sapiens
tggttggttagttggtttttccctctacccttattcaggaaaaccaagggaaactcacatatactttgctctagttacttttttttttttttttttttgarcagagagcacaaaaaagcataaggtccatatggcagttattgatctgggccatctggaaagccaggacttgctcccaccatgtaggatcagaagctgttc

SEQ ID NO: 13312 - DNA, 201 bp, Homo sapiens; identical to SEQ ID NO: 1592

SEQ ID NO: 13313 - DNA, 201 bp, Homo sapiens
aacatgcaaggaatgggctggagttatggaggattagtgccatgtggcatcaatcttttaagtggggtcttggcaagttgttttgtgcatcccttactagsgaccgagggggatgagaatgtgctttagcactttggccagaaatgaggaagacttctaacatgattgaaaccatggcctccaggaaaagactgaatttca

SEQ ID NO: 13314 - DNA, 201 bp, Homo sapiens; identical to SEQ ID NO: 1587

SEQ ID NO: 13315 - DNA, 201 bp, Homo sapiens
ccctctgcctcccagaggccggtagctttacccgttggttctcctggtagcatcttacctgccacaccttgcctattctttgctagaactacagggacctratgagagaaccacattccttcctgctggcctcctaaggaaacaggctgcagtttacctaccaggctcaacagaaaaggaaagtggctggtaaagggcaaa

SEQ ID NO: 13316 - DNA, 201 bp, Homo sapiens; identical to SEQ ID NO: 1589

SEQ ID NO: 13317 - DNA, 201 bp, Homo sapiens
aaagatccttcatttgattcaagggtgggagaagagtgggcaaaatgaaagggcagactgaagttcaattgaagcagtcaggtagatggcctaggggacamaaactgtgtgcttgcctcccttcctgagtggtgctactgtaagcagagattagggggttcacccagagcctgtggccacatgtatccatgggaagactga

SEQ ID NO: 13318 - DNA, 201 bp, Homo sapiens
atatgacacttgagcttgggggtaagaaaatgttagtctgggggtgactgaagggaaaagcatttggggtaatgggaacagcatgtgggaaggatccaagrcagtaaagagcagttatttgggaagtaaagacctgatactgatgccaggaaggtttccttctacttggcaaaacaattactaggaaataattcaatgttt

SEQ ID NO: 13319 - DNA, 201 bp, Homo sapiens; identical to SEQ ID NO: 1622

SEQ ID NO: 13320 - DNA, 201 bp, Homo sapiens
acttagactactgcctgcacccagcaaacctgttatgataaataactgtaactgaaacaaaaggttcccaaagcaatggtcatcttaaccatggaagtgcwctccaaaatattatagtcggtatgttttaaaagctggtcatgacctattcgacggattccacaacccaatgatgagagtgatgcgtggtttgggaaatat

SEQ ID NO: 13321 - DNA, 201 bp, Homo sapiens
cactgtattggtcagtgcatagacagggcacgtcactgtatacacggcatcatcacagaatgtattggacaacactgctccagtgctttggacactcacaygagagcaaccaccaggggcccttgatgattctttagttccctggttttggtatgaaccaagaagcaagtaatggagggatgtgtcttctgtgggatccct

SEQ ID NO: 13322 - DNA, 201 bp, Homo sapiens
acaaactggaatcccatatacgcatactaaactggtctcatttgacttcagggaagcatagcttctgaagcactaatcccagagagcctaaacaggaaggrgcttaggggagcagggaggtaggtgaggcagctggggagtcaagaaggaaagagctgtttctgggccactgatgggaggtccagcacaggctcagctctc

SEQ ID NO: 13323 - DNA, 201 bp, Homo sapiens
gtggcataaaagcatccataagcaatatgtaaacaaatgagggtgtctgtgttccaacaaaaattgatttacacaaacaggcagtgggctggatttggccmataggccacagtgagctgacccctgggttagagcacaggctgggattttgtccacctggttctagccgtgactctgacacttgctagcagtgtacagttc

SEQ ID NO: 13324 - DNA, 201 bp, Homo sapiens; identical to SEQ ID NO: 1579

SEQ ID NO: 13325 - DNA, 201 bp, Homo sapiens; identical to SEQ ID NO: 1580

SEQ ID NO: 13326 - DNA, 201 bp, Homo sapiens
tgctcccaccatgtaggatcagaagctgttccaaaaagccttccctcccataagagatgtattggtcagatggggacagggatggatttcattacagggcrggactacagtgagaggaagctggagcaggactctgaaggactgtctgcaaccctgaccctgccacaaagatcagagagaaccaagaaagtgttgattgac

SEQ ID NO: 13327 - DNA, 201 bp, Homo sapiens
gtcctgttctccatgattaatgagttccacttgctttcttcaaagaatgcctgtgctgtgccatgctgttatttatttatgttttctactaaaaaatttaygtaaaaaacatcccttaaggtcagtatgcagtattgtgctgcagactaaactatcccagcagccagaggtaaacctacacaccaagaaaaagtctcaaat

SEQ ID NO: 13328 - DNA, 201 bp, Homo sapiens
ggagattagattctactttcaaagggctccgggagagtggtaccagctaagctgaatcctgtacccagctctgcagagacagatcacttcctttgaagaarcagcagtgacatcttacccctcacctacccaattattacttccacagggatgtgaatctcccatttacgagcgctttcccagacaaaacgggaacttgta

SEQ ID NO: 13329 - DNA, 201 bp, Homo sapiens
tgggattttgcaaaagttgctaagtgctaaattgctaaatgagattccacgaaatttctcttgatgacaaatccctggagattagattctactttcaaagsgctccgggagagtggtaccagctaagctgaatcctgtacccagctctgcagagacagatcacttcctttgaagaagcagcagtgacatcttacccctcac

SEQ ID NO: 13330 - DNA, 201 bp, Homo sapiens
acagtgtttctttaaaaagcccaaaacaacatacccactgattatttttaagcttgagggaaagaaaatttgacagaactttcccatccccttcaaagackgctcaagtggctgaactacaaacaggggtttcaataacatggttttgcatcttacgctacaggtatttcaagccaacaacgatgcaactgaggtggttct

SEQ ID NO: 13331 - DNA, 201 bp, Homo sapiens
cccctgggtttaacattctttacaccaatcagctgacccattttgctacctaacatttccagaaactgttctccataggtcacgtggctatgtttgctttycgaatttccatctgtttctcacactcatcttcggttcacttcttcatccctatcccaaaggataacaggaaaaataatgggctgggctgagctgctgcag

SEQ ID NO: 13332 - DNA, 201 bp, Homo sapiens
tcctcataaggactccatgggtattattctcctcactttacagatgaggaaaccaagacttaaagagctaggtcactcaccagtaagtggtagagccatgrtttgaatctaggcagttccagtccaaagcccttgctttcaaataacactctctgctgcctcaaccgggggccaagagctgtgcatggtgctgtggacaca

SEQ ID NO: 13333 - DNA, 201 bp, Homo sapiens
ctatattaataacaccctagatgcagacatggcattgttaatacaacagtagaaggttcatgtatgtttacataattataggcacaattatgtacatacayaccaagaagggcgcatggagagcaatgggaagagctcagaggcacaaggtcttggtctagttcctgccctcctgagatgctgattccatgattctgcact

SEQ ID NO: 13334 - DNA, 201 bp, Homo sapiens
agctaggtcactcaccagtaagtggtagagccatggtttgaatctaggcagttccagtccaaagcccttgctttcaaataacactctctgctgcctcaacygggggccaagagctgtgcatggtgctgtggacacaaaggtgggcacaacagactgttctgtgtgggcatatggacaagttgggcagacatactgataaac

SEQ ID NO: 13335 - DNA, 201 bp, Homo sapiens
ggagatttactccagctgtagcaaatccctcataataaaaaatttccccaaatgagtcagtcacacaggaggtaaatgagacattctgtatgaagtcagcrtgtcatttggagtgtgccctttatataaaaggcccagccagaagaccatgtggttaagtggggcttgtccacagggcagaaccagaagactggaagttgg

SEQ ID NO: 13336 - DNA, 201 bp, Homo sapiens
accgttgcttattaactttgttccattgaagcttgctgtctgcttggaaaatttcactcacaagccgcagctttgcctgactcagtgcaatccaaggccaycatctctggtgaacttcccttgactcctccctccagccacttgcagaaatgcaaatcctgggcacccacaggctgtttgggggcctgtatagaagctgtg

SEQ ID NO: 13337 - DNA, 201 bp, Homo sapiens
tcctctttagatggtgacccagttatataaaatatttctatcagaagggaactgggttgggccaggtgggggaaaatctaggaaaggcagcctcccagcasttcatggtttctagatagtggtcaagaagaggtcacattaatcctatttgcagataggatttcccaccaaccccattcatgggatttatcagaggccttc

SEQ ID NO: 13338 - DNA, 201 bp, Homo sapiens
atatgtcacatatggactgaatcaaaggtttaaaaatactacaaagcctttgcattacagtttttgggaattttttttccctgtcttgaagcagaacacayctcccttgagtttctccaactagccagtgaaatataaatcatttgcattccctccacttagctacattgagcaatgttaactgaagggcttgggaaagac

SEQ ID NO: 13339 - DNA, 201 bp, Homo sapiens; identical to SEQ ID NO: 1576

SEQ ID NO: 13340 - DNA, 201 bp, Homo sapiens
tccagccctctattccccaggtggacctgcgctttttaaccatgctcacggccatcgcaacacagggagcgatttccagggaaacacagaatggctactaygtcaaatcctacaagctggaagtcagcactaatggagaggactggatggtgtaccggcatggcaaaaaccacaaggtaaatccatgatcctaccttaaag

SEQ ID NO: 13341 - DNA, 201 bp, Homo sapiens
cctgttcttcactgtagtagaaaatgtgcaagtaaccttccaggagtctgtatggagagattatgccataagtttcagcatggaaatgggcactattagtytctgcttaaatatgataatttaggctaaatataatattcagattaaaattctgttgaaacagttggaaagttgccagatttagcacataaaaatgtccca

SEQ ID NO: 13342 - DNA, 201 bp, Homo sapiens
gatttagtgtaagataatgtgagtttaatcgtccaatggaattgcaaactgatactaattacaagtatgtctcagtgaatcacagatacaggttggaagcraagtctaatgattgtgtcctttggaaaaaaacaagacactgccctgtgttgggaatggtggtctcttactccagccctctattccccaggtggacctgcg

SEQ ID NO: 13343 - DNA, 201 bp, Homo sapiens
atcatcattattactataattttaaaattgtcattaatatagtcataaatattgaaaaggtacatcacccaaggctaacagccaccagtacttcgcaggtraagaccaacatggatcttgggtctaattagtattggagaggaacaaatctttcacttttgtagtcattgtaagttttttctaatataaaggagacttgat

SEQ ID NO: 13344 - DNA, 201 bp, Homo sapiens
ccagctgtgcaaccttagacaaatcccttaccctatctgtgccttatctgtgttaagttagctgctatcatcatcattattactataattttaaaattgtyattaatatagtcataaatattgaaaaggtacatcacccaaggctaacagccaccagtacttcgcaggtgaagaccaacatggatcttgggtctaattagt

SEQ ID NO: 13345 - DNA, 201 bp, Homo sapiens
tttttctttaaaacgaatacctctaatgcccaagatcccaaagttgttgtaggattaaacattgcaggccaggtgactggcacgagaaggatatcataacyatcatcttggtcaaaagcacctgaacagccagtccacctgagaggcacgcattttcttcagggtctcctgctgcagatgaggtcaccctggctgtgtccc

SEQ ID NO: 13346 - DNA, 201 bp, Homo sapiens
catgcccacattccatgctgcatatgtggtagaaaagtggccctgccatcttgcagaagtattcagcctaagacgcccctatgtttcagggccaaaaagargtaccgagatttcctcaccaaatgccaccttgttctctgtacaagtggccagaatggtcctgcacaagttggatttgaaggtgcaggtcacacctgtgtt

SEQ ID NO: 13347 - DNA, 201 bp, Homo sapiens
cagaatgctgtcatcaataaagagactcaatgagaggccccctacaggagctgcggataaaggcatcgctgcaggctcagatcagtgtattgacatcaccyagttatatttcagtgtgagccccagaggacacttcctgacagtaaacacccagtttatcgagtatttctggttggttgtgttttttatgcttagagtgtc

SEQ ID NO: 13348 - DNA, 201 bp, Homo sapiens
agagacctttccagagacagcagcaggttaaaatgctgaatggccctgtcctctgtacttcctcttcacccttttgaactcctgttgttcattcccaggcrattgttttccctgtatcattggcaacaacagatgttttgggtcaaggacccagcgaaatgcctcccaagtatgtcaggtccaggaggagaggaattgtat

SEQ ID NO: 13349 - DNA, 201 bp, Homo sapiens
tgggtggacatgctgaagaaatccaaacaaacacagctatgtttgctagtcggattcatagagaggaagaagcgggggaaactgtaaacacagatacgcaratagccatacagagggctctagaagccttcgatggtacattaccctggtgaggctctgctgtaggacccacagtgtgagtgcagaccagggcatgtggct

SEQ ID NO: 13350 - DNA, 201 bp, Homo sapiens
caagagacctttccagagacagcagcaggttaaaatgctgaatggccctgtcctctgtacttcctcttcacccttttgaactcctgttgttcattcccagrcgattgttttccctgtatcattggcaacaacagatgttttgggtcaaggacccagcgaaatgcctcccaagtatgtcaggtccaggaggagaggaattgt

SEQ ID NO: 13351 - DNA, 201 bp, Homo sapiens
attcgggatggggacagtgaatccgcagacctcctgggcaaacactgtgggaacatcgccccgcccaccatcatctcctcgggctccatgctctacatcargttcacctccgactacgcccggcagggggcaggcttctctctgcgctacgagatcttcaagacaggtcagtgtggtcacacgtaggggccgggagatggg

SEQ ID NO: 13352 - DNA, 201 bp, Homo sapiens
catttaggctagccaagagacatgctccctggaagaactcagaggcctctgtgctgtgcctttcccaaccaggcatctgagattaacagtgtgatactcarcctgtggatttccactctaaaatcccgccccaccccccaacacagcttggctcaactatttgcaaatcacttctgattcaattttgttttggttatctca

SEQ ID NO: 13353 - DNA, 201 bp, Homo sapiens
atcaaaactatgatcaatgtctggacatagaggcttatggtccttggaagtacatcgtaggggatttgacccagcctaggagctcaaggaagacttctttraggaggtgatgattgaggtgaggttagaaggcaaataacagacattacctggtgaagaagggagggaaggtgcaccaggcaatggtcacagctttctcaa

SEQ ID NO: 13354 - DNA, 201 bp, Homo sapiens
ccctgttgctgttccaggataatcagcaaagatttaggtagaggtcattctctggaagattgaaaggagagaaccagtgattttgaagaaggggaacaacstggaggatcttttttatccatagctcagtttgcaagtatgaaatgcacattgactatagaccctgccttgcctgacatcatttattcatgcattctccac

SEQ ID NO: 13355 - DNA, 201 bp, Homo sapiens
ttccaggataatcagcaaagatttaggtagaggtcattctctggaagattgaaaggagagaaccagtgattttgaagaaggggaacaacgtggaggatctyttttatccatagctcagtttgcaagtatgaaatgcacattgactatagaccctgccttgcctgacatcatttattcatgcattctccactcaatcatttg

SEQ ID NO: 13356 - DNA, 201 bp, Homo sapiens
ttttggttatctcagtgtaaataacagttaagtgggagttacagatttttcaaacactaaaagtgataaagctaatgggcaagtccagataaggagggaarccacccagaagaatccacaagtacaagccaagaagaaaatgggtagtcaggtgtgtgtttctcgtcaccgaaactgtatttttcttaatctacagaaaat

SEQ ID NO: 13357 - DNA, 201 bp, Homo sapiens
atgagctcctgttcctgctcctgctgccatccaagctcgcaccaggatgcgaatgtgtgccgcatttaatcaggatgcctccatgcgtcccaagaaagcaracgcaagagctcaggagagaaacaaggccatccacaccacaaaggagccagaagccttccaaatgtcaatgcactgctgcatttttccaaacttgttgcc

SEQ ID NO: 13358 - DNA, 201 bp, Homo sapiens
gctattgaaggaagaaaaaaatgtgttttgtgatatttgatagaacgatgctcctgctcttacgtgggcaagagataaggccttccagccatgtgtttatkcactctgtggctttcacaaagcacaacgacctgcagtatctctgtttgccagtctgtacaagcagacataagtgcccttcgcttatccatctgaaacacc

SEQ ID NO: 13359 - DNA, 201 bp, Homo sapiens
tcctttaaccataagttcaagattaggttttctttcctgtttgcctgtgacacttcagaaactgacatttttggggtcattcacagaggtagagaaaactyggagtgcctactgcctccacttcctgaattcaggaactgaattcaccttctgcggggaaggcaaactcagctttgggtaaatccactgtgttttaaatgt

SEQ ID NO: 13360 - DNA, 201 bp, Homo sapiens
ccctttatataaaaggcccagccagaagaccatgtggttaagtggggcttgtccacagggcagaaccagaagactggaagttggggggatttcagctgccsaactgtaactctgtgtcacttcccctcaagcaaaccttatagaaaaatctagtttttctaagaagttcaagtaaggtttgttgattatttgcttcacaaa

SEQ ID NO: 13361 - DNA, 201 bp, Homo sapiens
ccaaaagaaggggcagagtattcttcctccgaagacctaagtactctatcttcgatacagaaatccccttccaagtggttctgtgtggcatccctaaagckggattctgacaagggccagacatttcggtgccctgagagaaggacctaagcttggtgaatcttccagcacaggctccgttgactaacccagcctttggtg

SEQ ID NO: 13362 - DNA, 201 bp, Homo sapiens
tccataaaggctaggtgactgtactgagcctaaggagcaggtggcctggcttcaggcctgaaccaaccagagacctcagcattgtgcagatctgccttgcrgcctttttagacatcgtgcagcttctttgttgggaagttgtatgtgacagtgctgttttttttcctcctaatttcctcacaggttttaatgtaaggatta

SEQ ID NO: 13363 - DNA, 201 bp, Homo sapiens
ttttatgcctcttttcgagctttgtagccaagcatcttggcagtctctaatatttttctactttttcccactggggactcaactgtatgtttgtgggtcaygtggaggaactctcaaaattagacaacaatagcaaacatttattgaactcttgccagacatcaggtcctaccctaagttttctatgtttaaccgccacag

SEQ ID NO: 13364 - DNA, 201 bp, Homo sapiens
acagagaggttaggtcagtcacccaaggtgactcagctggtcttacaacattggttctgccaccctggaaatgtgtggcttaggaactcccaagtggacayttagacacttgggagtactttagaaatgccatgttactaccgaggtccctaaaagttaaggttgggaagcaggcagcatgtctagaatgcagatgtgctt

SEQ ID NO: 13365 - DNA, 201 bp, Homo sapiens
cagcaagtgtttacataagacctttttttttttttttctaatctacatccttctggaaatgtttacatgaaactcaggggaggcaggctggccagtgaaaygaggttggaacaggaccatggttgaagaaaacaggacccatctggatgcagaggccgcctttgcccctgtgacgttggtggtgttgatgggggtgtggga

SEQ ID NO: 13366 - DNA, 201 bp, Homo sapiens
ttcttatagaaaaaaaaaagggtaaaaaaaaaaaaaatctaagtagttctaagattcacattggttcttgatagctgtgctacacaagtagagtctcaaartcagtgtcatggatttatttaacaaacactcttctaattgcattacaaatattaatccatttactttgcacagtgggccctgggaagttagtgccattat

SEQ ID NO: 13367 - DNA, 201 bp, Homo sapiens; identical to SEQ ID NO: 1582

SEQ ID NO: 13368 - DNA, 201 bp, Homo sapiens
agcctttgaaggtggctcccttccctcccaggccacatgaagctgtctgcctccagccaggcactgcaggtacagggagccagcccttcctgcaaacggcyagttatggctggacaaagcagcagcacactctggtggtggtgaccaggcaggagggacagtgggcagacagcgcagaagaaacagatgttcattcaacac

SEQ ID NO: 13369 - DNA, 201 bp, Homo sapiens; identical to SEQ ID NO: 1584

SEQ ID NO: 13370 - DNA, 201 bp, Homo sapiens; identical to SEQ ID NO: 1585

SEQ ID NO: 13371 - DNA, 201 bp, Homo sapiens
tgctaactactgtgctctgaagagcctctgggctggggaggctcagtcacttcaccctgacataggcagtgcctgcaatctctcatgaattttatgtatcrcagatgaatacgaggtggactggagcaattcttcttctgcaacctcagggtctggcgccccctcgaccgacaaagaaaagagctggctgtacaccctgga

SEQ ID NO: 13372 - DNA, 201 bp, Homo sapiens
agtcttactctgtcacccaggctggagtgaactggcgcaatcttggctcactgcaacatccacttctcgggttcaagcgattctcctgcctcagcctcttragtagctgggattgcaggtgcccgccactatgcctggctaatttttgtatttgtagtagagacggggtttcaccatgttggccaggctggttttgaactc

SEQ ID NO: 13373 - DNA, 201 bp, Homo sapiens
cctgagatatctttcagtaaaatttcatcaatatgtctctttgtgcatagagacatattcattcatatctgtgtatctacctatcacaatctttatatcarttgaataccttaatctttatatcaattgaatcatagcctacgtgctacttaatataccatataaataactttttatgccactacttgctttactattttt

SEQ ID NO: 13374 - DNA, 201 bp, Homo sapiens
gtgagaagcataataattaaacatgaataaattaaatatgcagattttaatatttttattgaaaattggatagaaatatttgtttagttggaacctgtgartgattattatgcatataaatagacattcagttattgcagataaattcagtggtggtaaaataaaacatttgtatagggttttggaattcaaatctttaga

SEQ ID NO: 13375 - DNA, 201 bp, Homo sapiens
gatgtcactgcagagccagaggaggctgtcgccgaaatccacctcccccacttcatctccctccaaggtaatgtggggtgagcggaggctgtgggggccgytggggtgcgtgccgtctcactgctgttgtggttctcctgcagcaggtgaggtggacgtctcctggtttctcgttgcccattttaagaatgaagggatggt

SEQ ID NO: 13376 - DNA, 201 bp, Homo sapiens
aagataatgtacaccttctttaagattcttataaggaaaaaattccatttcgtttcttgaaatgaggtattgctttgtcgcccagactggaatgcagcggygccatcatagctcactgcgaccttaatctcctgggatcaagggatcctgtcacttcagcctcctgagtagctgggactacaggcacaaaccactgtgcct

SEQ ID NO: 13377 - DNA, 201 bp, Homo sapiens
aaaataataacaatattaatgataaagtagttgggagagaagggcagagttcccatgtagccttcaccaagtttcccctcacgataatactttttttcttytttttttgagacgaagtcttgctctgttgcccaggctggagtgcagtggcacgatcttggctcactacaacctctgcttctggggttcaagcgattcttt

SEQ ID NO: 13378 - DNA, 201 bp, Homo sapiens
caccatgaacagtggctggtgggcggccccttgtttgatgtcactgcagagccagaggaggctgtcgccgaaatccacctcccccacttcatctccctccraggtaatgtggggtgagcggaggctgtgggggccgctggggtgcgtgccgtctcactgctgttgtggttctcctgcagcaggtgaggtggacgtctcctg

SEQ ID NO: 13379 - DNA, 201 bp, Homo sapiens
aaacacagttgaatatgtactgtggtgttactgtatatatatatatccagagtttctttatgcatatacaaatttttactctttacttgaagagtagaaastttacatgttgtttactatgcctttcttcattaacaatagatcttagtgataattcagtatcagtttttagtgaactttgacattcttttaaaattgcat

SEQ ID NO: 13380 - DNA, 201 bp, Homo sapiens
ggaggctgaggcaggagaattgctcaaacctgggaggcggaggttgcagtgagccgagatcgtgcaactgcactccagcctgggagacagagtgaggcttygtctcaaaaaaaataataacaatattaatgataaagtagttgggagagaagggcagagttcccatgtagccttcaccaagtttcccctcacgataatact

SEQ ID NO: 13381 - DNA, 201 bp, Homo sapiens
actctccatttctctgtaaacatcagaatatttttacattgtttacttttttatttaaaaaagattttttccaggtgtcacaatcatgcttttttttttttgatagcaaattctagatgaaatgggggagattgtggatggctgggtcttggatgagtatgctggttcaaggcagctcatgttctgcccagaagtcaaatg

SEQ ID NO: 13382 - DNA, 201 bp, Homo sapiens
gcttgtgtgacatcaaaacaaatggaagcattgtgtgtgtgttatatatatatatatatatatacaataacatagtgtcatgaaagtatagtatatatatrtaaaattttgcgtgtgaaaattttaggtggaggtttttaaaccatttgtttactttataaagggtaataaattcacatagtctgctccccaaacacagtt

SEQ ID NO: 13383 - DNA, 201 bp, Homo sapiens
aaaattatttcaaaataaaagcattatatgggtcatgtagtttttttgtatagtttagttctaggtaccatagttgctattttaatgagtgtattttcttytttcatggaattgggatagtctgttatattaagaagctattcacttttgtatattaagattcttctggctggtgcggtggctgacacctgtaatcccagc

SEQ ID NO: 13384 - DNA, 201 bp, Homo sapiens
cacactgggaggcgagggcaggtggatcgcctgaggtcaaaagtttgagaccagcctggcctacatggtgaaaccccatctctactaaaaatacaaaaatyagctgggcatagtggcccacacctgtaatcccagctactcaggaggctgaggcaggagaattgctcaaacctgggaggcggaggttgcagtgagccgaga

SEQ ID NO: 13385 - DNA, 201 bp, Homo sapiens; identical to SEQ ID NO: 1698

SEQ ID NO: 13386 - DNA, 201 bp, Homo sapiens
atgtggaggaatggtattttattctagcatgggcatcgaagaaggtgtctctaagaatgggcatctctaaggcatctctgaggatggcatctctaaggatrgtatctctaaggatggcatctctatggatgggcatgtctaaggatggatgtctctaaggatggcatctctatggatgggcatgtctaaggatggatatct

SEQ ID NO: 13387 - DNA, 201 bp, Homo sapiens
gtaacagcaatgcagttagttcaataaaaatgtggaggaatggtattttattctagcatgggcatcgaagaaggtgtctctaagaatgggcatctctaagrcatctctgaggatggcatctctaaggatagtatctctaaggatggcatctctatggatgggcatgtctaaggatggatgtctctaaggatggcatctcta

SEQ ID NO: 13388 - DNA, 201 bp, Homo sapiens
ctcactgcaaccttctttccctgggttcaagcgattctcctgcctcagcctcctgagtagctgggactacaggcacctgccaccacgcctggctaattgtygtatttttagtagagatgggggtttcaacatattggccaggctggtcttgagctcctgacctcaagcaatcggtcacctcagtctcccaaagtgctggga

SEQ ID NO: 13389 - DNA, 201 bp, Homo sapiens
aacctgggaggtggaggttgcagtgagccaagatcgctccattgcactccagcctgggcgacaacagtgaaactctgtctcaaaaaaaaaaaaaaaaaaaagtctgaaatgactgagacagatgatctggcatgcataaaagaccacggactaggacgaattgtttgctttgggaacccagtgtttccaactcttgcgcta

SEQ ID NO: 13390 - DNA, 201 bp, Homo sapiens
agaagggagaagaggagataactgttccatgggttcttataaaacatgcccaatctcactaatgccctgcaatcccaatcattttagggtcctattctctygggcaccaattatggatgaagggagactacaaattaggaatctcatcctttccctaaaattcttagcaaggttatataggtcaacatacttgttgaccta

SEQ ID NO: 13391 - DNA, 201 bp, Homo sapiens
ttgcttgaatccaggaggtgggggccgcagtgagctgagatcacaccactgcatactccagcctgggtgacagagcaagactctgtctcaaaaaaaaaaaattatatatattatatatattcttacatatgttttacttacatatttgtgtatatgtattttatttaaatatgcatatatatgtaaacataacaaaacata

SEQ ID NO: 13392 - DNA, 201 bp, Homo sapiens
agtaaatgtgagataagaagtggcaattgcaacctgaggtgataatctttttttgagacagagtcttactctgtcgcccaggctggagtgcagtggcgcartgtctgctcactgcaaccttctttccctgggttcaagcgattctcctgcctcagcctcctgagtagctgggactacaggcacctgccaccacgcctggct

SEQ ID NO: 13393 - DNA, 201 bp, Homo sapiens; identical to SEQ ID NO: 1686

SEQ ID NO: 13394 - DNA, 201 bp, Homo sapiens
tggtgactgagctgctgccaaaggtggggtggggggggcatgttgcaaaattcatctgaactttgaaaacatcaaggagtctagatgaaagtgcaaaaccmcattgaaggcatcatgggaaatttttttaattattttccaaaatggtagctccaattagcaaatcttctatcaacttataagggtacccaaatttctgca

SEQ ID NO: 13395 - DNA, 201 bp, Homo sapiens
tcaacatattggccaggctggtcttgagctcctgacctcaagcaatcggtcacctcagtctcccaaagtgctgggactacaggtgtgagtcaccgcgcccrccctagaggtgatgatcttgagcgaggtaaactctcctcagagtcatcttccatttaaaaagattccagccaacaatctcaccctttgtaattttttaaa

SEQ ID NO: 13396 - DNA, 201 bp, Homo sapiens
tgttatattaagaagctattcacttttgtatattaagattcttctggctggtgcggtggctgacacctgtaatcccagcactttgggaggctgaggtgggyggatcacctgaggtcagaagtttgagaccagcctatccaacatggtgaaaccccatctctactaaaaatacaaaaaaaattagccaggcatggtggtgca

SEQ ID NO: 13397 - DNA, 201 bp, Homo sapiens
ttttcattcagcacgtgcttgggaaccatttatttttccatttctgtgaatttcatgttcatatcctttgtctacctatttctagagcaatgtttttttttattattgattttctatttcatgtatcagaatagctctttgctctgctctatttgtctatctgtttgtcagtctatctatcgagaagtaaatacaggcatg

SEQ ID NO: 13398 - DNA, 201 bp, Homo sapiens
ggtctcgaactcctgacctcaagtgatctacccggcttggcctctcaaggtgtggtgattacaggcttgagccatagcgcctggcctcaattgtatttatraagagtgccacagtgagtaaacatgtgagcatgagttcatacataggtaagtatatttgtataggagtatatcaattcctcaaaattgatttaccattcc

SEQ ID NO: 13399 - DNA, 201 bp, Homo sapiens
gaatctctggagatacatttatatctccaatacatttgtaaaatgccatgctctgtttgaataactacaatgatgcagaaatcagtatcttcaatagtagyagatccttgtcttgggtaacacagcatgaaaaatttcaatgaagctctatgaagggaaggatattaacatacatttgcataggagctataaatcgcttta

SEQ ID NO: 13400 - DNA, 201 bp, Homo sapiens
tggtaaaaatcatgtgtattttaatgttaaaatttaaaatttagtgtaatttaattttgcttgtgtgacatcaaaacaaatggaagcattgtgtgtgtgttatatatatatatatatatatacaataacatagtgtcatgaaagtatagtatatatatataaaattttgcgtgtgaaaattttaggtggaggtttttaaac

SEQ ID NO: 13401 - DNA, 201 bp, Homo sapiens
gaggtaaattaggaaataattttattattttttattagcacaaaagggcagatggttgggtagcatgatgaaataattccagtgatcatctctagtcttgrttttttctcagatttataaaagaaataaagagtgatgaagttgtttgagcaataaaagcacacaaagcaaccaagcagcaggaggatggtatgggtggct

SEQ ID NO: 13402 - DNA, 201 bp, Homo sapiens
gtcttaataatctctctcacactcaatttgttttaatttctgtaataataatttttataccaatgtttatgttgttaatactaataattttacactgtaaytgtataactttaattattagaagtgttaacctaactaacaaacatatgaaagcttcctaagggaaacaatttttttttctttttgagatggagtctcgct

SEQ ID NO: 13403 - DNA, 201 bp, Homo sapiens
gataaaggtagcgccctcatgaatggaattagttccctcatgaaggaaccctggagagctcctttctctttccccatgcttggacagaacaagaagtctgycctctatgaatcaggagcagacactgatctaccagcaccttgatcctgggctttccagcatccagagctgtgacaaatacatttatattgttcacaagct

SEQ ID NO: 13404 - DNA, 201 bp, Homo sapiens
ctcacagcagccctgtgacggagagaagtaacatctctacccttgtccatcatagacgtgttcacagacacagctgagctaccagttctctgctgaggcamcaaaaagaagtccttctgtcctgtgctttcataagtacgcagccaatctttccacagtgtaaaaataaaagcaaactatacaagaatttataagttcaca

SEQ ID NO: 13405 - DNA, 201 bp, Homo sapiens
gatccacatgtttctcactggctgacaaaactgtgttaagtcagggtgaagcatggcggaggaacagggaggaagtgcagagtgagaaaacataaagaagycaggaagtgccagaagagtaatttcctgtgagtaaagcctcatactcggtgatttatcgatagagtttgaatacaagagctgtgaggtctgggcagttgg

SEQ ID NO: 13406 - DNA, 201 bp, Homo sapiens
cagtaacaagggtgacattagtcctaggttggaccagcagttgctgggcagcattccttgcagaaatatatatttttttaaggttgtgaagacctttatgyaaggttgtgggttttgtagagtctttttcatcttcaggcatgcaaggataagagccctctcttcatggccttcctggctctatttgtcagggttatctta

SEQ ID NO: 13407 - DNA, 201 bp, Homo sapiens
cagctaattgtttttgtgtttttagtagagacggggtttcactatgttggccaggctggtctcgaacccctgacttgtgatctgcccacttcggcctcccraagtgctgggattacagggatgagccaccgcaccaggcctgcatttcttttttcaaagaattactgtggcattttttccaatgtcattgtgttctgtggt

SEQ ID NO: 13408 - DNA, 201 bp, Homo sapiens
caaagaattactgtggcattttttccaatgtcattgtgttctgtggttcttatctagtcttcacatttatttacataatgaactttcaatgatggatttckacagaatttttgtcactaagtggttgcctagaagtatatatcctaagattgaacatattgaaatatgagctaacttttctcattcaattattgattactt

SEQ ID NO: 13409 - DNA, 201 bp, Homo sapiens
acaatcccatagcatggcgcccagatcagagcagaaccaagcagcctgactcactaagccctccctctgtgtgtttcagtggctcctcatcagcaccaggyttatgtctcatttgtagaaaatgaatgcactgttttacattgtcttggaactcaaaacaaattaatctgaccaaatatttcatgtatgcaattcagacac

SEQ ID NO: 13410 - DNA, 201 bp, Homo sapiens
gtggttcttatctagtcttcacatttatttacataatgaactttcaatgatggatttctacagaatttttgtcactaagtggttgcctagaagtatatatmctaagattgaacatattgaaatatgagctaacttttctcattcaattattgattacttagttagtttatttattatttgggggatgggatcttgcaatgc

SEQ ID NO: 13411 - DNA, 201 bp, Homo sapiens
tccttgattctgaccatggcaacttcatacctgagcaaaagcgagtctagggctgttcttccagctctttccttgatgcatgggcctatggccttgaccaygctcttgacaatcccatagcatggcgcccagatcagagcagaaccaagcagcctgactcactaagccctccctctgtgtgtttcagtggctcctcatcag

SEQ ID NO: 13412 - DNA, 201 bp, Homo sapiens
acatattgaaatatgagctaacttttctcattcaattattgattacttagttagtttatttattatttgggggatgggatcttgcaatgctgcccagaccrgactcaaactcctgggctcaaactcctacctcagcctcccaagtaggtgggattacaggcatgtactacttcacctggctcaattatttattatttataa

SEQ ID NO: 13413 - DNA, 201 bp, Homo sapiens
aactcctgggctcaaactcctacctcagcctcccaagtaggtgggattacaggcatgtactacttcacctggctcaattatttattatttataactcattrtacatatattcagataacttaatctgtgcattaaactcttccactttgttgatagtcatttctgtgtttgctatgtggctacatatgtatgctatgtgtt

SEQ ID NO: 13414 - DNA, 201 bp, Homo sapiens
tattctagggcacttaagtcaagaatatgaattgctttggtcaattttttatatctttactgatactctgttattctgttaattgctgaaagactattgawcagatttcccacaagagtggaggattattctatatctgtttatcattctacccgtgtatactatatacatattgaaagtgtgaatatgtatacacaaaat

SEQ ID NO: 13415 - DNA, 201 bp, Homo sapiens
tttaatttagactaatggttgtgttgaacaacttggttgcaaaagccctgaaaatggaaccgtcagctctcatgatctgggatgcgctgtctgcagttcarcgctgggttcctcccactttctaaacccctcctcagcaggcagactccagcatgcacatgcaccaggaaagagaatataaaatggcatgtttactcttgc

SEQ ID NO: 13416 - DNA, 201 bp, Homo sapiens
tagccgggtatggtggcgcatgcctgtaatcccagctactcaggaggctgaggcaggagaatcgcttgaacccgggaggtggaggttgctgtgagtcaagmtctcgccattgcactccagcctgggtgacagagctagactccatctaaaaaaaaaggaagtttctagtttctgttttacaactctcctgtttcggcctct

SEQ ID NO: 13417 - DNA, 201 bp, Homo sapiens
tgtcctaaaactgattgtggtggtggttgtacaacttcattactatatatacaacattgaattgtagacttatgtgggtgaattgtgtggtttgtgaactrtatatccataaagccattattttaaaaatctaatctttaaaaaatgtcatagcagagccggtgaaggtaatggattagacaacggttcctaaacccaagt

SEQ ID NO: 13418 - DNA, 201 bp, Homo sapiens
atgacgctgtcctaaaactgattgtggtggtggttgtacaacttcattactatatatacaacattgaattgtagacttatgtgggtgaattgtgtggtttstgaactatatatccataaagccattattttaaaaatctaatctttaaaaaatgtcatagcagagccggtgaaggtaatggattagacaacggttcctaaa

SEQ ID NO: 13419 - DNA, 201 bp, Homo sapiens
agctattccgttggaaaactattggacgctgtgtctcaatatcacagaggaacatgagaattagaggaatttgggtgtttttcatcgaactcaggggagartgaatgagcttatgcaatactagcaatgaatccagaaatttttgaaacaaaccttaagcaatgaggttttcttccatggaggtgtctagagaacctatac

SEQ ID NO: 13420 - DNA, 201 bp, Homo sapiens
gtccacgatcaaggcactggtacattcagtgcctggagaggacctgcttccttgttcatagacggctgacttcttgctgcgccctcccacggtagaaagcrggagcgaggtctctggggtctctttgctaagggcgttgagaccattcatgaggattccaccctcatgacctcatcacctcccgaaggccccatctcctcc

SEQ ID NO: 13421 - DNA, 201 bp, Homo sapiens
caacagaatttatttctcacagttctggaggctgggaagtccacgatcaaggcactggtacattcagtgcctggagaggacctgcttccttgttcatagayggctgacttcttgctgcgccctcccacggtagaaagcgggagcgaggtctctggggtctctttgctaagggcgttgagaccattcatgaggattccaccc

SEQ ID NO: 13422 - DNA, 201 bp, Homo sapiens
ctgtcttagtcactttgggcttctttaacaaaagtatcatagactatgtggcttaaacaacagaatttatttctcacagttctggaggctgggaagtccamgatcaaggcactggtacattcagtgcctggagaggacctgcttccttgttcatagacggctgacttcttgctgcgccctcccacggtagaaagcgggagc

SEQ ID NO: 13423 - DNA, 201 bp, Homo sapiens
ggagatcgagaccatcctggctaacacggtgaaaccccgtctctactaaaaatacaaaaaaattagccaggcgtcatggctcacgcatgtagtcccagctyctcaggaggctgaggcaggaaaatcgcttgaacctgggaggtggagcagcctggtgactaattacaaattagtgatttgtatttcactaattatcttttc

SEQ ID NO: 13424 - DNA, 201 bp, Homo sapiens
tcaaaacaatatgcaatcctccccatttctgtcttcctttatcttcctgaatatatacatagtttaatatggcatatctattcccaattgcaatgctctaktcccaaataaacactgtttcctttaggaagctttcatatgtttgttatttaggttaacacttgtaataattaaaggattacagttacaatgtaaaattat

SEQ ID NO: 13425 - DNA, 201 bp, Homo sapiens
aaccgacctaaggggattctcccatttggcccgtcctcccctaaagtcaccacctgctgcttttctggagcgcttaccaggtgagtttcaggagccctagygtacaggaaggagaaacggaggcttgtaggtaggacaccgccaggctgctctgtgttctgttcctcttggtcagcaaggaaggagtacgacaaagtgaga

SEQ ID NO: 13426 - DNA, 201 bp, Homo sapiens
ctgagcaatgcaaaaccaactcctaataagcaccatattaagactaacagtaaagctgctgaatgaaattcacaatttcttttgtggtagtttttgttctttgtttgcatctcactattgttatatagtcacgtcattttgaagttcttcacaacttaagaagaaagtgtaacaattgaattaattattcaaagttcactt

SEQ ID NO: 13427 - DNA, 201 bp, Homo sapiens
actgagcaatgcaaaaccaactcctaataagcaccatattaagactaacagtaaagctgctgaatgaaattcacaatttcttttgtggtagtttttgttctttgtttgcatctcactattgttatatagtcacgtcattttgaagttcttcacaacttaagaagaaagtgtaacaattgaattaattattcaaagttcact

SEQ ID NO: 13428 - DNA, 201 bp, Homo sapiens
tactgagcaatgcaaaaccaactcctaataagcaccatattaagactaacagtaaagctgctgaatgaaattcacaatttcttttgtggtagtttttgttctttgtttgcatctcactattgttatatagtcacgtcattttgaagttcttcacaacttaagaagaaagtgtaacaattgaattaattattcaaagttcac

SEQ ID NO: 13429 - DNA, 201 bp, Homo sapiens
ctgcggcccgggtgttggggatctctgctctatatgatcctgcgacaccatattatcccaatttccctgtgacttttcttttctttcctttttttttttttgtgatggagtctagccctctcacccaggctggagtgcagtggtgtgatctcggcccactgcaacctctgcttcctgggttcaagtgattctcctgcctca

SEQ ID NO: 13430 - DNA, 201 bp, Homo sapiens
gtttacatgtggttttaataatttatgttaactgcgctacagtattaatgcaatgatgatattataatcaatgtatccattctttgatgatggacattcartttgttaccctgttttctgatagcaaaccataatacaatggactttttatatgcattttcttgtccacacataatttcaagggtaggtgtgtcttgaagt

SEQ ID NO: 13431 - DNA, 201 bp, Homo sapiens
tatatgcattttcttgtccacacataatttcaagggtaggtgtgtcttgaagtctagatacagccagtttattctccaaagcggctgtgttttcagtcatstccactactggtttacgagtttccattgctacacattcatattcacacttgattttgtcagcttttcttatttccatcagtattgtgggtgagaatgata

SEQ ID NO: 13432 - DNA, 201 bp, Homo sapiens
agcctgcacatgctcagatggagctctgggcccgcgggttctactgcgcaggccctcacactcagcaaagggacttggacgcgaaagcgctggtggcgctyagccggctgggagttgtagctttctggctgctacagcaggagatacaggtggccaatgggtgagctggctggaggtaggaacaaggttaaggaagctggg

SEQ ID NO: 13433 - DNA, 201 bp, Homo sapiens
ttccctaaaattcttagcaaggttatataggtcaacatacttgttgacctattatgaaaccaatgtttgtggcaaatgctagatgttgagaactgactgaygtctgcttcctaggatggaaagagcagcatatagtgggaaacagagagccagttaaatttaacataatgagatgtaagaaagagtcatgggagtctgaga

SEQ ID NO: 13434 - DNA, 201 bp, Homo sapiens
taggtttaccatttctggttgcagggaactagtgggtgcacctctgaatcacccacaagttgatcttatccatagatcaagtcttaacaccatcttggaamaaagccctacaattttgtttgtgcgattacagtgtgtccagcatagtgtggcctcagactctgtgctgtttatttaagatgctgaaaaaaaatgcgtgac

SEQ ID NO: 13435 - DNA, 201 bp, Homo sapiens
tgtgtagaccaggagtccccaacccccgggctagggactggtaccggtctgtggcccgttagaaaccgggttgcacagaggaggtgagtggacggtgagcrggcgaagcttcatctgtgtttacagctgctccccattgcttgcattaccgcctgcgctctgcctcctgtcggatcagtggtggcattacattctcgtagg

SEQ ID NO: 13436 - DNA, 201 bp, Homo sapiens
tttgtatttttcgtagagacggggtttcaccttgttggccaggctggtctcgaactcctgacctcaagtgatctacccggcttggcctctcaaggtgtggwgattacaggcttgagccatagcgcctggcctcaattgtatttatgaagagtgccacagtgagtaaacatgtgagcatgagttcatacataggtaagtata

SEQ ID NO: 13437 - DNA, 201 bp, Homo sapiens; identical to SEQ ID NO: 1690

SEQ ID NO: 13438 - DNA, 201 bp, Homo sapiens
cccaaggcagcaatctgcaatgtcctctggatctgtgtaaagtcttgtgtggcaaatgacagaaagtccaacttaaatggagtgaaattatcaagagtgtsatggctcaggcgagttcaaggaagagatgtgggactgactccagggaggctgattcatgggctcaaacaacatcacaagggaggaatgtttctccatgtc

SEQ ID NO: 13439 - DNA, 201 bp, Homo sapiens
tgaggaagatacattatttgagacacctcaatgcatttgatactgcaaagggtatatttgctctgtgaatgtgtgtgattttgtatgtccacaaattaagytacagacacaaggagcaatctcccacccctgaattttgactctaagcttggtatagatcctgaatcctgtaagtgaacgattctcaaagtctgaaactcc

SEQ ID NO: 13440 - DNA, 201 bp, Homo sapiens
aacataggctggaaggtcacatgacaaggaagtagtggagctgggatttgaacccaggcagtctggcttcatacttgataagcttaatcacaatgccaaastggtaaatagctgtgtggcataatttcaggtagtgataagtgctgtgaaggataaagcaaagaaaggggcagggatggctctttagagagactacttagg

SEQ ID NO: 13441 - DNA, 201 bp, Homo sapiens
ctgtcactgtctcccatcaccccgagatgggaccacctagttgcaggaaaacaagctcagggctcccactgattctacattatggtgagttgtttgtatarttatttcattatacattacaatgtaataatagaacttaggtgcacaataaatgtattgcacttgaatcatcctgagaccatcccctccctctccagtccg

SEQ ID NO: 13442 - DNA, 201 bp, Homo sapiens
ccatttcatctgcctctctttgctgtttttaaaaaatgtggctgctatgaaattaaaaattgcatttggtcacgcctgtaatcccagcactttgggaggcygaggtgggcggatcttgaggtcaggagttcgagaccagcctgaccaacatggtgaaactccgtctctactaaaaatacaaaaattagccgggcgtgctgg

SEQ ID NO: 13443 - DNA, 201 bp, Homo sapiens
aagttattgtgcactttatttcgattattattacattgtaatatatgatgaaataattacacaactcaccataatgtaaaatcagtgggagccctgagctkctttttctgcagctagatggttccatctgggggtaatgggagacacttacagatcatcaggcattagattctcataaagggcgtgcaacctagatccctt

SEQ ID NO: 13444 - DNA, 201 bp, Homo sapiens
gcccaccaccacgcccagctaatttttgtatttttagtagaacagagaggagaaggttaggggtgagtcagaggaagtacgagagcaatcgctaagagatraggtcgaactttaggaaccaggaaagcctccacacttgtcaccccacacatcagggctgtccaacagaactttctgcagtgatggtgttaccctatggaa

SEQ ID NO: 13445 - DNA, 201 bp, Homo sapiens; identical to SEQ ID NO: 1700

SEQ ID NO: 13446 - DNA, 201 bp, Homo sapiens; identical to SEQ ID NO: 1704

SEQ ID NO: 13447 - DNA, 201 bp, Homo sapiens; identical to SEQ ID NO: 1705

SEQ ID NO: 13448 - DNA, 201 bp, Homo sapiens
tatatatatatatatacaataacatagtgtcatgaaagtatagtatatatatataaaattttgcgtgtgaaaattttaggtggaggtttttaaaccatttrtttactttataaagggtaataaattcacatagtctgctccccaaacacagttgaatatgtactgtggtgttactgtatatatatatatccagagtttctt

SEQ ID NO: 13449 - DNA, 201 bp, Homo sapiens
ttccagggtatacagggagctaccctgtgtttctgagaccctttgtgacatctcacattttttccaagaagatgatgagacagaggcagagccattattgwtccgtgctgttcctgagtgtcaactatctgggggggacattcccaggtaagaaaagctattccgttggaaaactattggacgctgtgtctcaatatcaca

SEQ ID NO: 13450 - DNA, 201 bp, Homo sapiens
taaaaatcatgtgtattttaatgttaaaatttaaaatttagtgtaatttaattttgcttgtgtgacatcaaaacaaatggaagcattgtgtgtgtgttatrtatatatatatatatatacaataacatagtgtcatgaaagtatagtatatatatataaaattttgcgtgtgaaaattttaggtggaggtttttaaaccat

SEQ ID NO: 13451 - DNA, 201 bp, Homo sapiens
tcatcacatttggagttaggatttcaacacatgaacttgagggtggacacatacattcggtccataacaactcctattaaatcaaatgtccagaatgagtmaacctatggagacagaaggtggatgcgtgggtgcctgtggctgggtgtgcgtgcctgtggggaatggggagtgccgcttaatgagtttctttttgaggtg

SEQ ID NO: 13452 - DNA, 201 bp, Homo sapiens
tccaccctcatgacctcatcacctcccgaaggccccatctcctcctatcatcacatttggagttaggatttcaacacatgaacttgagggtggacacatayattcggtccataacaactcctattaaatcaaatgtccagaatgagtaaacctatggagacagaaggtggatgcgtgggtgcctgtggctgggtgtgcgtg

SEQ ID NO: 13453 - DNA, 201 bp, Homo sapiens; identical to SEQ ID NO: 1685

SEQ ID NO: 13454 - DNA, 201 bp, Homo sapiens
gtctaggatttcaatgaaaaacaccaactaggaagaaacaggcttcaagaaatggatgagaggagtaggactgaggaagatacattatttgagacacctcratgcatttgatactgcaaagggtatatttgctctgtgaatgtgtgtgattttgtatgtccacaaattaagctacagacacaaggagcaatctcccacccc

SEQ ID NO: 13455 - DNA, 201 bp, Homo sapiens
gtaagcaaatgccaccacactctccatttctctgtaaacatcagaatatttttacattgtttacttttttatttaaaaaagattttttccaggtgtcacartcatgcttttttttttttgatagcaaattctagatgaaatgggggagattgtggatggctgggtcttggatgagtatgctggttcaaggcagctcatgtt

SEQ ID NO: 13456 - DNA, 201 bp, Homo sapiens
aattactgtggcattttttccaatgtcattgtgttctgtggttcttatctagtcttcacatttatttacataatgaactttcaatgatggatttctacagratttttgtcactaagtggttgcctagaagtatatatcctaagattgaacatattgaaatatgagctaacttttctcattcaattattgattacttagtta

SEQ ID NO: 13457 - DNA, 201 bp, Homo sapiens
acatgctcagatggagctctgggcccgcgggttctactgcgcaggccctcacactcagcaaagggacttggacgcgaaagcgctggtggcgctcagccggytgggagttgtagctttctggctgctacagcaggagatacaggtggccaatgggtgagctggctggaggtaggaacaaggttaaggaagctgggatcttcg

SEQ ID NO: 13458 - DNA, 201 bp, Homo sapiens
ggtatagatcctgaatcctgtaagtgaacgattctcaaagtctgaaactccccctttcatccaggtgcagcctttgtgaaggagaaccaccggcaactccragccaggatgggggacctgaaaggggtgctcgatgatctccaagacaatgaggttcttactgagaatgagaaggagctggtggagcaggaaaagacacgg

SEQ ID NO: 13459 - DNA, 201 bp, Homo sapiens
acccaagaagcctccttgttctttttcttttcttttctttttttcttttttgagacagagtcttgttctgttgcccaggctagaatgcagtggcaattgcrgctcactgaaacctccgcctcccgggttcaagcgattctcctgcctcagcctcccgagtagctgggattacggatgtgtgccaccacgtcctggtaattt

SEQ ID NO: 13460 - DNA, 201 bp, Homo sapiens
cttcacctatttctttcctctgaaacccaagaagcctccttgttctttttcttttcttttctttttttcttttttgagacagagtcttgttctgttgcccrggctagaatgcagtggcaattgcggctcactgaaacctccgcctcccgggttcaagcgattctcctgcctcagcctcccgagtagctgggattacggatg

SEQ ID NO: 13461 - DNA, 201 bp, Homo sapiens
ctttcatcattcccaaatctcatatgcttacttgcttcataccttattgatatactagaaacaaaatgggatggaaaaacctcattgtttcactgtcagcyctgtgagcctgtttctggcccgtcttcacctatttctttcctctgaaacccaagaagcctccttgttctttttcttttcttttctttttttcttttttga

SEQ ID NO: 13462 - DNA, 201 bp, Homo sapiens
cattctgagcccacccttttcctatccttcacttagtgcctcttctttcatcattcccaaatctcatatgcttacttgcttcataccttattgatatactrgaaacaaaatgggatggaaaaacctcattgtttcactgtcagctctgtgagcctgtttctggcccgtcttcacctatttctttcctctgaaacccaagaa

SEQ ID NO: 13463 - DNA, 201 bp, Homo sapiens
ctgatgccactgctgatctgacaggaggagctcaggcggtaatgtgagtgatggggagtggctgtaaatacagatgaaggtttgctccctcactgctcctytcctgctgtgcagcccgattcctaacagctcacacactggtactggtctgcggcccgggtgttggggatctctgctctatatgatcctgcgacaccatat

SEQ ID NO: 13464 - DNA, 201 bp, Homo sapiens
ggtacttaaatacaggagaaaacattttaatctgaatgataaagatgactattcctagagtgggccagaaatacatacattccagtgaattcttgcataayttctgttttcattctgagcccacccttttcctatccttcacttagtgcctcttctttcatcattcccaaatctcatatgcttacttgcttcataccttat

SEQ ID NO: 13465 - DNA, 201 bp, Homo sapiens; identical to SEQ ID NO: 1696

SEQ ID NO: 13466 - DNA, 201 bp, Homo sapiens
tagctgctgtgcacctggataaagtcccacttctgtccttccagcctaggtggggcgattatgccagaaagattacattaaattgtatcgtccccccgtckaatgctccaacatcccaagaatgagaggcaggtgcctgcctgtcaggacttagggtggtgagtaactgtgggtacttaaatacaggagaaaacattttaa

SEQ ID NO: 13467 - DNA, 201 bp, Homo sapiens; identical to SEQ ID NO: 1697

SEQ ID NO: 13468 - DNA, 201 bp, Homo sapiens
ctctggagtaaccctcctcctgttcagtagcatctccctctaatgcacttattaaaggctcatattcccacactctcttctgagttagtgatgaagcagaygtgctggttgctgtagctgctgtgcacctggataaagtcccacttctgtccttccagcctaggtggggcgattatgccagaaagattacattaaattgta

SEQ ID NO: 13469 - DNA, 201 bp, Homo sapiens
ggtaaaaatcatgtgtattttaatgttaaaatttaaaatttagtgtaatttaattttgcttgtgtgacatcaaaacaaatggaagcattgtgtgtgtgttrtatatatatatatatatatacaataacatagtgtcatgaaagtatagtatatatatataaaattttgcgtgtgaaaattttaggtggaggtttttaaacc

SEQ ID NO: 13470 - DNA, 201 bp, Homo sapiens; identical to SEQ ID NO: 1699

SEQ ID NO: 13471 - DNA, 201 bp, Homo sapiens
gtgggcggccccttgtttgatgtcactgcagagccagaggaggctgtcgccgaaatccacctcccccacttcatctccctccaaggtaatgtggggtgagyggaggctgtgggggccgctggggtgcgtgccgtctcactgctgttgtggttctcctgcagcaggtgaggtggacgtctcctggtttctcgttgcccattt

SEQ ID NO: 13472 - DNA, 201 bp, Homo sapiens
tttccaatgtcacataaaatactatacaagaattttagtatttgaactttaaagaatgtaattttgcatttttttcttgtgaagatgaatacagattttcrtgggagtaaaaaagacaatttaaggtgaagagtatttggttttcatgaaataatttgatttctaaaataaaagtaaaccgtcaaaactttttaaatgcaa

SEQ ID NO: 13473 - DNA, 201 bp, Homo sapiens
ggccccatttccctttccgacagcctcataggaacttctccctttcttctcaagtgaccaagaggaacagaacacagagcagcctggcagtgtccaagcarcaagcctccgctcctccttcctgcaccctggggctcctgaaactcacatggtaagcgctgcagaaacgcagcaggtggtgactttaggggaggacaggcc

SEQ ID NO: 13474 - DNA, 201 bp, Homo sapiens
aatagtttcctcttatgcttctaaagtctgttttgagatcgaagaagattataaaaatcgtcagtttctggggcctgaaggaaatgtggatgttgagttgrttgataagagcacaaacagatacaggtaagaatggaagatgctgatgatttgaaaaccactctgatataaaggaagtgtgtaggccaggcgtggtggctc

SEQ ID NO: 13475 - DNA, 201 bp, Homo sapiens
gaaactccccctttcatccaggtgcagcctttgtgaaggagaaccaccggcaactccaagccaggatgggggacctgaaaggggtgctcgatgatctccargacaatgaggttcttactgagaatgagaaggagctggtggagcaggaaaagacacggcagagcaagaatgaggccttgctgagcatggtggagaagaaag

SEQ ID NO: 13476 - DNA, 201 bp, Homo sapiens
attttgtatgtccacaaattaagctacagacacaaggagcaatctcccacccctgaattttgactctaagcttggtatagatcctgaatcctgtaagtgarcgattctcaaagtctgaaactccccctttcatccaggtgcagcctttgtgaaggagaaccaccggcaactccaagccaggatgggggacctgaaaggggt

SEQ ID NO: 13477 - DNA, 201 bp, Homo sapiens
ttgttggcttcattgtcaggctccacacagtgtaagtttccgaactcatgtctcaaaacagaccactgggagaaaaaagagagcaccttctgagatggcartcatgccatttcctagctgttgttgcctggaaggccattgaggcagattaaataaaaagaaatcatgcctcacatctggaggtgcaatgaggatcagcta

SEQ ID NO: 13478 - DNA, 201 bp, Homo sapiens
gggttactgtggcaacgccaacctttgaatccccctcctgcgcgctgagcggctcgtaaccatggagaccgaagcaggtttcccgcgtccgcctcctcacmcagagactgcagccccggcgcccagaccctttggacaaggagatccaagcgggccccacaatgctcagcgggtaaagagctcctccccactcctctcccg

SEQ ID NO: 13479 - DNA, 201 bp, Homo sapiens
acgtgcttgggaaccatttatttttccatttctgtgaatttcatgttcatatcctttgtctacctatttctagagcaatgtttttttttattattgatttyctatttcatgtatcagaatagctctttgctctgctctatttgtctatctgtttgtcagtctatctatcgagaagtaaatacaggcatgtgtaggcacagt

SEQ ID NO: 13480 - DNA, 201 bp, Homo sapiens; identical to SEQ ID NO: 1688

SEQ ID NO: 13481 - DNA, 201 bp, Homo sapiens
accagcctggccaacatgacgaaaccctgtctctactaaaaatacaaaaattagtcaggcgtggtggcacccgcgtgtagtcccagctaatcaggaggctragaaaggagaatctcttgaacccagggggcagaggttgcagtgagatgagatctcgccactgcactgcagcctaggagacagagcgagactttgtctcaa

SEQ ID NO: 13482 - DNA, 201 bp, Homo sapiens
tgataagagcacaaacagatacaggtaagaatggaagatgctgatgatttgaaaaccactctgatataaaggaagtgtgtaggccaggcgtggtggctcasgcctgtaatctcggcactttgggaggtggaggagggcggatcacaaggtcaggagttcgagaccagcctggccaacatgacgaaaccctgtctctactaa

SEQ ID NO: 13483 - DNA, 201 bp, Homo sapiens
tacccgaatccatagcaaaatgtgtagccgcagacagcaaccagtcttaggatgtcagcccaggggtctctccatgcttggcttgcccacagaatccttcygagaaaagcgctgtaaagcctttctcttcatcccacttctctaggtacctgttctttttaaacctaatccacgtgtcagtttctctgctggtctctttca

SEQ ID NO: 13484 - DNA, 201 bp, Homo sapiens
gggcatagactgctgaaaagtgtagaaaaatgactggaaattggtatgttttaatatgtattacttttgtttttaatatgatttatttaaatgttagcttrtatcatttaatttagactaatggttgtgttgaacaacttggttgcaaaagccctgaaaatggaaccgtcagctctcatgatctgggatgcgctgtctgca

SEQ ID NO: 13485 - DNA, 201 bp, Homo sapiens
gaatgagcttatgcaatactagcaatgaatccagaaatttttgaaacaaaccttaagcaatgaggttttcttccatggaggtgtctagagaacctatacasaaaaaggcaatgagcaatgcaatcgaagaccagtgggttattggttaagctgttactcaatacataaaaccaacctaattctctaggaaactggctgatg

SEQ ID NO: 13486 - DNA, 201 bp, Homo sapiens
gatttggccaagtttatacagacattatatggggcacaacgtaaaccctgagtctacatgatggaaaaaagtctgtatcttttcccctgttcttccttttstatgcattgtatgtctccagttaaatctcttctttcatagctctgccagctaagctttggggatccagctgaatccttctccatacctctagcatcatgc

SEQ ID NO: 13487 - DNA, 201 bp, Homo sapiens
aagataaaatattgagtctatggctattaacataaaatcttcctgcacagcctatgctatcatcaggcacctaccttatattcatagtaaaaattctgttsttgttttccagggtatacagggagctaccctgtgtttctgagaccctttgtgacatctcacattttttccaagaagatgatgagacagaggcagagccat

SEQ ID NO: 13488 - DNA, 201 bp, Homo sapiens
gagatgggaagctcatatttattctgtcttggtgacatggtgactgagctgctgccaaaggtggggtggggggggcatgttgcaaaattcatctgaacttygaaaacatcaaggagtctagatgaaagtgcaaaaccacattgaaggcatcatgggaaatttttttaattattttccaaaatggtagctccaattagcaaa

SEQ ID NO: 13489 - DNA, 201 bp, Homo sapiens
cagacgtcctatgcctatgtccattacccagaaaaattcttttagtttcacgtggctggggaggcctcaccatcatggcagaagtcaaaggaggagcaaasgcatgtcttacatggtggcaggcaagagccacgtgtggcttttgagcacttgaaatatggctacttcaaaggaggaactgattttcacatttaacaattt

SEQ ID NO: 13490 - DNA, 201 bp, Homo sapiens
cccagacaatttgccaaagatctcctgatagttccttgaatctctggagatacatttatatctccaatacatttgtaaaatgccatgctctgtttgaatamctacaatgatgcagaaatcagtatcttcaatagtagcagatccttgtcttgggtaacacagcatgaaaaatttcaatgaagctctatgaagggaaggata

SEQ ID NO: 13491 - DNA, 201 bp, Homo sapiens
tagcccaaggcaggaccctctggtcaactggactacagcagaggttctaaagtcaatgctgtccaatagagttctcacccaggatggaaatgttccctgtctgtggtgtccagtgtgaaagccactggcctcacatggctttttctttttttaacatacatactttaatcagaattgctgaaaaaatattcaggatttttg

SEQ ID NO: 13492 - DNA, 201 bp, Homo sapiens
gggttggatgatgctcagccgacccaggcctcatctccacatgagtagcatctcatgagtgcacctccacatgcaccctccccgcctcctccctccagtckgtaaaatgtcttagcatctcagattgtcagagttttgtttgtgcaacttcttagctctccttgtgatgtttaatatgcgaagaagccgtgcagatgtcgg

SEQ ID NO: 13493 - DNA, 201 bp, Homo sapiens
taaaaataaaaatagaaatgaaaccaatggcagatagcccaaggcaggaccctctggtcaactggactacagcagaggttctaaagtcaatgctgtccaayagagttctcacccaggatggaaatgttccctgtctgtggtgtccagtgtgaaagccactggcctcacatggctttttctttttttaacatacatacttta

SEQ ID NO: 13494 - DNA, 201 bp, Homo sapiens
ttcacaggctgaaaagcactgctaatgaggacaggaattcctcagtcttgcttggtccatgcacccatttaacatgggatattttaaaagcagtgctgcaygccggggaccatggatggtagagcttaaagaactactttgtttaataaaacctatcccagactgggtgcggtggctcacaggtgtaatcccaggactttg

SEQ ID NO: 13495 - DNA, 201 bp, Homo sapiens
accaccacacctggctaattcttgtatttttaatagagatggggtttcacagtgttggacaggctggtcttgaactcctgaccttgtgatctgcccgcctyggcctcccaaagtgttgggattacaagcatggaccactgctcctggcatctccgtgacttttctgagtctctcctcaaatcgcctctgcaggttcttgct

SEQ ID NO: 13496 - DNA, 201 bp, Homo sapiens
cacacaccaccacacctggctaattcttgtatttttaatagagatggggtttcacagtgttggacaggctggtcttgaactcctgaccttgtgatctgccygccttggcctcccaaagtgttgggattacaagcatggaccactgctcctggcatctccgtgacttttctgagtctctcctcaaatcgcctctgcaggttc

SEQ ID NO: 13497 - DNA, 201 bp, Homo sapiens
gcacacaccaccacacctggctaattcttgtatttttaatagagatggggtttcacagtgttggacaggctggtcttgaactcctgaccttgtgatctgcycgccttggcctcccaaagtgttgggattacaagcatggaccactgctcctggcatctccgtgacttttctgagtctctcctcaaatcgcctctgcaggtt

SEQ ID NO: 13498 - DNA, 201 bp, Homo sapiens
tcaacatacttgttgacctattatgaaaccaatgtttgtggcaaatgctagatgttgagaactgactgacgtctgcttcctaggatggaaagagcagcatrtagtgggaaacagagagccagttaaatttaacataatgagatgtaagaaagagtcatgggagtctgagaggtgagatggagtcgtaggggcctgaggaat

SEQ ID NO: 13499 - DNA, 201 bp, Homo sapiens; identical to SEQ ID NO: 1707

SEQ ID NO: 13500 - DNA, 201 bp, Homo sapiens; identical to SEQ ID NO: 1708

SEQ ID NO: 13501 - DNA, 201 bp, Homo sapiens
agcctatgctatcatcaggcacctaccttatattcatagtaaaaattctgttgttgttttccagggtatacagggagctaccctgtgtttctgagaccctytgtgacatctcacattttttccaagaagatgatgagacagaggcagagccattattgttccgtgctgttcctgagtgtcaactatctgggggggacattc

SEQ ID NO: 13502 - DNA, 201 bp, Homo sapiens
cttctgctatttcggaccagtagaaatgtaggtgcattggttccagtcctcagcaaatggtgcctcccaccaaagctgtccagcctggcttcccagaaagycttatggaatttggtgtatacgtttagtcatgacaaggaacattcttgtgcctttctttgtctggattcaaagaagcgaaactgcatattctggtcactc

SEQ ID NO: 13503 - DNA, 201 bp, Homo sapiens
agaaaagctattccgttggaaaactattggacgctgtgtctcaatatcacagaggaacatgagaattagaggaatttgggtgtttttcatcgaactcaggrgagaatgaatgagcttatgcaatactagcaatgaatccagaaatttttgaaacaaaccttaagcaatgaggttttcttccatggaggtgtctagagaacc

SEQ ID NO: 13504 - DNA, 201 bp, Homo sapiens
tttgcataaaaattagtatatatgttacttttcttctttgttatcttaagtttttatttcaaaagagtttgtatctcataagaagtagggaaaaaaggtcygagcccagtggctcacacctgtaatctcagcacactgggaggcgagggcaggtggatcgcctgaggtcaaaagtttgagaccagcctggcctacatggtg

SEQ ID NO: 13505 - DNA, 201 bp, Homo sapiens
tcaggcacctaccttatattcatagtaaaaattctgttgttgttttccagggtatacagggagctaccctgtgtttctgagaccctttgtgacatctcacmttttttccaagaagatgatgagacagaggcagagccattattgttccgtgctgttcctgagtgtcaactatctgggggggacattcccaggtaagaaaag

SEQ ID NO: 13506 - DNA, 201 bp, Homo sapiens; identical to SEQ ID NO: 1693

SEQ ID NO: 13507 - DNA, 201 bp, Homo sapiens
ccacaatgctcagcgggtaaagagctcctccccactcctctcccgccagcagacgaaggaaacaccccgcagcctgcacatgctcagatggagctctgggmccgcgggttctactgcgcaggccctcacactcagcaaagggacttggacgcgaaagcgctggtggcgctcagccggctgggagttgtagctttctggctg

SEQ ID NO: 13508 - DNA, 201 bp, Homo sapiens; identical to SEQ ID NO: 1694

SEQ ID NO: 13509 - DNA, 201 bp, Homo sapiens; identical to SEQ ID NO: 1701

SEQ ID NO: 13510 - DNA, 201 bp, Homo sapiens
taagacgtttgtattcagttggtagctcagatagtttttctctgactcatgtggtgttgacagctaggttattcttcccttcctggtataaaagcatttcytaacattgtaaatgtaaagagctgtttacctctctccctctgtttcccactcaaccagccatgacattgcacaggaaacgggttaagttccattggccag

SEQ ID NO: 13511 - DNA, 201 bp, Homo sapiens
gtcatggctcacgcatgtagtcccagctactcaggaggctgaggcaggaaaatcgcttgaacctgggaggtggagcagcctggtgactaattacaaattartgatttgtatttcactaattatcttttctgttatccagagtctctgaaatgctattaataatatgtatttttattattatataaaagttaatcttcaaaa

SEQ ID NO: 13512 - DNA, 201 bp, Homo sapiens; identical to SEQ ID NO: 1687

SEQ ID NO: 13513 - DNA, 201 bp, Homo sapiens
cagttaaactctgctcttaatgcacattcttgagcccactggcccagttcccgagatcttattgggaagctgctgatcaccagtttcaggtgttttctctstgtcaggagacggcctttccctggtgccggctgcaaccaattattattttagagagacggtgtaacaactgcctgaccatcacctgatggttgcctgaca

SEQ ID NO: 13514 - DNA, 201 bp, Homo sapiens
aatgaccagaaactcaattgtgagacctcacaggagatgggaagctcatatttattctgtcttggtgacatggtgactgagctgctgccaaaggtggggtkgggggggcatgttgcaaaattcatctgaactttgaaaacatcaaggagtctagatgaaagtgcaaaaccacattgaaggcatcatgggaaatttttttaa

SEQ ID NO: 13515 - DNA, 201 bp, Homo sapiens
ggtgatgatttgataggtgcagcaaaccaccatggcacatgtttacctttgtaacaaacctgcatgtcctccacatgtatcccagaacttaaattaaattwaaaaaaatagtttgaataaaataaaatgttcttgccaaaaaagaaaaaaaaaagagaaatctattgtcagtgtattatcagtgtgataacacaacaatgg

SEQ ID NO: 13516 - DNA, 201 bp, Homo sapiens; identical to SEQ ID NO: 1691

SEQ ID NO: 13517 - DNA, 201 bp, Homo sapiens
atctctagaacaaagtatcaagatttaattgttttccagttttaatgggaaaacacatcccagtgatttcaaggtctttaattcagaatgggacggaccaatgttattgttttggcgtagatggctttttcctgtttgcggaccttggaagaggtgagaaacaagagggttaggtgtcagtatttacatgtctcctttttg

SEQ ID NO: 13518 - DNA, 201 bp, Homo sapiens
cttttttccctctttctctctttctttctttctttcttttctttctttctttccttccttccttccttccttccttccttccttccttccttccttccttycctttctttccctctttctctctttctttccttcttttttgatggagtctcgctctgttgcccaagctggagtgcagtggtgtggtcttggcccactaca

SEQ ID NO: 13519 - DNA, 201 bp, Homo sapiens
ttaaccaacttaaagctagtatatttccaaatagatttccttccttccttccttcctctttcttttttccctctttctctctttctttctttctttcttttctttctttctttccttccttccttccttccttccttccttccttccttccttccttcctttcctttctttccctctttctctctttctttccttcttttt

SEQ ID NO: 13520 - DNA, 201 bp, Homo sapiens
attaaccaacttaaagctagtatatttccaaatagatttccttccttccttccttcctctttcttttttccctctttctctctttctttctttctttcttytctttctttctttccttccttccttccttccttccttccttccttccttccttccttcctttcctttctttccctctttctctctttctttccttctttt

SEQ ID NO: 13521 - DNA, 201 bp, Homo sapiens
tcctttctcaggtaagtgaaatgtttacattaaagccaagggtatgtatgagacatcaaggggtctttgagtgacagtggaaggtatccaagtgacatggyaccagaacgttactggcagcaaatccgtataggtctgcagcaacctcaattcttgcctccttagaagacagaatttgactgaggggcataaggcagaagg

SEQ ID NO: 13522 - DNA, 201 bp, Homo sapiens
tgaagcacaaggttatcctttggcctgagagagacatattatgccgagaatgtgtgtaatcctttttacttaggaattgtgggtggagtttttttccccccaagagtgattgttaacttgggtccatcattttcctttgattgttctttatctaaaacaaaacaaaacaaaaaacaacaacttcctggtcttctcacctat

SEQ ID NO: 13523 - DNA, 201 bp, Homo sapiens
tggaaaaatgtgtttcttcctccgatgccttttctgaattgtcagtgagtgacccacaacttaatggggtttcctcagtgtattagtgtgcaaaacaagasccttatgacatatgtagaattaaattatttcagttggttgcatcaaagactagaaaagctaaataagggtacatgatttatctcatctcatcatataatt

SEQ ID NO: 13524 - DNA, 201 bp, Homo sapiens
agcctgagcgacagagggaggccccgtctcaaagaaaaaaaaagattctttctctaacttactggtttatcttacttttgtagcttatttcaggtgattcrttatgtttctctatagaggaaaataacgtgtagtgagttatagtttaatctccttcctttcaatcactgtatttggaatttgtccaatattttggaataa

SEQ ID NO: 13525 - DNA, 201 bp, Homo sapiens
gacaatagcatacgggaactgcaatacacaaaaactggaattttttttcaggctgaggcctgtgtgacaaatgatacgtaagggacatctatttgttgggraaaaattaaagatttggaattttgctccattggtttatgtacattcataagaagcaaagacatgcaggttatttgcataaaaattagtatatatgttact

SEQ ID NO: 13526 - DNA, 201 bp, Homo sapiens
tttggccaaagattctttaatggattcacgttacacttagaacatgaatcaaataatttactatggcctagaggccatggcttttttttttttttttttttgagacggagtcttgctgtgtcccccaggctggagtgcagtgggcgtgatctcagctcactgcaacctccgtctcccaggttcaaacaattctcctgtctc

SEQ ID NO: 13527 - DNA, 201 bp, Homo sapiens
ctcctctgacatgctcacattccaattccatttgtgttttcccagggacagtggatccagtaggaacatagatgcatccaaactcattagactacaaggaycacggaaactgttggttgacaatagcatacgggaactgcaatacacaaaaactggaattttttttcaggctgaggcctgtgtgacaaatgatacgtaagg

SEQ ID NO: 13528 - DNA, 201 bp, Homo sapiens
actttgtctcaaaataaataaataaataagtaaataaataaaatagagttaacactgagaggaccaagtttccatcatctagtaagcaataaatccaggtytggaactccttgtctcctgatgacttcatgtccacgttaattttaaaaatcacccaaggcagcaatctgcaatgtcctctggatctgtgtaaagtcttgt

SEQ ID NO: 13529 - DNA, 201 bp, Homo sapiens
ctctgctctatatgatcctgcgacaccatattatcccaatttccctgtgacttttcttttctttcctttttttttttttgtgatggagtctagccctctcrcccaggctggagtgcagtggtgtgatctcggcccactgcaacctctgcttcctgggttcaagtgattctcctgcctcagtctcctgagtagttgggatta

SEQ ID NO: 13530 - DNA, 201 bp, Homo sapiens
gcctctactaaaaatacaaaaactagctgggcgtggtggcacatgcctgtgatcccagctactcggggggctgaggcaggagaatcgcttgaacccaggggcggagattgcagtaagccgagatcgtgccatcgcactccagcctggggacaagagtgagactttgtctcaaaataaataaataaataagtaaataaataa

SEQ ID NO: 13531 - DNA, 201 bp, Homo sapiens
acttgtaatcccaacactttgggaggccgaggcaggtggatcacctgaggtcaggagtttgagaccagcctggccaacatggtgaaaccctgcctctactraaaatacaaaaactagctgggcgtggtggcacatgcctgtgatcccagctactcggggggctgaggcaggagaatcgcttgaacccaggggcggagattg

SEQ ID NO: 13532 - DNA, 201 bp, Homo sapiens
ataagcaccatattaagactaacagtaaagctgctgaatgaaattcacaatttcttttgtggtagtttttgttctttgtttgcatctcactattgttatayagtcacgtcattttgaagttcttcacaacttaagaagaaagtgtaacaattgaattaattattcaaagttcactttggttgcaatattttggtttgtttt

SEQ ID NO: 13533 - DNA, 201 bp, Homo sapiens
atatttttattgaaaattggatagaaatatttgtttagttggaacctgtgagtgattattatgcatataaatagacattcagttattgcagataaattcaktggtggtaaaataaaacatttgtatagggttttggaattcaaatctttagattatttctctgggccaggggcaatggctcacgtctgtaatcccagcact

SEQ ID NO: 13534 - DNA, 201 bp, Homo sapiens
cattatttaatataaagagttggctgggtgcagtggctcacacttgtaatcccaacactttgggaggccgaggcaggtggatcacctgaggtcaggagttygagaccagcctggccaacatggtgaaaccctgcctctactaaaaatacaaaaactagctgggcgtggtggcacatgcctgtgatcccagctactcggggg

SEQ ID NO: 13535 - DNA, 201 bp, Homo sapiens
cttgtcatctgccaagaatgactgatgtcataaatacagacaatgagtatgatttagtcccagaagggcgtgaggacatcatgtagacacaaaagagcatrcaacagcaaattattgggggtaaatatttaatatcttgcgtctggggaactctaagttaaagtagtttgatatggctgtgaattaaactgttagagggac

SEQ ID NO: 13536 - DNA, 201 bp, Homo sapiens
gcctctgtttcccaaagtgctgggattacaggcgtgagccacggtgcctggcccatttttcttctttcaagacattctaatatgacctttgcccctggcastataccatatcactaaatctaatgatgactttcagttttctgtctacctcattgattactcctttctcagttctactttgctgtctgatgagtacatgtt

SEQ ID NO: 13537 - DNA, 201 bp, Homo sapiens
ctccgtgtttggccttgtggtgagtcttatctgcatttctagtatttctttaatttgttcatccatgtgagatgggtataacctttttacagatgaagaarcttgagtctcagagaggtcagttaatttgtccaagggtctcacagctgtgtgtcagaatcaggtttcaacatcagatcagtgattctaaaacctgaaatg

SEQ ID NO: 13538 - DNA, 201 bp, Homo sapiens
agggataaactaaagaaaatggcacttaattttagcttaagttactttatatatttaattttgtaagcagaaaagtataggactctagattccatgactayatcctgaacaattaagtggccaaactggatatcatggaaaataagggttgagtctttttttttttttttttttttttgagacaaggtcttgctctgtcac

SEQ ID NO: 13539 - DNA, 201 bp, Homo sapiens
tttatatatttaattttgtaagcagaaaagtataggactctagattccatgactacatcctgaacaattaagtggccaaactggatatcatggaaaataarggttgagtctttttttttttttttttttttttgagacaaggtcttgctctgtcacccaggcaggagtgcagtggtgcaatttcggctcactgcagcctct

SEQ ID NO: 13540 - DNA, 201 bp, Homo sapiens
acttgtaatatcttactctccaaatacaattgtctatctttctaccttactccctttaatatacagtctccaccaggatcaatcaagatctattgatcttgtcaccttttcattttcccttatcccccttatgtattcacttccctatttaactctgctttgtcattgtcagatcatcattatcactctcaaagagcgaga

SEQ ID NO: 13541 - DNA, 201 bp, Homo sapiens
atgcttttaagtccttgctcctctgctcactagttagtgacattgggcaacttaacgttctgagtgttgggggttttttgtctataaaatgaggataataygtgcaaaaaagtttatttcaaataagtgcctaggctgtagtaggggttctgtaaatcaatgacagtgatttctttgtgttcccagcatttagaatgaatg

SEQ ID NO: 13542 - DNA, 201 bp, Homo sapiens
ttccaaaaggagttagtaacttgttgagaaactgaattattttaaaatttagctgactttccccaagtcctctctgctcttacttacaaatgataaacttmtatcacatcatcctaataagtcaagagacccatggtctagtcctgtggagccactaaagcaacatggcctgttttacttggactacattccaaatgagag

SEQ ID NO: 13543 - DNA, 201 bp, Homo sapiens
gtgggtcctaacctatgattacatatttatgggtgtgtttagtttagtctccatgaccactccgagatttttctgtatgttttcaagtcttttacaaatayaaatattggccattattatttctgcttccaatgtttgttctgtcaggtttcagaggcacccatcagctccttatctgttgtaccttagaaaatgcaaaat

SEQ ID NO: 13544 - DNA, 201 bp, Homo sapiens; identical to SEQ ID NO: 1738

SEQ ID NO: 13545 - DNA, 201 bp, Homo sapiens; identical to SEQ ID NO: 1741

SEQ ID NO: 13546 - DNA, 201 bp, Homo sapiens; identical to SEQ ID NO: 1742

SEQ ID NO: 13547 - DNA, 201 bp, Homo sapiens
gcatggtttattttttccctttagaatgaaaaccaagattcatttttttcaggctaccaaaatgtatgattttaattgtatatttaactgctcgacagatwgaatgtaatattttagagtgaatttgaaaagtagataactaaagaatatacagaggcatgtttacttatttgggtgatgatttgctgtgaaatctttaaa

SEQ ID NO: 13548 - DNA, 201 bp, Homo sapiens
tagcatctaatttagttctttgcatgttgagacaagaaatatctaaatgtaactttcatgaagaaagatttaagataaaatttaggaactctaaaagtttktacaagctaaaattccttatcagtgaaagttatataatctttctgtatgcaaaaaaataatttttttatcctcttttacttacaggcacaagatgctggt

SEQ ID NO: 13549 - DNA, 201 bp, Homo sapiens
ggaaaaacccagttcttcttaaaattctgtctcaacagccagtagaaacggaggaaggtaagtcttaagactatattggatgaggatttagttctgagaamgttggaattgattatgggttaaaattttgggaatttaacttgtgtatatatctagtctttctgtttttactttgagtagtaaaaattaactattagcatt

SEQ ID NO: 13550 - DNA, 201 bp, Homo sapiens
atgttaccaaggaaggggtgtggaaaaacccagttcttcttaaaattctgtctcaacagccagtagaaacggaggaaggtaagtcttaagactatattggytgaggatttagttctgagaacgttggaattgattatgggttaaaattttgggaatttaacttgtgtatatatctagtctttctgtttttactttgagtag

SEQ ID NO: 13551 - DNA, 201 bp, Homo sapiens; identical to SEQ ID NO: 1744

SEQ ID NO: 13552 - DNA, 201 bp, Homo sapiens; identical to SEQ ID NO: 1745

SEQ ID NO: 13553 - DNA, 201 bp, Homo sapiens; identical to SEQ ID NO: 1746

SEQ ID NO: 13554 - DNA, 201 bp, Homo sapiens; identical to SEQ ID NO: 1747

SEQ ID NO: 13555 - DNA, 201 bp, Homo sapiens
tgaggcaggagaatggcgtgaacccgggaggcggagcttgcagtgagccaagatcgcgccacggcactccagcctgggtgacagagcaagacttcatctcaaaaaaaaaaaaaaaaaaaaaatttgagggctcatccagagcactgtacagtcaatgccaagtgcctaatattcagtacagctcagaagtactgagcttca

SEQ ID NO: 13556 - DNA, 201 bp, Homo sapiens; identical to SEQ ID NO: 1750

SEQ ID NO: 13557 - DNA, 201 bp, Homo sapiens; identical to SEQ ID NO: 1752

SEQ ID NO: 13558 - DNA, 201 bp, Homo sapiens; identical to SEQ ID NO: 1753

SEQ ID NO: 13559 - DNA, 201 bp, Homo sapiens; identical to SEQ ID NO: 1754

SEQ ID NO: 13560 - DNA, 201 bp, Homo sapiens
ggcagaatttaaaagcacacttaaaatagttgaattgtgaaaaggcataaagaaagcgtggtgattaagtgtgggctgaggagccagatggctctagttcraatcctgaatctaacacctattggatgactttgcccaaataattcaatctctcatgtttcctcatttaaaaaaaaaaaaaattcccaaaagacaacttga

SEQ ID NO: 13561 - DNA, 201 bp, Homo sapiens
tagagtgtggtggcgcacactgctcactgcagcctcaaaatcctgggctcaggtgatcttcccacctcagcccctggagtagctaggaccacagaaacatrccaccattcccgattaatttattttttatttattttttatttttttggagagacagggtcttgccatgttgcccaggctggtctcgaactcccagggtca

SEQ ID NO: 13562 - DNA, 201 bp, Homo sapiens
accagcattctgaagtacaggatatctgtcagtgccattgcttgaaaacattccccagaagcattcactttagaatggaagttagatgttgtaaactcggsaagaaggccaaatgatgaccatgacacaacttgctacaaaatattaaagctgatgctgggggtgagggggcagaatttaaaagcacacttaaaatagttg

SEQ ID NO: 13563 - DNA, 201 bp, Homo sapiens
ttttgggtttgattcctcatcctgtaataataacaactttactctctcagcctttgcttaattaaaacccgttttgtttctaatgttgtattaggcattgrcaaatacagcaaactgtatggcccagtttgtttgccaaaaatagttacagaaagagaagtactaagctcaatgattactgccctaaattcagtagaagtg

SEQ ID NO: 13564 - DNA, 201 bp, Homo sapiens
gctgataatgtttccaaggcccttcctgcattaagctaattagaaaggccaagcccagctggaatgcaggtcacctggctccttggtcagccttctttccrctctaccacctatttccatgtgttagacattgataagccatggtctgattgggaacatcttggtgatatatcattctgttcatatttatacatataggtg

SEQ ID NO: 13565 - DNA, 201 bp, Homo sapiens
tgccagttggctgcctcttatgcctgttattactgttgtttaattgcctgattattttgaaacctttctaactgtatctaatcttgccttttcctaatttrttttctgcagtggccaaggtgatcctttttcttttttaagtaaaattagatattttattttgaggtaattttagattcacatgtaattacaagaaataat

SEQ ID NO: 13566 - DNA, 201 bp, Homo sapiens; identical to SEQ ID NO: 1736

SEQ ID NO: 13567 - DNA, 201 bp, Homo sapiens
tctgagaaatgatagagcccaaaatgcatgaaatagcagaatcaaagaggcaaatggacaattcaaacatgagagttggagactttaacacccactctgamtaatgggtagaacaactaggcaacaaagaaatggaagacttaaacaatactgtaaaccaactggactgagcagacatctatagactactccacccaacag

SEQ ID NO: 13568 - DNA, 201 bp, Homo sapiens
aataagaaccaagatgaaaccaagtacagtgttgtgattcagatttctgtataggttgattgcatcctggatcagtgcttgggtcaatagttatttcaaayggctaagaccccctgctatggcccagatcatatctcccactgtgagaatcttttatcagatttttttgttgaaaattgttttttttggagacagagtctc

SEQ ID NO: 13569 - DNA, 201 bp, Homo sapiens
agtgaaaccccgtctctactaaaaatataaaaaattagctgggcacggtggtgggcgcctgtagtcccagctactctggaggctgaggcaggagaatggcktgaacccggaagtcggaggttgcagtgagctgagatcgcgccactgcactccggcctgggcgacacagcgagactccgtctcaaaaaaaaaaaaaaaaaa

SEQ ID NO: 13570 - DNA, 201 bp, Homo sapiens
tacattcagaattctttattctatgtgccatgggccctggctacttttctaacgttctctcaccttatcttgtaatcttagtgcccactactctccagccrccttgtctttgctgttctttgaacaagccaaggatgttcctgtcttagagctttgtgcttgctattccctctgacgagaattgccttccacaagataatt

SEQ ID NO: 13571 - DNA, 201 bp, Homo sapiens
tatctgtattgagactgtagtagaacttccttatagtgtctgttcccttctttaatattttcttatgtgaaatattcatgcaagaagactcattcattagyaggagaaaattatgtctctaatttttgcctcattaagaagtttcaccttatataacaaagtttactgaaaagtcaccattttctttttgacttagtcatc

SEQ ID NO: 13572 - DNA, 201 bp, Homo sapiens
atatatttactttaaattacatgttttcatttcttaagctttggatttgtagccaactttctgggagacagtctgtgttaatagcaatataggatatcagkgtttttaaattggcttatgaaaaagtacagatttttaaatgaaaattatttaatcagtatccattgatttacttaaaagagccacatgtattaagtgata

SEQ ID NO: 13573 - DNA, 201 bp, Homo sapiens
tttgcccctggcagtataccatatcactaaatctaatgatgactttcagttttctgtctacctcattgattactcctttctcagttctactttgctgtctratgagtacatgttgcagtacccaatgactctgtcattgggtcttctctttttacacttaactaggcttatttccttcatctttggctttaaataccaact

SEQ ID NO: 13574 - DNA, 201 bp, Homo sapiens; identical to SEQ ID NO: 1737

SEQ ID NO: 13575 - DNA, 201 bp, Homo sapiens
tcaagtataagcctaagtagttgatcccaagatcactgtctatcccagttagagcagcttgcatcatttgatctttattaaagacttttggctgggcgcgrtggctcgcacctgtaatcctggcactttgggaggctgaggcgggtaggtaacctgaggtcaggagtttgagaccaggctgaccaacatggagaaaccccg

SEQ ID NO: 13576 - DNA, 201 bp, Homo sapiens
tgctgaataaattgcggcgttctaaaataataattttggggggcaatttgctctgttggtccggagtagaataaaagttagcttgcttgattgcttttctyccctctctctgccgaggcagaagcacctcatctctctgaatggaattttgtccttactaatcttttccgtggattgtaccactccaatttttgtgtgtac

SEQ ID NO: 13577 - DNA, 201 bp, Homo sapiens
aacagatgattttcccaaagatatctagggttacttgaaatgtaagtttgctaactgtaactcccacctttcttctactcaaggatgcaagtgaatgaagtattattatatgaataagcttaaatctactttgattcctttttgaaaaaataaaacatttatcaactttgatttttaaaatctattactaggaacaaattg

SEQ ID NO: 13578 - DNA, 201 bp, Homo sapiens
tgccttggcctcctaaagtgctgggattataggcaagagccactgcgcccggtctgcttataccttttttattggctgcaacaactgagggccatgaaaamagttttttttattttatatatatgaaataattggaattcattgttttatagagagatgcaaagaatgaagtttttgttgtttttgttttgttttgtttta

SEQ ID NO: 13579 - DNA, 201 bp, Homo sapiens
atactgtatttgtgcattagcctacttgctaaaatttatttgtaaaaccagctgactctgactgagctttttatgaaaaaatttcacctccaaaggttttkcagggattaaattatgtgtatttgttacatatgaaaaatattttagtgtattataatttggggaaagtagagaatgagttatatttcagacgtatcttga

SEQ ID NO: 13580 - DNA, 201 bp, Homo sapiens
acagatgattttcccaaagatatctagggttacttgaaatgtaagtttgctaactgtaactcccacctttcttctactcaaggatgcaagtgaatgaagtattattatatgaataagcttaaatctactttgattcctttttgaaaaaataaaacatttatcaactttgatttttaaaatctattactaggaacaaattgt

SEQ ID NO: 13581 - DNA, 201 bp, Homo sapiens; identical to SEQ ID NO: 1739

SEQ ID NO: 13582 - DNA, 201 bp, Homo sapiens
cagatgattttcccaaagatatctagggttacttgaaatgtaagtttgctaactgtaactcccacctttcttctactcaaggatgcaagtgaatgaagtattattatatgaataagcttaaatctactttgattcctttttgaaaaaataaaacatttatcaactttgatttttaaaatctattactaggaacaaattgtt

SEQ ID NO: 13583 - DNA, 201 bp, Homo sapiens; identical to SEQ ID NO: 1740

SEQ ID NO: 13584 - DNA, 201 bp, Homo sapiens
acacttggacgcagggtggggaacatcacacaccggggcctgttgtggggtggggggaggggggcgggatagcattaggagatatacctaatgtaaatgaygagttaatgggtacagcacaccaacatggcacatgtgtgcatgtgtaacaaacctgcatgttgtgcacatgtaccctagaacttaaagtataattttaaa

SEQ ID NO: 13585 - DNA, 201 bp, Homo sapiens; identical to SEQ ID NO: 1748

SEQ ID NO: 13586 - DNA, 201 bp, Homo sapiens; identical to SEQ ID NO: 1749

SEQ ID NO: 13587 - DNA, 201 bp, Homo sapiens
ttttcccttatcccccttatgtattcacttccctatttaactctgctttgtcattgtcagatcatcattatcactctcaaagagcgagaggtcctctctcttttttttttttttttttgacagagtctcgctctgttgcccaggctagagtgtagtggcgcgatctttgctcctgggttcaagcaattctcctgcctcagc

SEQ ID NO: 13588 - DNA, 201 bp, Homo sapiens; identical to SEQ ID NO: 1751

SEQ ID NO: 13589 - DNA, 201 bp, Homo sapiens
gtgcctagtaaatgtacattgttcgtagttgtagcatctaatttagttctttgcatgttgagacaagaaatatctaaatgtaactttcatgaagaaagatktaagataaaatttaggaactctaaaagtttttacaagctaaaattccttatcagtgaaagttatataatctttctgtatgcaaaaaaataatttttttat

SEQ ID NO: 13590 - DNA, 201 bp, Homo sapiens
tgtgatcatacaaggaatgagataatacactcagaatacactaatgacagaaagtctgtgtaaagaaattgaggatttgcttgtttaggtattttatctcytaaagcacagttctttcaaatagctttgaagagacgtcttcccagaactttgtatgcatctggatctcacttctgatcttactttcatgggttatgtgtg

SEQ ID NO: 13591 - DNA, 201 bp, Homo sapiens
ttctttaatattttcttatgtgaaatattcatgcaagaagactcattcattagcaggagaaaattatgtctctaatttttgcctcattaagaagtttcacmttatataacaaagtttactgaaaagtcaccattttctttttgacttagtcatctcatttttgatagattgcaaaggtcgactgcaaggaagtactagaca

SEQ ID NO: 13592 - DNA, 201 bp, Homo sapiens
ggccctctggctggagctttaatttgtatctttggttatctgtctatcccagggcagtgcaggacaggcgggayrgcccggaagtccaggccaccagggcstagcggtaagtgtcaggtggagccacaggggctggccaggggctagtggctgatgaggttagaatccacacacacccggggctcttgctcaatcaccacc

SEQ ID NO: 13593 - DNA, 201 bp, Homo sapiens
gttccaggctctgtttaggcttcgttgggtttccctgaggccaagggcctgactgggccacccagactgacctgagaactgttttcctgcagggtgagccrggcccgcagggccttcctggattctctggtccccctgggaaagaggtaaatgccccctgcactgacacaagggttcctgctttagggtgaggccatgggg

SEQ ID NO: 13594 - DNA, 201 bp, Homo sapiens
tgcctcagtgcagataggatggcatggcttaaaatccagaggagaaacaaacaggaaaatcaggagccaagaggattgaaccaagaataccctctcccccktcccagctcatctggttccaggctctgtttaggcttcgttgggtttccctgaggccaagggcctgactgggccacccagactgacctgagaactgttttc

SEQ ID NO: 13595 - DNA, 201 bp, Homo sapiens
gaagtgggccttgcaattgccattgctgtcatttttctttctcaacagggtccccagggcatcaggggctacccaggcatggcagggcccaagggagagayggtaagtgaatcttggggtgttctacaagagcttccaggagctgccttctggcccctggagttcagccaggactgacctgcaaccctttcctctccccag

SEQ ID NO: 13596 - DNA, 201 bp, Homo sapiens
aattatctcaaaaatgtcttttcctggttcttgttcaaatcaagactcacacagcatccacacactgcattcggttgttgtgttcctttggctgagtggaktgtggggccttggccaaggtctcagtggattctggctcccacccctgctctggctcagcccagcctggcctcctggcactgacttctcctccctcctgct

SEQ ID NO: 13597 - DNA, 201 bp, Homo sapiens
gtgtgtgtgagtgagtgtgtgtgtgtctgcccaagtgggtgacctgctggggaggaccatctgtgccaagagcccagtcagcccaaattcagactttaggmgaagccctgggatccagtcccatggtcactggggccagacaatgagattccagcaaatcagccatggggctaatgggatttggtctcgatcccagttctc

SEQ ID NO: 13598 - DNA, 201 bp, Homo sapiens
ggatcccaggtaagccattggccctgcccagctgcagtgtgttcctcagcttgggaattaatgacgtgtggacactgcggtctcctccatggcggcctcaygctcagccagctcagtccttgatacccagcttctgcacccctttggagcaccccggagtctctgggtggttccagctctggaagctgggcctctcaggac

SEQ ID NO: 13599 - DNA, 201 bp, Homo sapiens
ctgggcccggtcgggtgctgggtgtggtttcgagctcgcctgcggggcgccagcctggcacttcgcggcctggggaggtcgtgggcaccgggacccctgcmtgggtccgagctggcctcttaaaagggccgccttttaagatctctgatctgttcagagatgggcagcaggatggagactctccagctgtgagctcgcctc

SEQ ID NO: 13600 - DNA, 201 bp, Homo sapiens
caaaaaaaaaaaaaaagtaaaagtggagaaacgggctttgggtgcctgtctctacctttgtgcccagggtatctgaccctctgaggcatcctgaccatcamctctctgctccccaggggcctcctggacctgttggcctccctggtgagattggaatccgaggccccaaggtgagcctcagccaccctctgttcactgcct

SEQ ID NO: 13601 - DNA, 201 bp, Homo sapiens
gctgggtgtggtttcgagctcgcctgcggggcgccagcctggcacttcgcggcctggggaggtcgtgggcaccgggacccctgcctgggtccgagctggcytcttaaaagggccgccttttaagatctctgatctgttcagagatgggcagcaggatggagactctccagctgtgagctcgcctcatcttgatatgacttg

SEQ ID NO: 13602 - DNA, 201 bp, Homo sapiens
atccagggcggactcctggcgccgccgcccactctcagtgaccatggacccttcacgttctgagccagtttcttcgactgcaaactggggcccgtaatagsgcccgcctcccggttctgagtattctgtaagataatgaatgcatgtaatggcacacagtgcctgctatacagaagattctcaatacgtgggagttcgcgg

SEQ ID NO: 13603 - DNA, 201 bp, Homo sapiens
cagcctgcctcagtgcagataggatggcatggcttaaaatccagaggagaaacaaacaggaaaatcaggagccaagaggattgaaccaagaataccctctyccccgtcccagctcatctggttccaggctctgtttaggcttcgttgggtttccctgaggccaagggcctgactgggccacccagactgacctgagaactg

SEQ ID NO: 13604 - DNA, 201 bp, Homo sapiens
ttcattgcataaacattcactaaacacttgcaactatgagtctcctcttcatatggagggtatagtttaatggaagaaatagacatgaaataaatgatcaygccgggcgcggtggctcacgcctgtaatcccagcattttgggaggctgaggcgggtggatcacgaggtcaggagatccagaccgcggtgaaaccccgtct

SEQ ID NO: 13605 - DNA, 201 bp, Homo sapiens
cccaggcacgcctggcatgaaggtaggagtggggctgctgatgggactggggcaggggcaggaccttgagtcctggattctagacaccaagagcctggggycctcaggtcatggacatgccctttcttgcctctggatctcagtttccctacctgcatctgggtagaagccatggccctctggctggagctttaatttgta

SEQ ID NO: 13606 - DNA, 201 bp, Homo sapiens; identical to SEQ ID NO: 1760

SEQ ID NO: 13607 - DNA, 201 bp, Homo sapiens
aggcgtcaaaggagacaaggtgccagatggggctgggaaacacctgggaaaggggccctataacagggggagtggggtcggcaggactcagatccttccgragcctccaaacctgcggatctcagggttctggtctggtcggcgaggcggagttggaaagaggggtgtggccgaaagttaggtgggggaccccgtggaggg

SEQ ID NO: 13608 - DNA, 201 bp, Homo sapiens
ggggggagctcgccaaacccctcactgcccgctttctccagggctccccagggaagaccgggccccgcggcaaagtggtgagttccagcacccctgttccyagcgacccccaaccctgctctgcgtccccgccgccaccgcgcgtctgacccgtggttctctctgcagggtgacccaggggtggccggcctccccggagag

SEQ ID NO: 13609 - DNA, 201 bp, Homo sapiens
cgtggaggggggagctcgccaaacccctcactgcccgctttctccagggctccccagggaagaccgggccccgcggcaaagtggtgagttccagcacccckgttcccagcgacccccaaccctgctctgcgtccccgccgccaccgcgcgtctgacccgtggttctctctgcagggtgacccaggggtggccggcctcccc

SEQ ID NO: 13610 - DNA, 201 bp, Homo sapiens
ggggcagaaacccctcctatgagcccacccggcactaggtcttttagggacgccgctggccccatcccctgtcaatcaggccttcatctcccaagatggtrgatctcacaaagtgaccgggaagacagggtggagagggcagaggcaggacctggaggagggcactagggtaagctggtaagggctggtcaggggtatgat

SEQ ID NO: 13611 - DNA, 201 bp, Homo sapiens
ttctggtctggtcggcgaggcggagttggaaagaggggtgtggccgaaagttaggtgggggaccccgtggaggggggagctcgccaaacccctcactgccygctttctccagggctccccagggaagaccgggccccgcggcaaagtggtgagttccagcacccctgttcccagcgacccccaaccctgctctgcgtcccc

SEQ ID NO: 13612 - DNA, 201 bp, Homo sapiens
ctggtccttaaagcctcagtctgtcagtctctctggggttggcaaaaaaaaaaaaaaagtaaaagtggagaaacgggctttgggtgcctgtctctaccttygtgcccagggtatctgaccctctgaggcatcctgaccatcaactctctgctccccaggggcctcctggacctgttggcctccctggtgagattggaatcc

SEQ ID NO: 13613 - DNA, 201 bp, Homo sapiens
tgcagggtgagggttaaatacctcattctgaaagctcccgcaggagggccgcttgatgtttaccagtctggacagacttctattcaacctggtgcccccamcccccaaacacaggatgctgggcccccggccaggccctggctgctgagggctctgaaatgcctggaggcctctctggggctgaatcgcactctaccggcc

SEQ ID NO: 13614 - DNA, 201 bp, Homo sapiens
cagcttgggccagactcctgtctcttcccttcggttttctctccccgatttagaatcagctgggcttgttccctgcagggtgagggttaaatacctcattytgaaagctcccgcaggagggccgcttgatgtttaccagtctggacagacttctattcaacctggtgcccccaccccccaaacacaggatgctgggccccc

SEQ ID NO: 13615 - DNA, 201 bp, Homo sapiens
agggcccccatgggcaccctggccctcggggcgttcctggcatcgtgggagccgtgggtcagatcggcaacacggggcccaagggtgagtgctcctctgcrgtgggcatgggggccaggcagtgaggatttgtccaggccggccctttccccattcccttctcaggatgacatacagacccttccccggttcctcagccac

SEQ ID NO: 13616 - DNA, 201 bp, Homo sapiens
ctggacgcttcttcaggttcgcttgggagccttggccagaccaccgaccagcttgggccagactcctgtctcttcccttcggttttctctccccgatttaraatcagctgggcttgttccctgcagggtgagggttaaatacctcattctgaaagctcccgcaggagggccgcttgatgtttaccagtctggacagacttc

SEQ ID NO: 13617 - DNA, 201 bp, Homo sapiens
aaaaaaaagtaaaagtggagaaacgggctttgggtgcctgtctctacctttgtgcccagggtatctgaccctctgaggcatcctgaccatcaactctctgytccccaggggcctcctggacctgttggcctccctggtgagattggaatccgaggccccaaggtgagcctcagccaccctctgttcactgcctcctgcctt

SEQ ID NO: 13618 - DNA, 201 bp, Homo sapiens
cgccggccgcagctcacagcgaggcctcatccccctcctctcctttcccctccttgtggggtaggaggcgactcaacccctcaccctgcctctggcacatytggacgcttcttcaggttcgcttgggagccttggccagaccaccgaccagcttgggccagactcctgtctcttcccttcggttttctctccccgatttag

SEQ ID NO: 13619 - DNA, 201 bp, Homo sapiens
tgcaattctctggtccttaaagcctcagtctgtcagtctctctggggttggcaaaaaaaaaaaaaaagtaaaagtggagaaacgggctttgggtgcctgtytctacctttgtgcccagggtatctgaccctctgaggcatcctgaccatcaactctctgctccccaggggcctcctggacctgttggcctccctggtgaga

SEQ ID NO: 13620 - DNA, 201 bp, Homo sapiens
tgttcagtccgccggccgcagctcacagcgaggcctcatccccctcctctcctttcccctccttgtggggtaggaggcgactcaacccctcaccctgcctytggcacatctggacgcttcttcaggttcgcttgggagccttggccagaccaccgaccagcttgggccagactcctgtctcttcccttcggttttctctcc

SEQ ID NO: 13621 - DNA, 201 bp, Homo sapiens
caaaccagccctgacatgcggagcccgttatagccgccgacagacaaggagctgctgttcagtccgccggccgcagctcacagcgaggcctcatccccctyctctcctttcccctccttgtggggtaggaggcgactcaacccctcaccctgcctctggcacatctggacgcttcttcaggttcgcttgggagccttggcc

SEQ ID NO: 13622 - DNA, 201 bp, Homo sapiens
agcgctgtggtgggggtggggacttcggggtgcccggagatgtagtgcccctcgtcgccaataggcggcgccggcccgcaccacaaggacgccgtttgttytgcaaaaacctcaaaccagccctgacatgcggagcccgttatagccgccgacagacaaggagctgctgttcagtccgccggccgcagctcacagcgaggc

SEQ ID NO: 13623 - DNA, 201 bp, Homo sapiens
aagattctcaatacgtgggagttcgcggaagagctgcgcccctaggaccccgctcccagggtcgcttgcagccccggggacgcccagcttcctgcactgtytgaggactgccccaccccgtgtgtgtttttcagagaggtccaccgggagagcggggccccccgggtcccccgggaccgccgggagtgcctggatccgacg

SEQ ID NO: 13624 - DNA, 201 bp, Homo sapiens
atatccatctcttccacgtagaccccaggtcctggaagacaggccattctctgtgccccactcctctgccaccactgtgggaatgtacagttaagttcatsatgccgtggctggaccttctgttgttcagctcccacaggtgggggaaatctggattggggatgggaagcaaagcagcaggtgcatggggctccctcatgc

SEQ ID NO: 13625 - DNA, 201 bp, Homo sapiens
acgcctggcatgaaggtaggagtggggctgctgatgggactggggcaggggcaggaccttgagtcctggattctagacaccaagagcctggggtcctcagrtcatggacatgccctttcttgcctctggatctcagtttccctacctgcatctgggtagaagccatggccctctggctggagctttaatttgtatctttgg

SEQ ID NO: 13626 - DNA, 201 bp, Homo sapiens
aagggacatttatcttccctattttttgctctagtccctaggagggtgtggccagactctgtaaattgttccttgggagaagggatgaggctggggagggmatggtgtctatgctccctcctggtctgggacctggcctcttaggtcctcattttcaggcttgatcctgcagaaaaaattaccatggtaggtggagcaaaa

SEQ ID NO: 13627 - DNA, 201 bp, Homo sapiens
gcttcactgcagacctccaggagacagatttgcttgttgggacagagtagggaggtgaaagcgaggtgaggaagttcgggggtgggggaggtgcacacagytccactaaagagctggaagaggccgatggagtattcatgagacggctgatccaggaaggactgtggcatattaatatggaaaaggcctgtttgtttgtgc

SEQ ID NO: 13628 - DNA, 201 bp, Homo sapiens
ttgtgcttggagaggaaggagccagaggagaggggagcaaggtgggcgggagctggggagagcctgcagcaagatctgcagagcccgaggtgctctcggcmtgggccctggagaggacgtagggtaagtgatggggcacaggctgtgcgtcagggggaaggtgctggggcctgaaggtcccgaggggaacctcagacggcc

SEQ ID NO: 13629 - DNA, 201 bp, Homo sapiens
agggacccaagggcgagcctggcaaagctgggccagatgggccagacgggaagcccgggattgatgtgagtagctgagtgtcgggtggggcagggtagggmtctgccaattgacctccagggcctggctctggcatcttcactgatctgttcagagatgggcagcaggatggagattctccagctgtgagcccccctcacc

SEQ ID NO: 13630 - DNA, 201 bp, Homo sapiens
gggacctcgtattgagctctctccttcccttcaggggcatgcgggcaaacgcgggattctgggtgatcctggccaccaggggaagccggtgagtgcaaggkctgagggctgtgggtcagggatacgtggagatggtcctacagggctctgtccccttcttcgtcccttccccttcccctgtgggttctggggacagagcct

SEQ ID NO: 13631 - DNA, 201 bp, Homo sapiens
gtctctggtcatgtctccttgcttggcttttctctatctgtaacacaggactgtagggttcgtagtagtccctcccgtctgcttgtgctggggaaaagagrtggtatctttgcttgtctgtatatgtgtctttccatctgcctgcctgtctgacagctcatccctgccctttagggtcccaagggagatgtgggtgcctct

SEQ ID NO: 13632 - DNA, 201 bp, Homo sapiens
accccaggtcctggaagacaggccattctctgtgccccactcctctgccaccactgtgggaatgtacagttaagttcatcatgccgtggctggaccttctsttgttcagctcccacaggtgggggaaatctggattggggatgggaagcaaagcagcaggtgcatggggctccctcatgccagggcagaaactgacttcaa

SEQ ID NO: 13633 - DNA, 201 bp, Homo sapiens
gagcccttcatggagtcattcccctgctcaggcctctagcttgtaaaagagacacctgtgtctagctgggagcatctctggatggggagatggaggctgarattgtcaggaatgagggacaggaaccaaagctgtcagcaagaagcccaggctgaggtccaggtctgccactgtccctttgagtaatgcagtgagtccctc

SEQ ID NO: 13634 - DNA, 201 bp, Homo sapiens
gacatctcagccccccctaccccaatccagggacacaggagggacacagtggggttagactgagggccactgatgtggcttcaccctcagtgcttgggcarttcccaagttacagcatctcagtccccagagaaggccatgctgccactgtagccgccaagggccccctggagtgcagggcacagaggaggaagggagagg

SEQ ID NO: 13635 - DNA, 201 bp, Homo sapiens
tgcaattgccattgctgtcatttttctttctcaacagggtccccagggcatcaggggctacccaggcatggcagggcccaagggagagacggtaagtgaaycttggggtgttctacaagagcttccaggagctgccttctggcccctggagttcagccaggactgacctgcaaccctttcctctccccagggccctcatgg

SEQ ID NO: 13636 - DNA, 201 bp, Homo sapiens
tggcgccgccgcccactctcagtgaccatggacccttcacgttctgagccagtttcttcgactgcaaactggggcccgtaatagcgcccgcctcccggttytgagtattctgtaagataatgaatgcatgtaatggcacacagtgcctgctatacagaagattctcaatacgtgggagttcgcggaagagctgcgccccta

SEQ ID NO: 13637 - DNA, 201 bp, Homo sapiens
aggactcagatccttccggagcctccaaacctgcggatctcagggttctggtctggtcggcgaggcggagttggaaagaggggtgtggccgaaagttaggwgggggaccccgtggaggggggagctcgccaaacccctcactgcccgctttctccagggctccccagggaagaccgggccccgcggcaaagtggtgagttc

SEQ ID NO: 13638 - DNA, 201 bp, Homo sapiens
ccgcgcaagggcaaactggcacagtggaaggagtcgggcagatccagggcggactcctggcgccgccgcccactctcagtgaccatggacccttcacgttytgagccagtttcttcgactgcaaactggggcccgtaatagcgcccgcctcccggttctgagtattctgtaagataatgaatgcatgtaatggcacacagt

SEQ ID NO: 13639 - DNA, 201 bp, Homo sapiens
gatgtggcgctgaagatgctgcaaggtgaggggcagcaacccctcctcacagtcagttcgagggcatcgccgccccctcaccccctcccggagcctccacrtgttcacttgtctgaaaatctggagtcctgggggctccttccagtccagtctctgaagggttttgggaccttgaataagtcactctgggcctttgacttc

SEQ ID NO: 13640 - DNA, 201 bp, Homo sapiens
gtccccgccgccaccgcgcgtctgacccgtggttctctctgcagggtgacccaggggtggccggcctccccggagagaaaggcgagaaggtgagcgcgcgrcctagggaagggcggggagcggcggctggccccggggtccccgcggcttcgtgaccgctgctccttgtgcctgcagggcgagtccggcgagccggggccc

SEQ ID NO: 13641 - DNA, 201 bp, Homo sapiens
gtgctgccgaaggggcgctccgagtgggaagatagtacccgcttcacctccctacacctcctttctctgcgcctcccccactttcccgtcgggttttcccscaccatggggagaggaggaggcgctgtctctgcctgtcgttcacgtaagaacaacaacccgagccaccgctcactgagggccggcagcctgctaggcaca

SEQ ID NO: 13642 - DNA, 201 bp, Homo sapiens
tacagaagattctcaatacgtgggagttcgcggaagagctgcgcccctaggaccccgctcccagggtcgcttgcagccccggggacgcccagcttcctgcrctgtctgaggactgccccaccccgtgtgtgtttttcagagaggtccaccgggagagcggggccccccgggtcccccgggaccgccgggagtgcctggatc

SEQ ID NO: 13643 - DNA, 201 bp, Homo sapiens
ttggcaaaaaaaaaaaaaaagtaaaagtggagaaacgggctttgggtgcctgtctctacctttgtgcccagggtatctgaccctctgaggcatcctgaccrtcaactctctgctccccaggggcctcctggacctgttggcctccctggtgagattggaatccgaggccccaaggtgagcctcagccaccctctgttcact

SEQ ID NO: 13644 - DNA, 201 bp, Homo sapiens
ggcacaggctgtgcgtcagggggaaggtgctggggcctgaaggtcccgaggggaacctcagacggccttatgccttctcacaaagaaactggaccatcatytccgacccgcaccccggtcgcccctcgaggacagagggtgggcgcaggaggctggaccgagcggggcggagctggatgcctggcgccggcctccctcccg

SEQ ID NO: 13645 - DNA, 201 bp, Homo sapiens
gaccatcatctccgacccgcaccccggtcgcccctcgaggacagagggtgggcgcaggaggctggaccgagcggggcggagctggatgcctggcgccggcmtccctcccggcaaccccgccggtcctctcaggtgacagctcacgccggcccccgccccgccccccgcatattcaggagccccagcccaccctgcccgcga

SEQ ID NO: 13646 - DNA, 201 bp, Homo sapiens
gcccggcccgggacaggcagcgtggggcaggagctggcgcccggtcctggcagcccggggagcccaggtggcggggcatacaatggtgctcattcacccgmtgcgcagcctccgcccccgccgcctcccagggggcgccggctccaaccagacgccgctgtcgccccgaggcggcctctcggccctgcccgcctacccacg

SEQ ID NO: 13647 - DNA, 201 bp, Homo sapiens
gcaccccggtcgcccctcgaggacagagggtgggcgcaggaggctggaccgagcggggcggagctggatgcctggcgccggcctccctcccggcaaccccsccggtcctctcaggtgacagctcacgccggcccccgccccgccccccgcatattcaggagccccagcccaccctgcccgcgaacagccagcgctggagga

SEQ ID NO: 13648 - DNA, 201 bp, Homo sapiens
tgcagtgagtccctcctcatctctgaacctccatgtcccatccatgagacagagactctgctgcctacctcaaaagggcactgtaagattgaaggtgggcwtcagacaaggtatcatgaagtgggccttgcaattgccattgctgtcatttttctttctcaacagggtccccagggcatcaggggctacccaggcatggca

SEQ ID NO: 13649 - DNA, 201 bp, Homo sapiens
ccctacctgcatctgggtagaagccatggccctctggctggagctttaatttgtatctttggttatctgtctatcccagggcagtgcaggacaggcgggayagcccggaagtccaggccaccagggcctagcggtaagtgtcaggtggagccacaggggctggccaggggctagtggctgatgaggttagaatccacacac

SEQ ID NO: 13650 - DNA, 201 bp, Homo sapiens
gggcagggcgtcatatccaggcccctcattccatttattcctttggtttcttttctcctcagggccctaagggggagcagggcccccccggaattccaggrccccaaggcttgccaggcgtcaaaggagacaaggtgccagatggggctgggaaacacctgggaaaggggccctataacagggggagtggggtcggcagga

SEQ ID NO: 13651 - DNA, 201 bp, Homo sapiens
ctcacatgggctcaggcacctgagagcacatatccatctcttccacgtagaccccaggtcctggaagacaggccattctctgtgccccactcctctgccaycactgtgggaatgtacagttaagttcatcatgccgtggctggaccttctgttgttcagctcccacaggtgggggaaatctggattggggatgggaagcaa

SEQ ID NO: 13652 - DNA, 201 bp, Homo sapiens
cccacccatcatgcactcctcagcctgcctcagtgcagataggatggcatggcttaaaatccagaggagaaacaaacaggaaaatcaggagccaagaggaytgaaccaagaataccctctcccccgtcccagctcatctggttccaggctctgtttaggcttcgttgggtttccctgaggccaagggcctgactgggccac

SEQ ID NO: 13653 - DNA, 201 bp, Homo sapiens
gtttgctttgctggtctgccaagtggagaaaggaccccctgccagtgacagcaggaatggagggcaccctgaccatgcggtgccaggcctcggtgcgggakgctacccctgctgagagctgctgaggttgtgaccttctctttccatttcagggtgaccaaggcgagaggggtccagtggggcaaccaggccctcagggaa

SEQ ID NO: 13654 - DNA, 201 bp, Homo sapiens
aggtcaaacgcttagccccaatttctccttcctccagggagagccagggcctcgaggagaaattggtccccagggcatcatgggacagaaggtaagtgccwggcacaatggcccctccccgggggcctctgcggcagctggcactgctggatacagcatctgctccgtgcagcccgtgagatgcctccccaggcagggcct

SEQ ID NO: 13655 - DNA, 201 bp, Homo sapiens
ccgccgccaccgcgcgtctgacccgtggttctctctgcagggtgacccaggggtggccggcctccccggagagaaaggcgagaaggtgagcgcgcggcctrgggaagggcggggagcggcggctggccccggggtccccgcggcttcgtgaccgctgctccttgtgcctgcagggcgagtccggcgagccggggcccaagg

SEQ ID NO: 13656 - DNA, 201 bp, Homo sapiens
ggcggcgccggcccgcaccacaaggacgccgtttgttctgcaaaaacctcaaaccagccctgacatgcggagcccgttatagccgccgacagacaaggagytgctgttcagtccgccggccgcagctcacagcgaggcctcatccccctcctctcctttcccctccttgtggggtaggaggcgactcaacccctcaccctg

SEQ ID NO: 13657 - DNA, 201 bp, Homo sapiens
aggcaggctggagccacacacgggtgtgaatccagactcccctttctcatcgtggctctcagacgagttacctgctaatttccctgggccttaggtttacyatctgtaaaatggggacactgaaagtaccaacctcatcatgtggcagtgaggactatccttagagtagtttacatagagtttgtcttagttcactgagac

SEQ ID NO: 13658 - DNA, 201 bp, Homo sapiens; identical to SEQ ID NO: 1767

SEQ ID NO: 13659 - DNA, 201 bp, Homo sapiens; identical to SEQ ID NO: 1768

SEQ ID NO: 13660 - DNA, 201 bp, Homo sapiens
ggtgatcctggccaccaggggaagccggtgagtgcaagggctgagggctgtgggtcagggatacgtggagatggtcctacagggctctgtccccttcttcrtcccttccccttcccctgtgggttctggggacagagccttgagccgggggctggaggcctgtgctccaggtcggcatgtctctggtcatgtctccttgct

SEQ ID NO: 13661 - DNA, 201 bp, Homo sapiens
gcctctggagagcaaggcatccctggaccaccggtaaggaacaccttgcctcagtggccctcttctccctcaccccaggagcccttcatggagtcattccyctgctcaggcctctagcttgtaaaagagacacctgtgtctagctgggagcatctctggatggggagatggaggctgaaattgtcaggaatgagggacagg

SEQ ID NO: 13662 - DNA, 201 bp, Homo sapiens
aacctgagaccagggcgggagggaggcggcagacaaaggagaactttgtgagcgctgtggtgggggtggggacttcggggtgcccggagatgtagtgcccstcgtcgccaataggcggcgccggcccgcaccacaaggacgccgtttgttctgcaaaaacctcaaaccagccctgacatgcggagcccgttatagccgccg

SEQ ID NO: 13663 - DNA, 201 bp, Homo sapiens
cacgaggtcaggagatccagaccgcggtgaaaccccgtctctactaaaaatacaaaaaattagcctggggcggtggcaggcacctgtagtcccagctactytggaggctgaggcaggagaatggcatgaacccgggaggcggagcttgcagtgagcggagatcgcgccactgcattccagcctgggtgacagagcaagact

SEQ ID NO: 13664 - DNA, 201 bp, Homo sapiens
acgccgggcgcggtggctcacgcctgtaatcccagcattttgggaggctgaggcgggtggatcacgaggtcaggagatccagaccgcggtgaaaccccgtytctactaaaaatacaaaaaattagcctggggcggtggcaggcacctgtagtcccagctactctggaggctgaggcaggagaatggcatgaacccgggagg

SEQ ID NO: 13665 - DNA, 201 bp, Homo sapiens
ttgagcccaggaggcggaggttgcactgagccaagattacaccactgcactccagcctgggtaacagagcaagactccatctcaaaaaaaaaaaaaaaaaatagttattgagtatctgaggtatactaagtggcaggtaaacaattataaataggacagatgcaatctttgtcttcatggctcatcttaccattcaatgac

SEQ ID NO: 13666 - DNA, 201 bp, Homo sapiens
ggactgacctgcaaccctttcctctccccagggccctcatggatataaaggcatggtgggcgctatcggtgccactgggccaccggtaagcctctttttgytcccctacccctgaggctggagctcctacagctacagccacagagtgggcatggctccccctgagcctgtgtgacctggattcctgcttgtctttcttgc

SEQ ID NO: 13667 - DNA, 201 bp, Homo sapiens
agggccagcccactctgggcctgtccactggctctgcaattctctggtccttaaagcctcagtctgtcagtctctctggggttggcaaaaaaaaaaaaaaagtaaaagtggagaaacgggctttgggtgcctgtctctacctttgtgcccagggtatctgaccctctgaggcatcctgaccatcaactctctgctccccag

SEQ ID NO: 13668 - DNA, 201 bp, Homo sapiens
atgacttgtgaccttcctggaacctcactctcacccagggtcattgatttgcaggcaaccggggtccagagagagggtctgctttctgggaggtgcaggttcctcctgctacccctcagcagtcaggacttagtctcacatttctggcctccaaggatcaggctgaatatgttgggtggggctgtccttgtgtgccctgtc

SEQ ID NO: 13669 - DNA, 201 bp, Homo sapiens
cctacctgcatctgggtagaagccatggccctctggctggagctttaatttgtatctttggttatctgtctatcccagggcagtgcaggacaggcgggacrgcccggaagtccaggccaccagggcctagcggtaagtgtcaggtggagccacaggggctggccaggggctagtggctgatgaggttagaatccacacaca

SEQ ID NO: 13670 - DNA, 201 bp, Homo sapiens
gggacaggcagcgtggggcaggagctggcgcccggtcctggcagcccggggagcccaggtggcggggcatacaatggtgctcattcacccgctgcgcagcmtccgcccccgccgcctcccagggggcgccggctccaaccagacgccgctgtcgccccgaggcggcctctcggccctgcccgcctacccacgtctcccttc

SEQ ID NO: 13671 - DNA, 201 bp, Homo sapiens
tccgacggcatcgacgtaagtctctaacctgagaccagggcgggagggaggcggcagacaaaggagaactttgtgagcgctgtggtgggggtggggacttsggggtgcccggagatgtagtgcccctcgtcgccaataggcggcgccggcccgcaccacaaggacgccgtttgttctgcaaaaacctcaaaccagccctga

SEQ ID NO: 13672 - DNA, 201 bp, Homo sapiens
gggcaggagctggcgcccggtcctggcagcccggggagcccaggtggcggggcatacaatggtgctcattcacccgctgcgcagcctccgcccccgccgcytcccagggggcgccggctccaaccagacgccgctgtcgccccgaggcggcctctcggccctgcccgcctacccacgtctcccttccgagggccgccgggg

SEQ ID NO: 13673 - DNA, 201 bp, Homo sapiens
cacccacccaggggcattgaattgcaggcaaacgggatccagagagagggtctgctttctgggaggtgccggctcctcctgctcccctgcagcagtcaggrcttagcagagggaggaccgggcagctgtgctgccgaaggggcgctccgagtgggaagatagtacccgcttcacctccctacacctcctttctctgcgcct

SEQ ID NO: 13674 - DNA, 201 bp, Homo sapiens
gcatacaatggtgctcattcacccgctgcgcagcctccgcccccgccgcctcccagggggcgccggctccaaccagacgccgctgtcgccccgaggcggcytctcggccctgcccgcctacccacgtctcccttccgagggccgccgggggctgcgggcgcgcgggtagggcagagactgggcccggtcgggtgctgggtg

SEQ ID NO: 13675 - DNA, 201 bp, Homo sapiens
ccccagggaagaccgggccccgcggcaaagtggtgagttccagcacccctgttcccagcgacccccaaccctgctctgcgtccccgccgccaccgcgcgtytgacccgtggttctctctgcagggtgacccaggggtggccggcctccccggagagaaaggcgagaaggtgagcgcgcggcctagggaagggcggggagcg

SEQ ID NO: 13676 - DNA, 201 bp, Homo sapiens
tcctctattacaaactagcacaaaacaggaataatttctttgcgtgaaacatagcaaaaaatagaggaaaagcattttccaattctgaaaaatgaagattyccttttttgtctacaggaaaacgtggagagaagggtgatccaggagaagtgggacgggggcaccccgggatgcctgggcccccagggatcccaggtaagc

SEQ ID NO: 13677 - DNA, 201 bp, Homo sapiens
agccctgggtgcggtgggcatgatgggtcctccaggacctcctgggccccctgggtacccaggcaagcagggcccccatgggcaccctggccctcggggcrttcctggcatcgtgggagccgtgggtcagatcggcaacacggggcccaagggtgagtgctcctctgcggtgggcatgggggccaggcagtgaggatttgt

SEQ ID NO: 13678 - DNA, 201 bp, Homo sapiens
ggacgggggcaccccgggatgcctgggcccccagggatcccaggtaagccattggccctgcccagctgcagtgtgttcctcagcttgggaattaatgacgygtggacactgcggtctcctccatggcggcctcacgctcagccagctcagtccttgatacccagcttctgcacccctttggagcaccccggagtctctggg

SEQ ID NO: 13679 - DNA, 201 bp, Homo sapiens
aggttgcactgagccaagattacaccactgcactccagcctgggtaacagagcaagactccatctcaaaaaaaaaaaaaaaaaatagttattgagtatctraggtatactaagtggcaggtaaacaattataaataggacagatgcaatctttgtcttcatggctcatcttaccattcaatgaccaccataatctgacccc

SEQ ID NO: 13680 - DNA, 201 bp, Homo sapiens
ctgggcaggacaaggcaccccctaaggctgtgtgtgtgagagtgcatgagtgtgtgcgtgagtgtgaatgtgtagtgtgtgtgagtgtgtagtgtgtgtgwgtgtagactgtgtgtatatgagtgtatgtgtacagtgtgtatgtgtgaggctgtctgtgagtgtgtgtagtatgtgtatgtgagtgtgtgaggatatctc

SEQ ID NO: 13681 - DNA, 201 bp, Homo sapiens
ggaaggtcctaggggaccgccaggccgagctggggagaagggtgacgaggtgagtcctcaggcacccattgttcagtcaggacccctggggagtactgggsaggacaaggcaccccctaaggctgtgtgtgtgagagtgcatgagtgtgtgcgtgagtgtgaatgtgtagtgtgtgtgagtgtgtagtgtgtgtgtgtgta

SEQ ID NO: 13682 - DNA, 201 bp, Homo sapiens
cctacccacgtctcccttccgagggccgccgggggctgcgggcgcgcgggtagggcagagactgggcccggtcgggtgctgggtgtggtttcgagctcgcmtgcggggcgccagcctggcacttcgcggcctggggaggtcgtgggcaccgggacccctgcctgggtccgagctggcctcttaaaagggccgccttttaag

SEQ ID NO: 13683 - DNA, 201 bp, Homo sapiens
ctgcaaccctttcctctccccagggccctcatggatataaaggcatggtgggcgctatcggtgccactgggccaccggtaagcctctttttgctcccctayccctgaggctggagctcctacagctacagccacagagtgggcatggctccccctgagcctgtgtgacctggattcctgcttgtctttcttgccagggtga

SEQ ID NO: 13684 - DNA, 201 bp, Homo sapiens
tacattttcattcttccccagggtttaactggagccaagggggagcctggccccatggggatccctggagtcaaggtaaggggcctgctggggcctcagcrtgggcaatctagggccagcgtttgggagtggctgtagagaggaagtaggagccggggaaaccccagcctctgagcctttctcgttgcttctgcagggcca

SEQ ID NO: 13685 - DNA, 201 bp, Homo sapiens
tgaagcaaattagctgagacccagggtagggaggggctggccaggtgtggaagggtgggttccaccaggtcaaacgcttagccccaatttctccttcctcyagggagagccagggcctcgaggagaaattggtccccagggcatcatgggacagaaggtaagtgcctggcacaatggcccctccccgggggcctctgcggc

SEQ ID NO: 13686 - DNA, 201 bp, Homo sapiens
accaaggcgagaggggtccagtggggcaaccaggccctcagggaaggcaggtgagtgcaggccagctaaggtgggcagggcgtcatatccaggcccctcaytccatttattcctttggtttcttttctcctcagggccctaagggggagcagggcccccccggaattccagggccccaaggcttgccaggcgtcaaaggag

SEQ ID NO: 13687 - DNA, 201 bp, Homo sapiens
caaagattgcaaggcttaggggacctggacagaagagaggagagtgaggagagcctttgggagcggcctgccagggcctgtgtgtgcccacttggggtagygtgagccgtagtgtgctgtctcaccaacttgtatcttgcagggtgacaatgggccccctggaaaagctggccctccggtgagtgctttatcctctttggc

SEQ ID NO: 13688 - DNA, 201 bp, Homo sapiens
tgtacagtgtgtatgtgtgaggctgtctgtgagtgtgtgtagtatgtgtatgtgagtgtgtgaggatatctctgagtgtgtgtgtgtgactgtgagtgtaygtatgtgtgtgtgagtgagtgtgtgtgtgtctgcccaagtgggtgacctgctggggaggaccatctgtgccaagagcccagtcagcccaaattcagactt

SEQ ID NO: 13689 - DNA, 201 bp, Homo sapiens
agggtgacaatgggccccctggaaaagctggccctccggtgagtgctttatcctctttggcctttgacccttcctgctcttgccctcctctggctcatgtytgttccatctctgttttcaagggacccaagggcgagcctggcaaagctgggccagatgggccagacgggaagcccgggattgatgtgagtagctgagtgt

SEQ ID NO: 13690 - DNA, 201 bp, Homo sapiens
ctccagggagagccagggcctcgaggagaaattggtccccagggcatcatgggacagaaggtaagtgcctggcacaatggcccctccccgggggcctctgyggcagctggcactgctggatacagcatctgctccgtgcagcccgtgagatgcctccccaggcagggcctaggtttgctttgctggtctgccaagtggaga

SEQ ID NO: 13691 - DNA, 201 bp, Homo sapiens
aaaatctggagtcctgggggctccttccagtccagtctctgaagggttttgggaccttgaataagtcactctgggcctttgacttccgcaaaacagagccyacggaaggtggtgcttttctgtctgcaaacctaggggccagggcccatcggaatgctctgcctcccctagtgttactgctgacacccatctcatagactt

SEQ ID NO: 13692 - DNA, 201 bp, Homo sapiens
gttcacttgtctgaaaatctggagtcctgggggctccttccagtccagtctctgaagggttttgggaccttgaataagtcactctgggcctttgacttccrcaaaacagagcccacggaaggtggtgcttttctgtctgcaaacctaggggccagggcccatcggaatgctctgcctcccctagtgttactgctgacaccc

SEQ ID NO: 13693 - DNA, 201 bp, Homo sapiens
gaatttaattggataataaaaagttgaagacaatgaatatattaaataaaatgaatgattaaatatattactttgatttccattatggaaaatgctttctkggggggggggaatactttataaattataaggtactcagctttaagcaactccctcaaggagtgcagctgtagaatattaatgtttggctcttttaagaat

SEQ ID NO: 13694 - DNA, 201 bp, Homo sapiens
acaaggcaaacacttgtttgaaccagtccagctgtttctgtacctcacttctgatttctgtatgtcactttccttttgttgtctataaatttgttctgacmacgtggcatccctggagtctctctgaatctgctgtgattctggagactgccagatctgctaatcatttttttttcttggtccgttaaactctgttaaatt

SEQ ID NO: 13695 - DNA, 201 bp, Homo sapiens
tgtgtatatgttatgttccatggcaaaaacgactttgcagatgtgactaagttaatgctgctgagatagggagattagcctggatgatgcaggtggacccygtgtcataaatgagaatctaaataagagaaacagggagacagggagtcagagtgagagaaggacatgtgacaatagaagcagaggtcagagtgatgtgat

SEQ ID NO: 13696 - DNA, 201 bp, Homo sapiens
gccatttaatcacatggtttgtcgtgaagatatttccagttaaagaaatcttaatttaagttctccttcttaaatttgagaatgttaatattttggtggcytggacttattcttgagttctacttgctactaaacaacgtaagaaataaacatgtctatattgagtgttgcacagaaaatatttttgaaaattatattcag

SEQ ID NO: 13697 - DNA, 201 bp, Homo sapiens
tgttagtgaaagtaaacatgtaatttatctcctatcaaagtccacccatgccctgaattgtatccatagaccccccttgggaggacattgactccacgttragaactcctgctctgttagaatcctatttcatgtttgcaagcatcagaatgaaccctgctgcctcatattggttatttccaaagtggaggtgagaaggtc

SEQ ID NO: 13698 - DNA, 201 bp, Homo sapiens
tcaagcactcctcccacctgtctcctgagtagctgggatgacaggtgtgcaccaccacacctaaaaatgttttgtacagacagggtctccctatgttgccyaggctggtcttgaactcctgggctcaagcaatcctcctgccttggcctcccaaattgctacaggagtatttttaaacatttacaaacaaatgcacattta

SEQ ID NO: 13699 - DNA, 201 bp, Homo sapiens
ttaagcagtttgaaacgggctctggatcttgcagtaaaggcggggaaacacaaatgtgcaccagcaggcctcataattgacctccatttatccaactaacygaattgcccagtgctcttcattctatggtgaatactttgaggaaggtgcttgaacacccaggatgatccgctcctccctggtctgcctgctcatagctgc

SEQ ID NO: 13700 - DNA, 201 bp, Homo sapiens
acacaacgcaggattcatctccttgtcctttttcaaaattgaaaacaaactagtttcaggctttaataatagcaaatataattaaccaagagattcaaggraattactaagtccattatttctcaaattaaaataaatgttgtggtgctatatagttaaccaaataagtaaccatataacaaatgtactataatgggtatt

SEQ ID NO: 13701 - DNA, 201 bp, Homo sapiens
gccaatgattcaggatggtattatattaaattagaaactctgcttaactcttgatggaataaaagttactgtttataatggaaaatcctgcaaaagtttgyctttcttacatttggagttgtggctttttcaagcgagcagtgtcggaccatttttgttagccagagggccaagtaagaaaaaataaaaaatatgtgcagg

SEQ ID NO: 13702 - DNA, 201 bp, Homo sapiens
aacatttgtttgtgtttagtgaaatgaactggcttacaaaggcagtaaaatgttttgaattcatttaaataactaatgattcacgcttagtttgtgctaaygttttgagcacaaacttctgtgctctggttttgggtgatattaagcagtttgaaacgggctctggatcttgcagtaaaggcggggaaacacaaatgtgca

SEQ ID NO: 13703 - DNA, 201 bp, Homo sapiens
ggttctattaatagtttaatactatacataaaaataaacaaaacaacacaggaaacaatgtgcctaataggaagatttctttatggttgaaaatcagcagkgtatgtaatggaaagatggaatccaggtttgctcaaggtacatttgaggctgacatcatcaccttttttttttttcccttgagacagagtctcgctcttc

SEQ ID NO: 13704 - DNA, 201 bp, Homo sapiens
tattaaattagtgtgtcattggttttgtagggcccgatgatgcacaacaaaaaatagaacctcatcacacagcagtgcttggagaaggtgacagtgtccargtggagaacaaggtaagtatgttattttcctttaactttcttaacatgtactttctactggtttccaagaaaatgcctaaatgttgtggataactgaaag

SEQ ID NO: 13705 - DNA, 201 bp, Homo sapiens
ctccttctttctccttcctcttcttcctccttctttctcctttctcctccttctttctccttcctcctctctttctccttcctcctcctcatttctttctytctctctctttctttctttctttctttctttcctcctcctcctccttcttcttcctcttcctcttctgcttctccttctccttctccttcttcttctttc

SEQ ID NO: 13706 - DNA, 201 bp, Homo sapiens
gccacagatgatacataaacaaattgggtggctattccaataaaacttcatttatggtcactgaaatgtgaatttcatgttttttcatgtgtcatgaaagrctttttttaagtttgtttcaaccatttataatagtgaaaatttttcttagcctgtgggctctaccaaaggtgacagttgattttggtttaaatgaattgc

SEQ ID NO: 13707 - DNA, 201 bp, Homo sapiens
cctccttgggcaatacactcccagctccaggcagctggctgacagataacatctgctcagggatagaaggccacacccagagctatttaaaccattccttktattctccaaaaaggatgttcaattgcctgaaattattcttctggaaaataattgtaatgcaaactcatgcattttgaatttattcctaataaagtacaa

SEQ ID NO: 13708 - DNA, 201 bp, Homo sapiens
ttcccaagataactaattttgtgacttctgacatcataaattaattttggcttgttttgaactttgtagaaatggaatcatacggtgtatgatcttctgtrtctgtcttcatttgctcaatattatgcctgtgaaattcacctgagttgttgcatgtagttgagttcattcattctccttggtgtatagtattccactgta

SEQ ID NO: 13709 - DNA, 201 bp, Homo sapiens
ggtggtaactccaggcaccagatcttaagaaaatcctgtactcaactatggaaagctgataagaatatgaagaaatgttcctctcaccaatatgcagaaamatagaaatttgaataatatgctgccacttgacacccttcaaattaagaaaaaatacaaagttgggtactgtgaagtgctggcaaggatgggaagaaatgg

SEQ ID NO: 13710 - DNA, 201 bp, Homo sapiens
ggtctggcaattatgtgatccagagtttgtgaagggttgcaatctctccttagcccagttgcccttatctctgttaatggtgttggtgtgtcaccaggccrtgtttttctattttttctgcacatacaggtgtaaggaatacttgtaagttcattggaataatgaactccaagactgaggcagaaggaaaatgacccgggt

SEQ ID NO: 13711 - DNA, 201 bp, Homo sapiens
tcacaccaaggcatatctgtcttctagactgcacatttcattttatctaaatattaaaatatcacaaatttgaacataaacctctcctatcatcaaacttytaagacaaaagtaaagttctgatctaaaaccccttgcccttataaatcacattaaaataaactagaattaaaattgcattctaaataagatgccaaagca

SEQ ID NO: 13712 - DNA, 201 bp, Homo sapiens
atggagtcttttgtattaatatggctgttatgtttggaatacaatatggactgattaagatctggctcctccaggtttgttgagaaataaaacaatgacartttacctctttttcgtaaaaccttaaagcccccttgctctctttgttttattttttaattattattatactttaagttgtggggtacatgtgcacaacgt

SEQ ID NO: 13713 - DNA, 201 bp, Homo sapiens
cactcaccccagaaataccattcttggtgtgcacaaagggtgccagatgttcttattcattcaagatgtccctgctgacctaatccctaagaagtacattycagtcgtggcgacaagccctctccttccagtgaatgaagaatggataggtgcacttttaaaccagaagtaacaccctgtgccattcatactttgttggcc

SEQ ID NO: 13714 - DNA, 201 bp, Homo sapiens
ttaaattagtgtgtcattggttttgtagggcccgatgatgcacaacaaaaaatagaacctcatcacacagcagtgcttggagaaggtgacagtgtccaagyggagaacaaggtaagtatgttattttcctttaactttcttaacatgtactttctactggtttccaagaaaatgcctaaatgttgtggataactgaaagtt

SEQ ID NO: 13715 - DNA, 201 bp, Homo sapiens
ctcaacttaactaagttaccagggcacaaaacaccacatagaagtgtatctaagtacatatgtaattcacttctgacggaactacagttctccttaatttyaaatcaaacacccatttctaacaaataaaattactgaaaagtgtatatatgtatgatatacgtatgattttgatagataggactcttacaattataacat

SEQ ID NO: 13716 - DNA, 201 bp, Homo sapiens
tcttcctttttttggttgttagaatggcctttcttttatgaaatgatgaccatagtagataatttttacctttcacaatctgaatttaaaagttggcaccmccacccaccattgaggagtattctataaaatacttcaccagtactcttcaaaattatcaagctcatgaaaaacaaggaaagagtgagaaactgtcacaga

SEQ ID NO: 13717 - DNA, 201 bp, Homo sapiens
catcgccttatagtccaagacagctgttagggaaatggcaaccatttaccctctggcaaagaaaggaggaagaggggaagggcaaaatgatactcatcttstgtccatcctcctcttataaggaattttcctaaaagttccaccctgcaacttctacgttgtagctagattcaatcatatgaacacaactagctacaagag

SEQ ID NO: 13718 - DNA, 201 bp, Homo sapiens
gatgaggactttctctagaaaacatctgtgcaccattagaggggcgcatgagatttaggagtgccttaaatcaaaagcataactttctcctccacaacacrttgcctagctgaaaggatattaaaatagtgagtgcactcatgagtttagaagtggaggcagaggactttcaaattgcatgaaagttagaaaataattaag

SEQ ID NO: 13719 - DNA, 201 bp, Homo sapiens
taacacacatatgtatgtacagatgtataaggacatttatatatgtttatacagacatacaatagaaacagtatgtttgatgtttcctcattagactgtgytcatcacaacagctctgtgttatacgtattcattccttattttacaaaccagcaaagaggcttgaagagatgaagagtctggtcctagatcttcctgagg

SEQ ID NO: 13720 - DNA, 201 bp, Homo sapiens
tttttttgtcctgtctctccatctataaatctgaggattgtttaatttttctgtcatcagagggaaatatatatgtgatgtttattcatctcttttttttwaaagaaacatttcttagatacctattatgtataggatattgagtttggaactgtgggaagaacaaaaatagtatttttgtattatgtcatagggaatttt

SEQ ID NO: 13721 - DNA, 201 bp, Homo sapiens
ttggttgattttcactggaaagggcagagacttactagtggaagagaaaagagtaaatacagaaggtgagaggagaggagaaaaggaaagaggtgtcttcwgatggtttgaagtgatttgaagagttagagtgagagaaaatggaatcatgggagacagatatatacatggagaggggtaagagggattttaagcatatct

SEQ ID NO: 13722 - DNA, 201 bp, Homo sapiens
gcatcgccttatagtccaagacagctgttagggaaatggcaaccatttaccctctggcaaagaaaggaggaagaggggaagggcaaaatgatactcatctkgtgtccatcctcctcttataaggaattttcctaaaagttccaccctgcaacttctacgttgtagctagattcaatcatatgaacacaactagctacaaga

SEQ ID NO: 13723 - DNA, 201 bp, Homo sapiens
atgttaatttcataatttccataagtgcactatacttttgtaagaaaatatctttgtttttaggaaatacatactgaaaattatttcaaggtaaaggggcyacatgtctgcaaattactctcaaatagttcagaaaaaaaaagaatgacatatatttatagcaagaagaatgataaagcatatatgttaacatgttagctt

SEQ ID NO: 13724 - DNA, 201 bp, Homo sapiens
tttctcccctcaaagtattttgaagagaattccagccattattttatttcacttataaatatttcaatttgtatctctaaaagataacttgaaaaaaaaaactacaatctcattatcatacttacaaaaattttaaaaatcccttaatatcatcaaatagccttgactaatcttgttcttcactgatttagcctctgtaga

SEQ ID NO: 13725 - DNA, 201 bp, Homo sapiens
agtttcgtctttataatcaataatcatatacaatcctagtcaagaaactcatcttacagtccttggggattgaacactgtgaaaataaacttttactcttyggatgtgcttggattttgttttaaattaagaactacagaaatatatatcatttctagtggtagaggaaaatattgccacccagaactttctgaatgtctc

SEQ ID NO: 13726 - DNA, 201 bp, Homo sapiens
tgtttcatggttgcttagttggtttgttttccgtggttctccacaaagcctcctttaaggtttgctgctgcgctttgtttccccactccccaagagagagytgcatggatagaattaaatatggaggcggggcaggcagagaggccatgatactggagaaatgtaggaccatattgagaagagtttgtctgtcagaagttt

SEQ ID NO: 13727 - DNA, 201 bp, Homo sapiens
gactgtgttcatcacaacagctctgtgttatacgtattcattccttattttacaaaccagcaaagaggcttgaagagatgaagagtctggtcctagatctycctgagggtgatgcactgatgttgaaacaggaactttctgcctgtaatggtgtgtgctcatttttgttgctgtttcatggttgcttagttggtttgtttt

SEQ ID NO: 13728 - DNA, 201 bp, Homo sapiens
ggaaagtggaaaaagaagaaaggggcaggaaaatgaactgatatttgttaaatacctcctaagtgcctggcattgtgtagagaagattaaaaacatataayacacatatgtatgtacagatgtataaggacatttatatatgtttatacagacatacaatagaaacagtatgtttgatgtttcctcattagactgtgttca

SEQ ID NO: 13729 - DNA, 201 bp, Homo sapiens
tacggtgagctgttacttgctgtatgatcagacaacccaacttatgtcaccaattctagtctgcagtgtttggtgggacacagacagcatccttaatgccrtgaggttcttgatgaggacgttttgggagacgtcgcaaaaatgtagacttcttttgggaaatgatgaccctgctgagctttgctccgcagtcgaagagac

SEQ ID NO: 13730 - DNA, 201 bp, Homo sapiens
tacaaagttgacatttctttatcttgctgtttatattcagttataagatgggggttaaatgcctattcttggcaagctagtagatcttacggtgagctgtyacttgctgtatgatcagacaacccaacttatgtcaccaattctagtctgcagtgtttggtgggacacagacagcatccttaatgccgtgaggttcttgat

SEQ ID NO: 13731 - DNA, 201 bp, Homo sapiens
ctgccatcttgtcctgcaccaaacaaaaacatggacctttagtgaacagtactctattagtagtgtcttgggcatattggtaaataaatccaagattttgyacataggttagaaaaacgactattcttgaaaattttaaatgagtaatatcatctcattgtgttgtgtttttctgttatgtcacctttaggagaaaacagg

SEQ ID NO: 13732 - DNA, 201 bp, Homo sapiens
ggttttgacttcttcatatcattgttgtttgattaaatgaggaacatctaaaagcaattaaaacccattttattatttagataaatgcttacaaaacataygtccacttcaccaattattaaattcaacgtgcattaaaatcccattgcatttccctgccttgcatgaattcccaggtacacacaatgattgcagataaac

SEQ ID NO: 13733 - DNA, 201 bp, Homo sapiens
aactgccatcttgtcctgcaccaaacaaaaacatggacctttagtgaacagtactctattagtagtgtcttgggcatattggtaaataaatccaagatttygtacataggttagaaaaacgactattcttgaaaattttaaatgagtaatatcatctcattgtgttgtgtttttctgttatgtcacctttaggagaaaaca

SEQ ID NO: 13734 - DNA, 201 bp, Homo sapiens
tatcctttgatgaaattggttttcatgtatggtaagatacaattacattttttaaaacatggtttgaaacagaggaaaaaatggcaaaaatccatgatggrgaatgccatgaacattttaaggggttcacagttcactgaatcatcatatagtaataacaatcattatagctaacatttattaaatgcctactctttgcca

SEQ ID NO: 13735 - DNA, 201 bp, Homo sapiens
cttcagaacagtgattaacgtgaatcagagcctgaaatatcaaattattcaggaagaagtttaacatcattttcctttgactgggttgtctttttcatatygatttgtaagagctctttatatattctgaatactagtcattgtcagttatttgtgttgcaaatgtctttcctgcttttttttttaacctttctatactat

SEQ ID NO: 13736 - DNA, 201 bp, Homo sapiens
ccccagcccaaagggggtttctgtaatgtgaatacagaggtcttgggcagaaagtgcagctgagcttcaggaaatgtctctgcttctctctgcacactggygtgccaccctgggctgacatgctatctgcctcagcatgcatatcgccaaacatgcccaccacacagcccctaagtttatttgcccacacttcaaagcacc

SEQ ID NO: 13737 - DNA, 201 bp, Homo sapiens
aataaatatttatcgattactattcagggaggatacattttagggtaggccttgactaagtggagggtattgtggagtagagcccttctgaataacagcarctaacattctcatagcactaactgcacccctttgaggtaggcggtcttatcattccattttacagataaaactgagccacagaaaacctcaggtcacaca

SEQ ID NO: 13738 - DNA, 201 bp, Homo sapiens
ggtgaaaatggtagacggcttttctttctgcaaagcactgagatctaagtacctcatcagttgttcacatgcatacaatttaatcgtaggagtctggaagracccagacataatctagatggggataaagatactttctggttgcttcgatgtaggtgatgaccggcctgtactgctttgagtattaagctcgtttctgcg

SEQ ID NO: 13739 - DNA, 201 bp, Homo sapiens
caaaaaagtttcaatccagagttgggttccagctttctgtagctgtaagcattggtggccacaccacctccttacaaagcaactagaacctgcggcatacrttggagagatttttttaattttctggacatgaagtaaatttagagtgctttctaatttcaggtagaagacatgtccaccttctgattatttttggagaac

SEQ ID NO: 13740 - DNA, 201 bp, Homo sapiens
atctacatgcatactcacatagagccctttgaaaaggatccccaccttggccgggcgcggtggctcacgcctgtaatcgcagcactttgggaggccaaggygggcggatcacgatgtcaggagatcgagaccatcctggctaacacggtgaaaccccgtgtccactaaaaatacaaaaaattagccggacatggtggcagg

SEQ ID NO: 13741 - DNA, 201 bp, Homo sapiens
aggaagataggatgcatttcatagtctttttgtgatgaatccctgctctttaagtaaagtttctgatattttaggagtcttgggaggtttttattcccaartttccaggtttctttctcatgtctatttcattcccttgagtaattcagtcaccatgttgtgagtctgtttagtcaatctgactgctttatgtcattctta

SEQ ID NO: 13742 - DNA, 201 bp, Homo sapiens
gatggaagtcttattttaggcaatctcctctgtaccaataatgaaaagcaagagtctaactgaattaggtgacagatcaaaggagtgggactgctcaaagscaccctacactggggtcatgtggatcctctcccagtggcttggaacagagggacactaggtatgcctgcacatacaaactcggagtaatcagacaaaata

SEQ ID NO: 13743 - DNA, 201 bp, Homo sapiens
caagagtctaactgaattaggtgacagatcaaaggagtgggactgctcaaagccaccctacactggggtcatgtggatcctctcccagtggcttggaacasagggacactaggtatgcctgcacatacaaactcggagtaatcagacaaaataaatatgtcccttgaaagttcagttactgagaagcaaagcattttgttt

SEQ ID NO: 13744 - DNA, 201 bp, Homo sapiens
aagtatttagacatttcaactcaaatgagctctaaatcattgatagtaacgattaaaggaacagcatgttctgtcataaaaatcacagggaatcatttttkgccatccattgcagatccgggggctgttcagtattcctttggcttagtaaaatgagatgagttcagcaaacatttactgagggccagctgcatgcaagac

SEQ ID NO: 13745 - DNA, 201 bp, Homo sapiens
actgttccaagaatggtagaattttcactgcaatcttttctcttgtctagaatgccctttcccccagatttccctcttgtggtttatctaatcctacagarctctgttcaagtcttacctcctccacaacaaatatctgtggtccctagacctgcacaagcccccatcacccctgttctcttattgaactttgcttatgaa

SEQ ID NO: 13746 - DNA, 201 bp, Homo sapiens
taagggccctaggatttttacaatggtaaatgaacactggcttcaacttaaagtcaccagctgcattaacccctaacgagagagagtcagcctgttctttraagctttgaagacaagcatcgacttctctctagctatgaaagtcatagatggaatcttttttcaatataaggctgtttcatctacattgaaaatctgttg

SEQ ID NO: 13747 - DNA, 201 bp, Homo sapiens
agccctttgaaaaggatccccaccttggccgggcgcggtggctcacgcctgtaatcgcagcactttgggaggccaaggtgggcggatcacgatgtcaggaratcgagaccatcctggctaacacggtgaaaccccgtgtccactaaaaatacaaaaaattagccggacatggtggcaggcgcctgtggtcccagctactcg

SEQ ID NO: 13748 - DNA, 201 bp, Homo sapiens
atatctttggatgtctttaaccacccagtgtatttatggccttcgtaaactagcatttataaaataatcagtccttgacttggagccaattgatttcctgrgttcagtgagtctgagtctttataatatggaatatttcagagacatttgtcatctaatgaatagcagctacactgccctgaagggcaaattaacaaaatc

SEQ ID NO: 13749 - DNA, 201 bp, Homo sapiens
agtgttgcacagaaaatatttttgaaaattatattcagaattaggaacatcgcctatttggctagcatgtcaatttcaaattgttcacaatttgatcttcraaaataagcctgcttattgtttgatgttttctttgttaactttaggatcccaagagaagccactttgtcttaattgctggggagccattaagagaaccag

SEQ ID NO: 13750 - DNA, 201 bp, Homo sapiens
gagtgggactgctcaaagccaccctacactggggtcatgtggatcctctcccagtggcttggaacagagggacactaggtatgcctgcacatacaaactcrgagtaatcagacaaaataaatatgtcccttgaaagttcagttactgagaagcaaagcattttgtttttattttttaacttttaaaaactcagacatttaa

SEQ ID NO: 13751 - DNA, 201 bp, Homo sapiens
ataaatctacatgcatactcacatagagccctttgaaaaggatccccaccttggccgggcgcggtggctcacgcctgtaatcgcagcactttgggaggccraggtgggcggatcacgatgtcaggagatcgagaccatcctggctaacacggtgaaaccccgtgtccactaaaaatacaaaaaattagccggacatggtgg

SEQ ID NO: 13752 - DNA, 201 bp, Homo sapiens; identical to SEQ ID NO: 1841

SEQ ID NO: 13753 - DNA, 201 bp, Homo sapiens
cggattgctttaaaaatattcttttttgttctactaactacttcagggggaacattaaattgtaccctgccttgcctgtagcatttgacaaccattttgtrcgcatccgatttccattccaaaggtttgtggttcttgtttccttttctctcaactgaaaagcactgcaatattatagtttgtttttctggaaaaagcctt

SEQ ID NO: 13754 - DNA, 201 bp, Homo sapiens
ttgcagtgagccaagatcgcaccactcaccactgcactccagcctgggcgacagagcaagactcggtctcaaaaaaaaaaaaaaaaaaaaaaaaaaaaagwaaagaaaagaaaaacaaaacaaaaaatatccagaactgaacaccttgctccatccaaagcctcccacgtcctgtatctcaaatacccttaacaattccac

SEQ ID NO: 13755 - DNA, 201 bp, Homo sapiens
actatttttaattcttataaagtttataatttacctaaggaaacatgagcacataatgccaaggactttgcttatcaattaaagtgtaaatggaaacacaacgcaggattcatctccttgtcctttttcaaaattgaaaacaaactagtttcaggctttaataatagcaaatataattaaccaagagattcaaggaaatta

SEQ ID NO: 13756 - DNA, 201 bp, Homo sapiens
aataatcgcgggaggcagaggttgcagtgagctgagattgcgccactgcactccagtctgggcaacacagagagactccatctcaaaaataaataaatatataaataaataaataaatatttaccttagagtggagcatttcaaatgacctctttagtatcaacactgagattgcaaagagaatgggcagaaattgcatcc

SEQ ID NO: 13757 - DNA, 201 bp, Homo sapiens
agaataatcgcgggaggcagaggttgcagtgagctgagattgcgccactgcactccagtctgggcaacacagagagactccatctcaaaaataaataaatatataaataaataaataaatatttaccttagagtggagcatttcaaatgacctctttagtatcaacactgagattgcaaagagaatgggcagaaattgcat

SEQ ID NO: 13758 - DNA, 201 bp, Homo sapiens
taaaagcagccatgggttcccgtaaaaggctcttggtagcactgggagaaaacagctatagcagatgctgttggtaccccacccacacccctgggcccttrcttcctgagtgcccactgaccaactaataatagccagtatctgtgtcacttcgcttgaaggcttttctctgaaaccaatcagggcagcatgaaagtactg

SEQ ID NO: 13759 - DNA, 201 bp, Homo sapiens
agcaggtcttgatgtgtcctagaattttgccatttctgagattgagccattgaaggcattccatttctaaagcttatttagccggtgcttctaaagaattscacactaacgtgataacatggtttttgtaacaataaatgtaggatatttcctggcacatgcaaataaacctaatcattgtttctttaaaaatcagtgttt

SEQ ID NO: 13760 - DNA, 201 bp, Homo sapiens
ggcctgggggttggggacccatgccttagattcatactcagagtcctactgccatcttgagttttatatttatagttgatcaaactgagtagctactcatrgtttagaagttatcaacatattaagtgaaccataaaactttcatctgggctttgatcatttattgttggtatcagcagaactcgagacatatcttggcaa

SEQ ID NO: 13761 - DNA, 201 bp, Homo sapiens
tttcatgctcccttacccaatggtcattggttatggccattaactttgaagtggaggcacagaaatggttaaaagggatctgaggggatctgggagaagcyttgacatcgggtactacacatggaacctggcattgagtgcatcaagatagtgggagttactctgccattctcccagtgcacaaccagcacttaaaactat

SEQ ID NO: 13762 - DNA, 201 bp, Homo sapiens
aaataagtcaatttaggctaaagattatggacatatttgtgggaggaaaggggtgcggcaaatgccatgttaattgcacaccagaactgctcctggggagmataagattcctcacaccaaccaatctgaggtagtgtgttttcttaggtggggtttcccagaagcagaccctgagatgaagattcccatccaagagatttt

SEQ ID NO: 13763 - DNA, 201 bp, Homo sapiens
cttggtaacagggaccctgctggttcaacaggagctgtctctctttcaccccaatctccagggcccaccatgccaggaccatcatctgctgggctgaaggkgtgagtggcggctcttttcactcagctgtgagctctggcaggctcagggatgcatctgctaggaggaaggggcacctaggtgagattctgtcaaagacat

SEQ ID NO: 13764 - DNA, 201 bp, Homo sapiens
tccttcacatgtgcagttcacaacaggatttgtgctcctatgagaatccagcaccactgctgatctgacaggaggcagagctggggtggtaattcgagcartggggagtggctgtacatacagatgaagcttcactacctcacctgccactcacctgttgtgcagcccagttcctaacagaccaccaattggtactggtcc

SEQ ID NO: 13765 - DNA, 201 bp, Homo sapiens
taaagcctaaaactctctggccctttacagaaaaggtttggtttactacgttgtagatgctcaataatggtaactggaaagtttatgaatccaaatatctmatttgatagtcataccacatgcatgttacctaataaggatttatacagtagacctgaaggcttagggcacataacagtttctacaggtagaagaaggctc

SEQ ID NO: 13766 - DNA, 201 bp, Homo sapiens
cctttacagaaaaggtttggtttactacgttgtagatgctcaataatggtaactggaaagtttatgaatccaaatatctaatttgatagtcataccacatrcatgttacctaataaggatttatacagtagacctgaaggcttagggcacataacagtttctacaggtagaagaaggctccaagagaccctgactcactca

SEQ ID NO: 13767 - DNA, 201 bp, Homo sapiens
atgttacctaataaggatttatacagtagacctgaaggcttagggcacataacagtttctacaggtagaagaaggctccaagagaccctgactcactcacrctccaagccagtgttatcctcacttgaacctagcattagcctgaggatttgataaagaaggaagatgtgactgcccagtgccgcgccaatcccatttcca

SEQ ID NO: 13768 - DNA, 201 bp, Homo sapiens
gctcccatcagctgagttgtagtggacttaaaggcacctatgtttgttctcagtccatttatgctagttgcaccaataattgaaattatgtaatttaattraacagttgtaaattaattaaataaatgtgaaaagagagttggtatttccagaacaactaaggcagatgctttgtaaaagtgaattgctaaaggaaatgcc

SEQ ID NO: 13769 - DNA, 201 bp, Homo sapiens
atgtgaaaagagagttggtatttccagaacaactaaggcagatgctttgtaaaagtgaattgctaaaggaaatgcctttgacacggaaagacaaacatcayatgttctcagttctttgtgggatctaaagatcaaaacaatatgaactcatgaacatagagagtagaaagaaggttaccatgagttcatgaggctgggaat

SEQ ID NO: 13770 - DNA, 201 bp, Homo sapiens
atttttccatatggtcaatgactcgaaaacaagtagtgattttttttctctctctcatttgtgacttttaaaaatgactggagtaaacctcgaaaaatgcrtagtgattttttccacaggcttcttgcctgttttttcatagtctttctctacttttaaggagaatgccccaaacatgaatgattcatgtagaattttaca

SEQ ID NO: 13771 - DNA, 201 bp, Homo sapiens
aattgatttattttgtttttagcataagtgaaaatagatcagccctatagaagtagaaatataaatctacatgcatactcacatagagccctttgaaaagratccccaccttggccgggcgcggtggctcacgcctgtaatcgcagcactttgggaggccaaggtgggcggatcacgatgtcaggagatcgagaccatcct

SEQ ID NO: 13772 - DNA, 201 bp, Homo sapiens
ccagctactaggaaggctgaggcaggagaatcgcttgaatctgggaggcagaggttgcagtgagctgagatggcaccactgctctccagctcaaaaaaaaagcatatttctagcatcagcttcacacttcagacacactggaggcacaacaaatggaagataaagccagactggagtgttgcagttactatcataacatta

SEQ ID NO: 13773 - DNA, 201 bp, Homo sapiens
taggatgcatttcatagtctttttgtgatgaatccctgctctttaagtaaagtttctgatattttaggagtcttgggaggtttttattcccaaatttccargtttctttctcatgtctatttcattcccttgagtaattcagtcaccatgttgtgagtctgtttagtcaatctgactgctttatgtcattcttataaagag

SEQ ID NO: 13774 - DNA, 201 bp, Homo sapiens
tgcactccagcctgggcaacagagtgagactccgtctcaaaaaaaaaaaaaaaaaaaaagggagaaaaacgagtaagctatgaataagtaacattactttyagagagcttaaactcattctagtaaaatctcagagaggaaaaactgtgaaatagggggatgggaaaatattctctggcacttgctcatgtgtgtttgttt

SEQ ID NO: 13775 - DNA, 201 bp, Homo sapiens
aataatactgccaactgcaagtgattgttagaaagaatatttgagattacgtatattacaagtctactccagattgagcatgggggtcagtaaattatgtycaataggccaaatccaaacctttttcataaagttttattggaccacagccacacccattcgtttccatattgtctataggttcttttatccaataacagt

SEQ ID NO: 13776 - DNA, 201 bp, Homo sapiens
attagtgtgtgttttcagcatctaccatggacctccccccgccaaaggtgcacaatttgcacaccccggctatgccttattcatttttgtatcttcctctmaagtacatgcccatggtagatgttcagtaaatgatggtagacaaagctcggaagactaaatatgagtgggttaagatgggagaaaaacgcctgtaatccc

SEQ ID NO: 13777 - DNA, 201 bp, Homo sapiens
cctgttagcttctgatgcaatgagtgttcagtattatgaatgtggaccaaaccataagacagggttctcctataggctgcaattgtgcttacttaaaataygggatcctgagggatggctcttaatgttatatgcccatggcttataaacagcctgtagtatgatcgttctgtaatgtataaagtgcattctgagtctatt

SEQ ID NO: 13778 - DNA, 201 bp, Homo sapiens
actattgtattagcaagaaaataatcagcagggtttgccctccagcgggctaggcttcattctgggcatgcagaaggctgtattctgagtttacattctaragagcttatattgcttatatatttctcattcaaaatgttaaatttcatttatttcttagctttcctgttagcttctgatgcaatgagtgttcagtattat

SEQ ID NO: 13779 - DNA, 201 bp, Homo sapiens
caactccctcaaggagtgcagctgtagaatattaatgtttggctcttttaagaattttctttaaaactgtaactgtaattatttgtcagttcatttacttsctaaaattcatttgtaacccccaaatcagtacctgtggtgcttttgtagtaatttgtgggcatgtgtagagtggcaaaaaatttgagctgcccaatgcac

SEQ ID NO: 13780 - DNA, 201 bp, Homo sapiens
cattatggaaaatgctttctgggggggggggaatactttataaattataaggtactcagctttaagcaactccctcaaggagtgcagctgtagaatattartgtttggctcttttaagaattttctttaaaactgtaactgtaattatttgtcagttcatttacttgctaaaattcatttgtaacccccaaatcagtacct

SEQ ID NO: 13781 - DNA, 201 bp, Homo sapiens
aaagatgtttgggaaagggcaccaccacagtgtaaagggataatgaaccaagaagtttctggaagtaggatcagggtagttggactcttttcccttcctcrtttagccattcgccttccagttcccttctctgctaacacgttgaaggcgctgtggcttgctttgcagcaataatggaagccattcctttcacctacccta

SEQ ID NO: 13782 - DNA, 201 bp, Homo sapiens
tacattcattgttttcaatccttataatcttccaaggtatatattatcatgtgaggagaaagcaatgtataataaggtatgagaattctcaacctctcctyctaccaatcccagttctgttcctggacttttaataagctgatgtggaaaaatgaatgacaagactgaaaggaaacaaatttgcttggttgattttcactg

SEQ ID NO: 13783 - DNA, 201 bp, Homo sapiens
gtgttggagtcaatcttgaggagcctgttccttcagctgctcccgtattgtcttgatgtaggctgacctagaatcacctgattcttggctactaccatagrcattattgcccttttatcagttaggattaggttcaactgtgtgtaacagaaagcatcatccaaaaccaatgatatacataagtgtttgtttctcttttgt

SEQ ID NO: 13784 - DNA, 201 bp, Homo sapiens
gtagatgatgcttttcattatcaaggtctctagatattgaatcaaggaagtgggccatatagtcacagctcaagtccattcaaggctgtatctagatctcrgtctaggatatgtgctgcagtttccttctgccttctcattgttatccccaggttccagtctagaggccgagtaaacccagaaggtagcctgaggtgttgg

SEQ ID NO: 13785 - DNA, 201 bp, Homo sapiens
ctttctttttctttttctttcttttcttttttttttttttttttttttgagacggagtttcgctcttgttgcccaggctggagtgcaatggcatgatctcrgctcaccgcaacctccacctccctggttcaagtgattctcctgcctcagcctcccaagtccctgggattacaggcatgcgccaccacgcctggctaattt

SEQ ID NO: 13786 - DNA, 201 bp, Homo sapiens
atgttatgtatattttaccacaataaaaaaaaaacaaaaaaattagtagaggttagtgacaatagagatataactttttagcagtccaagtttacaacccytctgagttctatcagtggtgccaggtaaaagtccatggctgataacttatgctttacagatccccatattttactgattcagatctcctgtaccccaggt

SEQ ID NO: 13787 - DNA, 201 bp, Homo sapiens
gctggcaggctgggagctgggctctgctggggctgttgtttagagatgcctgagttctgctctaggtagcccctccatttggctagtttgggattcctcgmgagagggcagtcacaagacagcttcccagagagggagcatttgcttatgggaggagctgtggaaatgaagataggaaagcagaagctggggaatcagaga

SEQ ID NO: 13788 - DNA, 201 bp, Homo sapiens
tataaacatataattatttaaccaacccctcacttttggagaaatgttttcaatttctgctgtgataaatagtgctacgacagtgaaattcccttacactrtattgctaaaactgtcattactggatcggaggacattagcaatattgggggttttgagtcatattgtcaaattgctctctggaaggattactgcaccagt

SEQ ID NO: 13789 - DNA, 201 bp, Homo sapiens
gatatcaggaattgagctggacggtgcatcacttacaaagaatctaatttgtcgagtttctgacagtaccagattcctttcacattggccacacgtttttyatattagatcttggctaaaataagagtaagtagttttttaatggtgacttttaccatttcttgcaaggcgcaaggcaatctgactttccttttgctgtaa

SEQ ID NO: 13790 - DNA, 201 bp, Homo sapiens
aacatataattatttaaccaacccctcacttttggagaaatgttttcaatttctgctgtgataaatagtgctacgacagtgaaattcccttacactgtatwgctaaaactgtcattactggatcggaggacattagcaatattgggggttttgagtcatattgtcaaattgctctctggaaggattactgcaccagttgaa

SEQ ID NO: 13791 - DNA, 201 bp, Homo sapiens
gagttccttcccatgaatactatttgaatcgatttttaccatctctttatttccttcaggctaggcacgtttctcttgggttgtgctaatcttgcagaaarcagatgtttcatgcagtgatgatttggaaggcagttgatatcaggaattgagctggacggtgcatcacttacaaagaatctaatttgtcgagtttctgac

SEQ ID NO: 13792 - DNA, 201 bp, Homo sapiens
tgagcagatgtcccttggatgctctgtttttataaggttccatttagtgcaatatttccggggcatattttacattattagtaataattttcaaaagtaayaaaatcttattttggatttccataactaatcttcccttttaaaaattatatggtaactgagaaatcataaatcccatgataagccatttaatcacatggt

SEQ ID NO: 13793 - DNA, 201 bp, Homo sapiens
tccacagattaagcacaggaaatcatagaatgttaggatagaaaataaccttagccatgatgtagtcatgcctcttttatagatgaggaaaataaaatccrgatattttatttatttacttaatggatgcttgcatagaatttactatttcctagacattggttaaagcactttcctaatgttaatccgtctaaccttcaa

SEQ ID NO: 13794 - DNA, 201 bp, Homo sapiens
gcttccatgaaggttgtgcaaaaaagtttcaatccagagttgggttccagctttctgtagctgtaagcattggtggccacaccacctccttacaaagcaamtagaacctgcggcatacattggagagatttttttaattttctggacatgaagtaaatttagagtgctttctaatttcaggtagaagacatgtccaccttc

SEQ ID NO: 13795 - DNA, 201 bp, Homo sapiens
actccagattgagcatgggggtcagtaaattatgtccaataggccaaatccaaacctttttcataaagttttattggaccacagccacacccattcgtttycatattgtctataggttcttttatccaataacagtggaattgagtagttgtgacaaataaagcctaaaactctctggccctttacagaaaaggtttggtt

SEQ ID NO: 13796 - DNA, 201 bp, Homo sapiens
aaatccaaacctttttcataaagttttattggaccacagccacacccattcgtttccatattgtctataggttcttttatccaataacagtggaattgagwagttgtgacaaataaagcctaaaactctctggccctttacagaaaaggtttggtttactacgttgtagatgctcaataatggtaactggaaagtttatga

SEQ ID NO: 13797 - DNA, 201 bp, Homo sapiens
agtgcctctctgcccctacaatatatgaagaaaggggaagaaacacacattgcctcctggtagattaggggaggacttcttgtacatttttagcaaaatcygagttcagacccagcaattagacaaaagggtcagcaaactatggtcgatgggctacatctgcccactgcatgtttttgtaaatgaagttttattgggaca

SEQ ID NO: 13798 - DNA, 201 bp, Homo sapiens
cttcttattcaagtcttcactttaatgtaatctccctagtgaggacttcccttactctcctcattttattttctctctctgcatcctatttatttcttttytagcaagtaccacattttaaagttttatatttaatttgctaaattatcttcttcactagaaagtaatacttcacaagggttgagcagaactgttattcag

SEQ ID NO: 13799 - DNA, 201 bp, Homo sapiens
tatgggactactgtcatacatacagtccatatattgttgactgtgtaatgttgacctgaatgtcattatgtggcaggcacatgactgtatcgctaaccttygcacaagattactgtaggattacatgagatagttgtaaataattggtggggtactgggcacctagtaggtatgcatacatgttcaccatcattatggttg

SEQ ID NO: 13800 - DNA, 201 bp, Homo sapiens
gcattatagtcttatgggactactgtcatacatacagtccatatattgttgactgtgtaatgttgacctgaatgtcattatgtggcaggcacatgactgtrtcgctaaccttcgcacaagattactgtaggattacatgagatagttgtaaataattggtggggtactgggcacctagtaggtatgcatacatgttcacca

SEQ ID NO: 13801 - DNA, 201 bp, Homo sapiens
ttggcataagctttgcagtctaactaatttaatgttgacttggttttatcattaacagactaattggatagcaatagaagcatacactgctaccatcctcyccctgatactgggaaaatgcatatattccaagggaaatccagttaagggagactgaaaacgtttctcatgaatcagactaggttttatctgagttccttc

SEQ ID NO: 13802 - DNA, 201 bp, Homo sapiens
tcttcccaccccagcctcccaagtagctaggactacaggcactcatcattaatggtggctccttttaacagtgatattctacatcatctaaatacatactmtgatgtatttagctattttctatcaatgggaattcactttgttcctagtgcttggctacagcaaactggtctgcaatgaataccttgtgtatctgccttc

SEQ ID NO: 13803 - DNA, 201 bp, Homo sapiens
ctgttccattttcttctggtactttcatttgaatcagaatgtcaggcagcaatggaccccaaagataagctctccaactccaccactttgtaaatgagaargctgaaacccaactaggcaaaaagtctttcccaaggtcacacagctcattgtgaaagaagaccagacccaaactcaggtttcctgaattttgtcccattt

SEQ ID NO: 13804 - DNA, 201 bp, Homo sapiens
gtctagatcaagcttattcaactcgcggcccaggacaactttgaatatggcccaacgcaaatttatatactttcttaaaacattgtgagatttttgtttgygattttttttttctttgagctcatcagctatcattaatgttagtgtattttatgtgtggcccaagacaattcttcttccagtgtggcccagggaatccat

SEQ ID NO: 13805 - DNA, 201 bp, Homo sapiens
tctgtgtgttcgctggagtagcacttttaatttccttcagaaacttttcccttgcattcccaacttggctaactggtgcaagaggcctagctcttggcctrtctcggcttttgacatgccttcctcactaagcttaatcatttctagctttttgtttaaagtgagagacatatgactctttctttctcctgaacacatcga

SEQ ID NO: 13806 - DNA, 201 bp, Homo sapiens
agaaaacacctgtttcagattacaaatttcttacttaattagacacatgcaactcttgagtttaaacataacactcacaattcgtcagccacccacggcarttctccaggtgtttgtgattatgtaatgccctaaaaaatcatctggattgtgtcaactctcagaagtactgcttcagttttttaaaaaatcctctacaga

SEQ ID NO: 13807 - DNA, 201 bp, Homo sapiens
atattctcctaagtaaatgaccagtctttcttacgagtgaattttaataataacgcttcttggaaccatgggcagcattaatttagatttcaagaggcagygtggtgcagtggttacctgcatggactctggagatagaatgcctgggttagaatccttaccatgaaatagctgtgtggccttgggcaagccagttacttt

SEQ ID NO: 13808 - DNA, 201 bp, Homo sapiens
gtttgcaaaatcctgccttccccagctcactttagactcctaggggagataacaagagatacttaaattgtactacgaaatttggtgaaaatggtagacgrcttttctttctgcaaagcactgagatctaagtacctcatcagttgttcacatgcatacaatttaatcgtaggagtctggaaggacccagacataatctag

SEQ ID NO: 13809 - DNA, 201 bp, Homo sapiens
tggaggcagaggactttcaaattgcatgaaagttagaaaataattaaggaggaacaagatgggtatagttgaagaagtttcatgttttgaggcagaagctrtcccttctaacagaaggatctgggagggcttcagggaaaatttgcccatttagtaaggccttaaccaataagtaagatttgactctctggatagtggagg

SEQ ID NO: 13810 - DNA, 201 bp, Homo sapiens
agaagatggtgtttaaagagaaaatgaacacatcataacaggtacaaatatgtatttacaaagctttttaaaaagtagtggtttatgtacttataggattrcacaaccatcactgctgattccagaacactttcatcagcccagaaagtaaacctgaactcattatcagtcttttctcattcttccttcctccagctccta

SEQ ID NO: 13811 - DNA, 201 bp, Homo sapiens
ctatctgtcttgcattagaattggggattgcctcaacctcccctcacatacccaagaggatcataaattgcttcagctgagatcattctctgtgttctctrtgtggagatagtaactactggctgaatttaattggataataaaaagttgaagacaatgaatatattaaataaaatgaatgattaaatatattactttgat

SEQ ID NO: 13812 - DNA, 201 bp, Homo sapiens
tatattgtgggatggctaaatcaagctaattaacatattcattacctcacatacttatttttttgtgatgagaacacttaaagtctctcttagccaatttygagtatacattgttattaactatagtcaccattttgtgcaatgaatctcttgaactcattcctcctgactgaaattttgcatcctttgaccaacatctct

SEQ ID NO: 13813 - DNA, 201 bp, Homo sapiens
tgggttcaatttttttagttatgttttaaattgacaaataaaaattgtatatatttatgatgtacaaaatgatgttttgataggtgtctatattgtgggayggctaaatcaagctaattaacatattcattacctcacatacttatttttttgtgatgagaacacttaaagtctctcttagccaatttcgagtatacattg

SEQ ID NO: 13814 - DNA, 201 bp, Homo sapiens
tatactctctttccagaaaagtgtacacacttgaaaaactgtgaacaattccagggagttcacaggccatcctggagcccatttatatccctaagattatrtattcctgcatccctggaactgatgcatattctgttaggatagaataaaagaaggagttcactggaaccagaatgcaactagaatgcactggaactagaa

SEQ ID NO: 13815 - DNA, 201 bp, Homo sapiens
ggccggggcattctgcacgctgagatgccttgctcagaggagccagcccatggcctacaactgtgggttaatttgaggagctcagagaagatggtggagcytcagtaccaggaactgaaaagtgaagaaatccctaaacccagtaaggatggtgtgacagttgctgtcatttctggagaagccctgggaataaaggtaagc

SEQ ID NO: 13816 - DNA, 201 bp, Homo sapiens
tgtctctgcttctctctgcacactggtgtgccaccctgggctgacatgctatctgcctcagcatgcatatcgccaaacatgcccaccacacagcccctaartttatttgcccacacttcaaagcaccagggagtaactctgattctcaattccaaattcccaggagagagaatctgattggttgagcatagatcaggcctc

SEQ ID NO: 13817 - DNA, 201 bp, Homo sapiens
cagcatcagaacactctctttttagactccgatatggggtcctccaagaaagttactctctcagtgctcagccgggagcagtcggaaggggttggagcgasggtccggagaagcattggcagacccgaggtatgctagttgggtggctgctccttgttttcttttcagaagggactggtgggatgttgatggtgattttgg

SEQ ID NO: 13818 - DNA, 201 bp, Homo sapiens
gtctgtctgtatctctctctctctctccctcccctatctctctctctgtcttacacacacacacacacacacacacacacacacacacacacacacacacagacttatccatgcttccactgcattaggtgacaaatacaaagtttgaggcttctctgtttagtgcctaacaattaattcaagtattataaagcactcatt

SEQ ID NO: 13819 - DNA, 201 bp, Homo sapiens
tacccttaacaattccaccattgactcagcctcccaaattagacacctgctcttctaccttgatgccaaagtcttctttaaaaattataaatcatattatrttactccctacttaaccttacagtgattcataatcacctgcaaaagtaggtccaaacttcttcctgtagattgcatccaaagcccagaagggtctggttt

SEQ ID NO: 13820 - DNA, 201 bp, Homo sapiens
tgtctgtctgtatctctctctctctctccctcccctatctctctctctgtcttacacacacacacacacacacacacacacacacacacacacacacacacagacttatccatgcttccactgcattaggtgacaaatacaaagtttgaggcttctctgtttagtgcctaacaattaattcaagtattataaagcactcat

SEQ ID NO: 13821 - DNA, 201 bp, Homo sapiens
ctatagacttattaggagcttggttacatttccctcttgttggttttgtgtttgcagtggatgactgcgggccggggcattctgcacgctgagatgccttkctcagaggagccagcccatggcctacaactgtgggttaatttgaggagctcagagaagatggtggagcctcagtaccaggaactgaaaagtgaagaaatc

SEQ ID NO: 13822 - DNA, 201 bp, Homo sapiens
gagtgcaatggcatgatctcggctcactgcaacctctgcctcccgggttcaagcgattctcctgcgtcagcctcctgagtagctgggattacaggcacccrccaccacgcccaactaatttttgtatttttagttgagatggggtttcaccatgttggccaggctggtctcaaactcctgacctcaggtaatccatccacc

SEQ ID NO: 13823 - DNA, 201 bp, Homo sapiens
tttgacacggagtttagctcttgtcgcccaggctggagtgcaatggcatgatctcggctcactgcaacctctgcctcccgggttcaagcgattctcctgcstcagcctcctgagtagctgggattacaggcacccgccaccacgcccaactaatttttgtatttttagttgagatggggtttcaccatgttggccaggctg

SEQ ID NO: 13824 - DNA, 201 bp, Homo sapiens
cagcctcaaacacttttttttttttgacacggagtttagctcttgtcgcccaggctggagtgcaatggcatgatctcggctcactgcaacctctgcctccygggttcaagcgattctcctgcgtcagcctcctgagtagctgggattacaggcacccgccaccacgcccaactaatttttgtatttttagttgagatgggg

SEQ ID NO: 13825 - DNA, 201 bp, Homo sapiens
cagctatagcagatgctgttggtaccccacccacacccctgggcccttacttcctgagtgcccactgaccaactaataatagccagtatctgtgtcacttygcttgaaggcttttctctgaaaccaatcagggcagcatgaaagtactggagaattaacattcccagaagctacctcacccatcagacaggataactctga

SEQ ID NO: 13826 - DNA, 201 bp, Homo sapiens
gttgttcataatagtctctaatgattctttgtatttctatggtctcagttattgtgtcttctttttcatttctgattttatttatttgggtcttctctcayttattcttagtccagctaaaggtttgtcaattttatttatcttttcaaaaaaccaacttgtcacttcattgatcttctgtatttttttgtctcaatttca

SEQ ID NO: 13827 - DNA, 201 bp, Homo sapiens
gaaagttgtttaacttaccagggttacgcattggtggatgtgggaccagaatcaaggtctcctcaatcctgctctccacgcttcaccccataccttttgtycaatgacaatgcagagatagcaccatctaacttgtcttttcaagtctaaatcccttagcgaacccagcagcagaagggacagagcgggtgggagagaggg

SEQ ID NO: 13828 - DNA, 201 bp, Homo sapiens
ttatttaactgaatgtcctctccaggttgctgcagatgacaggatttcattctttttatggctgaataatatttcattgtatatttatatcacattttcthcattcatctattactgggcacttaggttgattctacgttttgtacattgtgaataatgctgcaataaacatgggagtgtaggtatttctttgatatattg

SEQ ID NO: 13829 - DNA, 201 bp, Homo sapiens
tttgaattattcttttctagctgtttggaaatatacaaagattgttgtaaacaatagtcgtcctactgatctatcaaacaccagatcttatttcttctatwgtatatttgtactcattaatcaatctctctttatccctcccagacccctacccttcatgtcttctggtaaccaccagtcttcatgagatctttatgagat

SEQ ID NO: 13830 - DNA, 201 bp, Homo sapiens
ggcctcccaaagcactgggatttcaggcatgagccattgtgtctggtctatttttaaataatttttttaattaacacaatagatgtacatattttcagggyacatgtgacaatttaatacgttcatataatttgtaaagatcaagtcagtataattaggatattcatcaccttaaatattggtcttttctttatgctagaa

SEQ ID NO: 13831 - DNA, 201 bp, Homo sapiens
cattcaaggctgtatctagatctcagtctaggatatgtgctgcagtttccttctgccttctcattgttatccccaggttccagtctagaggccgagtaaayccagaaggtagcctgaggtgttggagtcaatcttgaggagcctgttccttcagctgctcccgtattgtcttgatgtaggctgacctagaatcacctgatt

SEQ ID NO: 13832 - DNA, 201 bp, Homo sapiens
gagctggcctgtggagtgcataagtgcaaactttaaagtttgcaattgggggcaaaccagccccagcccaaagggggtttctgtaatgtgaatacagaggycttgggcagaaagtgcagctgagcttcaggaaatgtctctgcttctctctgcacactggtgtgccaccctgggctgacatgctatctgcctcagcatgca

SEQ ID NO: 13833 - DNA, 201 bp, Homo sapiens
ggtaggctgaaaatttcccaaatctttaagttctgcttctcttttgattaacaattctgcctttaaattatttctctcttcttgcattttactatatgccrtcaagaggaacccggtctctcaacgctttgtgtacaaatagcatcagctaaacatccaatttcattgcttacaggttctaccttccacaaaacactagga

SEQ ID NO: 13834 - DNA, 201 bp, Homo sapiens
ccactgtatattacatttcatttatccattctattattaaagacatttggatgatttccagtttggggctattatcagttctgtcactattaaggtacttrtgcctgtctttaggtgactgttaggtatacacctatgagttggaatattgggtcatagattatgcatatattcgtctgtgctacacatggccaagcagct

SEQ ID NO: 13835 - DNA, 201 bp, Homo sapiens
ctctttttgacaccgggcaagggaggaagcagagcattttagggagaaagaattctgcaaaatactgtagaaaaaaaggagttgaggatttccccatcttyatctccttgcttctatgcaccaaggtccaacccaggtcccctctctttggtgcagccttctcagctgtcctggccgacaagcatctcaacttctgcccag

SEQ ID NO: 13836 - DNA, 201 bp, Homo sapiens
ttctgtctaagacttcatcagaatggcctttactgtccatatttctacaacaatctgttcaggattacttaggtattctttaagaagattgaggccgggcrcagtggctcatgcctgtaatcctaccactttgggaggctgaggtgggtggatcacttgagctcaggagtttgagactagcctgagcaacatggtgaaacc

SEQ ID NO: 13837 - DNA, 201 bp, Homo sapiens
ttgctcaatattatgcctgtgaaattcacctgagttgttgcatgtagttgagttcattcattctccttggtgtatagtattccactgtatattacatttcrtttatccattctattattaaagacatttggatgatttccagtttggggctattatcagttctgtcactattaaggtacttgtgcctgtctttaggtgact

SEQ ID NO: 13838 - DNA, 201 bp, Homo sapiens
gtggctcatgcctgtaatcctaccactttgggaggctgaggtgggtggatcacttgagctcaggagtttgagactagcctgagcaacatggtgaaacctcrtctttacaaaaaatacaaaaattagctgggcatggtggctggcacctgtagtcccagctacttggggcactgaggcgggcgcattgcttgaggccaggaa

SEQ ID NO: 13839 - DNA, 201 bp, Homo sapiens
tcctgtagcaatcatgaaatagctactagtgctctggacgattgtgcttaatgccatttgggtgtaaggcctcctaatttcattagtcttaccacttgtgyttgcaaggatagctgtttggagtcagcagtgcatggaacatgtgaactgagacaaatctgtttgaaaatctcaacttaagatttcaaatccactgtgtat

SEQ ID NO: 13840 - DNA, 201 bp, Homo sapiens
ttcagtgccggaacaaactgccctgtttttaatgaaaggaaatgggtgagtaggaggtggaggtagacacaaaaatgtttgttgtttccttttgttatcasccatgtcctgtcctgtcacccatgaaacctttacatagactgttggcattttgtcaatcttactcctgtttttctagtcggaggtaagtatttgtggtct

SEQ ID NO: 13841 - DNA, 201 bp, Homo sapiens
tgtaacctaatctcagaagtgacattgcatcagttttgctatattctactggttagacgcaagactctagccacagcccatactcagagagagggaattayatagggcaatacgggaggcaggatcaggcagacgtcttagagtcgacctccacacttatgatcttggttgaaagtaccacacatttttccatatggtcaa

SEQ ID NO: 13842 - DNA, 201 bp, Homo sapiens
tatttgcagctttgatagtcctggctgcctgtcatcagacatactggatggtaaaattatgctgtataaagtttattatgaagtaattcaaatcaaggtcmccatttgtcttttttttttttccacctttccaggtcaaattccatcataaactccaaggactgtctagattctttttatttgggtgctttgttgtatcaa

SEQ ID NO: 13843 - DNA, 201 bp, Homo sapiens
gtaaaaagttgcccattggctatgtagttttcaatgaggcttgctagatctgttcataaatgtagcccctggtagtatggcttaaaagacatatctaatcwgcaaattttatttttatttcagttaaaaaatctggatccgtttttactgtttgatgaatttaaaggaggtagaccaggaggatttcctgatcatccacat

SEQ ID NO: 13844 - DNA, 201 bp, Homo sapiens
ctactaatttttgtatgttgattttgtatcctgcaactttaccaaatttgtttattagtcttaataggttttttttggtggagtctttaagtttttcttastgtaagatgatgtaatctgtgaacaagactagtttgacttcttcctttcttatttgaatgccctttgtttttttttttctcttgcctagttgctctggcc

SEQ ID NO: 13845 - DNA, 201 bp, Homo sapiens
tttacttatatagctccttttgttttgttttgtttaagagacagggtttctctgtgtcacccaggctggagtaaagtggcacaattatagctcactgcaayctcgaactcctgtgcccaagagatcttcccaccccagcctcccaagtagctaggactacaggcactcatcattaatggtggctccttttaacagtgatat

SEQ ID NO: 13846 - DNA, 201 bp, Homo sapiens
gtcacttagggctcaattgcaatttaatttaaactactgaagggagaaaaggtaggatgacaccattttatgtaattgaatactatgccaccttctctccyacactagccctctctatatcccagcacaggtatgcccagggcagggtgcctttcagcttacagaacattcagtgagggaagagaatatgaacaccagtca

SEQ ID NO: 13847 - DNA, 201 bp, Homo sapiens
tcccaaagcactgggatttcaggcatgagccattgtgtctggtctatttttaaataatttttttaattaacacaatagatgtacatattttcagggcacaygtgacaatttaatacgttcatataatttgtaaagatcaagtcagtataattaggatattcatcaccttaaatattggtcttttctttatgctagaaacat

SEQ ID NO: 13848 - DNA, 201 bp, Homo sapiens
tgtgcattcacatatatgcaaatatcaggttattttgtcattttaataaaatggaatcataactactcttttacgtcctatttatttgactgaaaaatacycatggaaatccttcccagtttacttatatagctccttttgttttgttttgtttaagagacagggtttctctgtgtcacccaggctggagtaaagtggcac

SEQ ID NO: 13849 - DNA, 201 bp, Homo sapiens
cccgacatccacaaaaaaggtgaggggggttttgaataagatactgtcgcttttatgagcaacaaaactgcctttttgatactaccaagggtagctgtatkcctgtttcccaggttgtatgtgtctgagcatttattcaacccttggaaagccaagacagaacaagattctgccaggacagcatggtctaaagtgaaggct

SEQ ID NO: 13850 - DNA, 201 bp, Homo sapiens
cgcaggattcatctccttgtcctttttcaaaattgaaaacaaactagtttcaggctttaataatagcaaatataattaaccaagagattcaaggaaattastaagtccattatttctcaaattaaaataaatgttgtggtgctatatagttaaccaaataagtaaccatataacaaatgtactataatgggtattaaatta

SEQ ID NO: 13851 - DNA, 201 bp, Homo sapiens
tttcgcatcaggaagacaattttaggttaaattacaaggtgaggctgagaatatatatttcaagagattagtgtatttataaccaatacagagtcaacaayaacttccatctctgcaactaaaatacctagaaaatggaattagcaataattccagcacttcttcaactttaatattcatgtgaattacctgagggtcttg

SEQ ID NO: 13852 - DNA, 201 bp, Homo sapiens
tccttcctcctcctccttctttctccttcctcctcctccttctttctccttcctcctcctccttctttctccttcctcttcttcctccttctttctccttyctcctccttctttctccttcctcctctctttctccttcctcctcctcatttctttctttctctctctttctttctttctttctttctttcctcctcctcc

SEQ ID NO: 13853 - DNA, 201 bp, Homo sapiens
tcccaggttcaaatgattctcctgcctcagcctcccaagtagctgggattacaggcgcccgccactacgcttggctaatttttgtgtttttagtagagacrgggtttcatcatgttggccaggctggtctcgaactcctgacctcaagagatctgcctgcttcagcctccccaaatgctgggattacaggcctgagccact

SEQ ID NO: 13854 - DNA, 201 bp, Homo sapiens
cttgtttggatctcagcctgaagattgcaccctcagataagctgccttgaactgagcaggacacttcacgtgctcacagaaccctgtcattcttcgaagcrcaagcacaattataatggcaataatgatatgcatgacattgtttgtttaaggatttttctcctgatgagggctgtgtggaagatgctgttgatggcctgc

SEQ ID NO: 13855 - DNA, 201 bp, Homo sapiens
gatcccacctcctgcctccccctcatcctcagggattagtgagaaaggcagagagcagctggcagtattgcctcatggggatattagggaggggtctggakgctccttcgaacattccctgattttttttctattaacatattagagtcggacgcttagccatgactgcctcctcaaggaaagagatgagaaatttatcag

SEQ ID NO: 13856 - DNA, 201 bp, Homo sapiens
gcatggccgtgtgccaataaacttttacaaaaacaggtggcaggttagattgggcccccaggctgtagtttgccaactcctacattagaaggtttaacaasccttttcaaatgggagtagagggaaatctagacttcatggaagaaaaaaatctttaaagtatgcactggcctcctttcagatccttcaactaataatgct

SEQ ID NO: 13857 - DNA, 201 bp, Homo sapiens
cattctatctaaacctgtgctatcaaagggaattttctgtaaagatggaaatgttctataatctgcactacccaatatgatagccattagccggatggggmttttgagcacccaaaatgtggcaggtgcacctgaggtgctgaattttaaattttatttaattttttttgtttttgttttatttatttatttatttttttg

SEQ ID NO: 13858 - DNA, 201 bp, Homo sapiens
tgggtgcctgtagtcccagctactcgggaggctgaggcaggagaatggcgtgaacccgggaggcggagcttgcagtgagccgagatcgcgccacagcactycagcctgggcgacagagcgagactccgtctcaaaaaaaaaaaaaaaaaaaaaaaaaaagaaatatcttgaatatacagatgacgtttcacctgggctagt

SEQ ID NO: 13859 - DNA, 201 bp, Homo sapiens
tggtggtgggtgcctgtagtcccagctactcgggaggctgaggcaggagaatggcgtgaacccgggaggcggagcttgcagtgagccgagatcgcgccacwgcacttcagcctgggcgacagagcgagactccgtctcaaaaaaaaaaaaaaaaaaaaaaaaaaagaaatatcttgaatatacagatgacgtttcacctgg

SEQ ID NO: 13860 - DNA, 201 bp, Homo sapiens
gtaaagtctcagtctagcatttacactacttagcaaaaaaacaaataaaaggttataataagtaaaaggtcagtggtttccttggtttctgatttttttttccccaaaggctgaaagtatgttttttgcttcaagtagtaaaagataggcattttgaattcaataaaacttcattgaccagacttctctaattcagatttt

SEQ ID NO: 13861 - DNA, 201 bp, Homo sapiens
taaatgataaaaagcttcatgcaaattgtccacactattaacaaagctgcttcagagtcatccaatcaacagactcttagaatcacaggcctgactacacrggattaaacttgaaggaaatttgccatgcaacagtattaactactgatatatgagaagcttcatatgttgatacgttacctgtaagcctcaaaacaatct

SEQ ID NO: 13862 - DNA, 201 bp, Homo sapiens
agtgattttgaattatgaataatgtctctgtataagattaacctgagaaccagacagggcttagggaatcaaagggaagagcctgggttaccagaacctargaacttggtggaggagtcccatgcatttaatacatgtacttctaagaaggggcagcacctggctgatactaatatctttaagggggcctgatgaggtcgg

SEQ ID NO: 13863 - DNA, 201 bp, Homo sapiens
caagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctc

SEQ ID NO: 13864 - DNA, 201 bp, Homo sapiens
atcccttcatagatgttatctgccaacctattccattgtgaagttgctttttctctctatgccatacatattttgtgagaaagatactttaagactatgtwaaaatatcctgttcatcatcacactttatatttgttcacttatttgttaatatctgtatggattcatcgtttcttattttattcaacagattataatccg

SEQ ID NO: 13865 - DNA, 201 bp, Homo sapiens
ttaaaactgcaagctactctcccatcccacctcaccccacactcaatccctaatcaacttccatgctttttccccccatagcacttattcatcattctctrtaacttattttctttattttctgtatccaccctctcactctctttttttataagaattaagctccatgaggacaggatttttttttccgttttgtttact

SEQ ID NO: 13866 - DNA, 201 bp, Homo sapiens; identical to SEQ ID NO: 1863

SEQ ID NO: 13867 - DNA, 201 bp, Homo sapiens
tacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaaa

SEQ ID NO: 13868 - DNA, 201 bp, Homo sapiens
aattacctgttgggtactgtgctcattacctgagtgatgaaataatctgtatgccaaacacctgtgacatgcaatttatccatgtaacaaacctgcctgtstaccccctgaacctaaaataaaagttgggggaaagaaaaactgaatccaagggaaaacgagaaggtaaaaatgtttaatgatcatttatgccgaagtatt

SEQ ID NO: 13869 - DNA, 201 bp, Homo sapiens
atcacagatttatgtttaccgtgattgttagctaagatttaatctcaaatggttttaagttttttggtatttgtagtcttttttttttttttttttttttygtcctttttagggatctgcctgcctcagcctcctgagtagctaagactcgaggcacataccaccatacctggctaatttttaaatttttttttgtagaga

SEQ ID NO: 13870 - DNA, 201 bp, Homo sapiens
ttagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagcttta

SEQ ID NO: 13871 - DNA, 201 bp, Homo sapiens
aagtcctattaaattaggataaattaatataaattcctaatttaaaatgatcaaaaaaatattttttatcatataccttttgtgcctttaaaccaaaagtrtggtgaaagaattgtaatccaccaaaaaaaaaaaaatcatatcagtttttttgtggctttgtaatgctgacatggcttctttttctaccttttttagttc

SEQ ID NO: 13872 - DNA, 201 bp, Homo sapiens
gcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagaggtaagtgttagtaatacggctgagtcgagatgggc

SEQ ID NO: 13873 - DNA, 201 bp, Homo sapiens
agcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttct

SEQ ID NO: 13874 - DNA, 201 bp, Homo sapiens
caaagggaacagcatgtttaaaggcacagttatgaaatggcatgacatgttcataaaaaagtgaaaagttcagtgtatcttgtatatgtggggagtgtgcytgaggctagatatatggttagaagtataggtgctgctgtgtacaatgaggcatccctagcttttaggtggagggtaacataatcagctttgcatattagg

SEQ ID NO: 13875 - DNA, 201 bp, Homo sapiens
acatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaacc

SEQ ID NO: 13876 - DNA, 201 bp, Homo sapiens
gagactggaagtgggtcctctagggatgaggaggcattctgctggatgacttctaaaaatgttttctatggagtcatctgcctcattaacaagtttttgtyttagaagtctctttttgattttgtaaactgacatgatttctttttctgttatgactgtatgctgctttagtccttcactaggcccatcacacatttttac

SEQ ID NO: 13877 - DNA, 201 bp, Homo sapiens
ggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtat

SEQ ID NO: 13878 - DNA, 201 bp, Homo sapiens
ctaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaaatcacc

SEQ ID NO: 13879 - DNA, 201 bp, Homo sapiens
atgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtg

SEQ ID NO: 13880 - DNA, 201 bp, Homo sapiens
gacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatct

SEQ ID NO: 13881 - DNA, 201 bp, Homo sapiens
ttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgaca

SEQ ID NO: 13882 - DNA, 201 bp, Homo sapiens
tagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctca

SEQ ID NO: 13883 - DNA, 201 bp, Homo sapiens
agaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagag

SEQ ID NO: 13884 - DNA, 201 bp, Homo sapiens
tttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcc

SEQ ID NO: 13885 - DNA, 201 bp, Homo sapiens
acagtgatttgaaagactgaaatttgtccctgaatcaaatgttgggaattgagatgtttcatcatttgtgttattcaaaagaattttttgattggccccatttttttttttttttttttgagatggagtctcagtctgttccccaggctggagtgcagtggtgcgatcttggctcactgcaacctctgcctcccaggttca

SEQ ID NO: 13886 - DNA, 201 bp, Homo sapiens
attccttgccttctctttcatccacttttgatccatctgccaatcctattaactttaccttcaaaatggactccaaatccaaccacttctcatcagatctrtcttccacattaccaccaatgacttattttaataaaatacatatccccatcctgtttcttacttccttaaaaccttcctctgtctccttattgcctttgg

SEQ ID NO: 13887 - DNA, 201 bp, Homo sapiens
atttgtgttattcaaaagaattttttgattggccccatttttttttttttttttttgagatggagtctcagtctgttccccaggctggagtgcagtggtgygatcttggctcactgcaacctctgcctcccaggttcaagcgattctcctgcctcagcctcccgagtagctgggattacaggcacctgccactatgcccag

SEQ ID NO: 13888 - DNA, 201 bp, Homo sapiens
gagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgat

SEQ ID NO: 13889 - DNA, 201 bp, Homo sapiens
atcaagtgggcttcatccctgggatgcaaggctggttcaacatacacaaatcaataaatgtaatccagcatataaacagaaccaaagacaaaaaccacatrattatctcaatagatgcagaaaaggcctttgacaaaattcaacagcccttcatgctaaaaactctcaataaactaggtattgatggaacatatctcaaaa

SEQ ID NO: 13890 - DNA, 201 bp, Homo sapiens
tcaagtgggcttcatccctgggatgcaaggctggttcaacatacacaaatcaataaatgtaatccagcatataaacagaaccaaagacaaaaaccacatarttatctcaatagatgcagaaaaggcctttgacaaaattcaacagcccttcatgctaaaaactctcaataaactaggtattgatggaacatatctcaaaat

SEQ ID NO: 13891 - DNA, 201 bp, Homo sapiens
catgctaaaaactctcaataaactaggtattgatggaacatatctcaaaataaaagagctatttatgacaaacccacagccaatatcatactgaatgggcraaaactggaagcattccctttgaaaactggcacaagacagggatgccctctctcaccactcctattcaacatagtgttggaagttctggccagggcaatc

SEQ ID NO: 13892 - DNA, 201 bp, Homo sapiens
cctcttcaaggacaactacaaaccactgctcaatgaaataaaagaggacacaaacaaatggaagaacattccatgctcatggataggaagaatcaatatcstgaaaatggccatactgcccaaggtaatttatagattcaatgccatctccatcaagctaccaatgactttcttcacagaattggaaaaaactactttgaa

SEQ ID NO: 13893 - DNA, 201 bp, Homo sapiens
cttcaaggacaactacaaaccactgctcaatgaaataaaagaggacacaaacaaatggaagaacattccatgctcatggataggaagaatcaatatcctgraaatggccatactgcccaaggtaatttatagattcaatgccatctccatcaagctaccaatgactttcttcacagaattggaaaaaactactttgaagtt

SEQ ID NO: 13894 - DNA, 201 bp, Homo sapiens
agtcctgaaaactccaaaagggaaatatttactcagaggtctattcaaatttgcttagtctctgacgttttcctgtgtcgtacaaatccctcgtgcggcaraagtagtttgtctttactaggccaccgtctcgtcagcgttacggagtattttgtccgcctgccgccgccgtcccagatattaatcacggagttccaggga

SEQ ID NO: 13895 - DNA, 201 bp, Homo sapiens
ttctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcac

SEQ ID NO: 13896 - DNA, 201 bp, Homo sapiens
gcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagt

SEQ ID NO: 13897 - DNA, 201 bp, Homo sapiens
ttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatac

SEQ ID NO: 13898 - DNA, 201 bp, Homo sapiens
ttccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttc

SEQ ID NO: 13899 - DNA, 201 bp, Homo sapiens
ttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaa

SEQ ID NO: 13900 - DNA, 201 bp, Homo sapiens
agcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatga

SEQ ID NO: 13901 - DNA, 201 bp, Homo sapiens
aatggatagataataaaattgagacccacagactatttggatcctaaattttgtttcatcatgactcccttgttgaaaatactttattgactctgtgtaaygtaaataagataatttttgtgaagctcattgaatgcgtctgagctccttaactcaaaaaaggctaaaagttactgaaatagctatggttaagggtatatt

SEQ ID NO: 13902 - DNA, 201 bp, Homo sapiens
tgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagt

SEQ ID NO: 13903 - DNA, 201 bp, Homo sapiens
tggctctggaatactttataaagtccctacttctgcaaaaattaatctctttgtgattttcccctttcttgcaaatggttggaaaaacttttataataatraacttaggaactggtgttacaatatggtatccaatgtgaatcatttgcctgttattagtacttgttacttgaagccacgtttttgttccttttaagatgg

SEQ ID NO: 13904 - DNA, 201 bp, Homo sapiens
ctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaa

SEQ ID NO: 13905 - DNA, 201 bp, Homo sapiens
aattcaaccatctgtgtactcatactaatcaatgtaatataggttggcgctttttatgcacttaattttgccacctctctcacttccccaaagaaattagwctaatgtataacaataggcttcataacttaatttagaaaacataacaaaaataatttcgctcagtaagtttctgttgtagtagatattgttggtattaaa

SEQ ID NO: 13906 - DNA, 201 bp, Homo sapiens
cttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccct

SEQ ID NO: 13907 - DNA, 201 bp, Homo sapiens
ttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgaccccta

SEQ ID NO: 13908 - DNA, 201 bp, Homo sapiens
aagggaaatatttactcagaggtctattcaaatttgcttagtctctgacgttttcctgtgtcgtacaaatccctcgtgcggcaaaagtagtttgtctttamtaggccaccgtctcgtcagcgttacggagtattttgtccgcctgccgccgccgtcccagatattaatcacggagttccagggagaaggaacttgtgaaat

SEQ ID NO: 13909 - DNA, 201 bp, Homo sapiens
taacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaa

SEQ ID NO: 13910 - DNA, 201 bp, Homo sapiens
acatacacacacacacacacacacacacacacacccctacctgttttacagatactatccagttttatcatagaattgtgtctcaccctatccttaacacmcacacacacacacacacacacacacacacacacacacccctacctgttttacagatactatccaattttattatcatagaattgtgaatgacccctaaac

SEQ ID NO: 13911 - DNA, 201 bp, Homo sapiens
cacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataat

SEQ ID NO: 13912 - DNA, 201 bp, Homo sapiens
gtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcgg

SEQ ID NO: 13913 - DNA, 201 bp, Homo sapiens
cacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataatac

SEQ ID NO: 13914 - DNA, 201 bp, Homo sapiens
ataactgtgggacacttcctggtagcataattttatgtcgtcttctgatacccaggctgcattttccagacttatctgatcacttgacttaatgttctctracagagcattcagttctttgtagtcagttcaccgactcacttctatcgggtatcctgccctgtccctccctgaatgtgcccatttccattgttttccagg

SEQ ID NO: 13915 - DNA, 201 bp, Homo sapiens
ctagaagaaggtatagtggacatttttatagttgtatactttttgataaacatttccctgtgttatttagaatttgtattagagccaaatggagccaggtmcttgactaacaaggcaaagggaggtcacagtatggtaactattgcacagtataatgcttgaaaattattacagatttgtttacttttatctctttaagga

SEQ ID NO: 13916 - DNA, 201 bp, Homo sapiens
ttaattaatttctatgtttaattaattaaactatattttataggttaaatcatgaacttcgaggatgggttcatagacatgaagtagaaaggaccaagtcwagaagaatgacaaataatcaacagaaaacccgtattcttcaggtatgtttctgtttgtctttgaacaatagttggcgtatttgttggaaggcttctccca

SEQ ID NO: 13917 - DNA, 201 bp, Homo sapiens
caagtgttcataagcggtaaataaagcccttgggctaggtaatgtaagatccattgcaacctggagatgaagaactttgtaaaggggataattgttatcayccatcagagcatcagagttttaagatgatctagatttagtcccactaattatatttctcctaacttttatagacagagaaatcagtgaaaaatatgtatt

SEQ ID NO: 13918 - DNA, 201 bp, Homo sapiens
cttttaaggtgaagattcattttttaatagctttattgaggtataattgacatataataaactgcacatatttaacaccacattttatgtgtgatatgtakgtgtgtgtgtgtgtgtgtgtgtatatatgtatatacttatataggtgaaatcatcaccatagtcaaaataatcagcatccccatcagtcccaaaagtttt

SEQ ID NO: 13919 - DNA, 201 bp, Homo sapiens
tgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctg

SEQ ID NO: 13920 - DNA, 201 bp, Homo sapiens
atttttgtgcttttttttttttagtagagacggggtttcaccatgttggccagtctggtctcgagctcctgacctcaactgatccgcctgccttggcctcmtaaagtgctgggattacaggcttgagccactgcactcggcctgaagcattttatgatgctcactaccaagtgttcataagcggtaaataaagcccttggg

SEQ ID NO: 13921 - DNA, 201 bp, Homo sapiens; identical to SEQ ID NO: 1853

SEQ ID NO: 13922 - DNA, 201 bp, Homo sapiens; identical to SEQ ID NO: 1854

SEQ ID NO: 13923 - DNA, 201 bp, Homo sapiens; identical to SEQ ID NO: 1855

SEQ ID NO: 13924 - DNA, 201 bp, Homo sapiens
acttcaaataaaaactataatttttcatcatcccaacgaaatattgacctcttagaagccctgaatttggcctgttctaggactaagccaattgttatatrtaacagattgttctttgttaattttaggatcacctgctgttaccagctaccacccataacaagaccacaagaccaaaaatgtcaattgtgttaccagcaa

SEQ ID NO: 13925 - DNA, 201 bp, Homo sapiens
cagatattaatcacggagttccagggagaaggaacttgtgaaatgggggagccggctggggttgccggcaccatggagtcaccttttagcccgggactctytcacaggctggatgaagattggggtgagtgggatctgagaatgtaccagggtggctcgggttcgcgtctaaaggtttcttcctccctacttccgcccact

SEQ ID NO: 13926 - DNA, 201 bp, Homo sapiens
gccggctggggttgccggcaccatggagtcaccttttagcccgggactctttcacaggctggatgaagattggggtgagtgggatctgagaatgtaccagkgtggctcgggttcgcgtctaaaggtttcttcctccctacttccgcccactcgtggtgacaggtgtggaccaaccctgcctggggagtgaggcccctcgtc

SEQ ID NO: 13927 - DNA, 201 bp, Homo sapiens
tgctgtgactcctcatgccaggccgcctgccatatcagtgccctctctacccttcttggaccctgacattccaccaggctacttctctgcgtggatggtgrtcttgctttaccccatctagtggcttaggataaaattattcaggaaggaatattttctaagtgactatgaataagtatttatcatgagatattattttta

SEQ ID NO: 13928 - DNA, 201 bp, Homo sapiens
tcttttaagaacgatttttaatatatagagtataaatcagtgagaaaaatgcaaattaattcaaccatcaatggacaatatatacgaatagataattcacraagaagagtggtaaattttaaaaatgaaagtatcaatggctgtgtattcctgaagggatattccctctgaaagattactattttataactatgtgaaaga

SEQ ID NO: 13929 - DNA, 201 bp, Homo sapiens
agatcttgtggctggttacaggtagttcgagaatgatattcaagaatttaaagtgttatggttagacttttctgtggctcttacctcccttgagtatgagwtctaaaggaaaatgtcttatggcttcttataacttcccagtgtgtatacactgcggttgtgtgtgtgtgctgacacatgttaaactttggttattgtatg

SEQ ID NO: 13930 - DNA, 201 bp, Homo sapiens
tttcatctttccaacttccagaccttttttttctgctgataactcataccttttaattaaactttaatttaatttaatttaatttagtttcttccaactckgctctccaccacttccttgcccctagcacacacacaattaatcagcacttacaaaaacaaaaatttacctctttacaaaaggtacagggatagagtagag

SEQ ID NO: 13931 - DNA, 201 bp, Homo sapiens
cagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcc

SEQ ID NO: 13932 - DNA, 201 bp, Homo sapiens
agattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggccc

SEQ ID NO: 13933 - DNA, 201 bp, Homo sapiens
gattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggccca

SEQ ID NO: 13934 - DNA, 201 bp, Homo sapiens
attaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccac

SEQ ID NO: 13935 - DNA, 201 bp, Homo sapiens
cccaggctaggtaggcaccttcctctttattcttgttgcaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcata

SEQ ID NO: 13936 - DNA, 201 bp, Homo sapiens
gtaaaaaagctttaaatagtacctgactattttggggttagctgctgttttactgcaataatcatcattgccattgtccttaagacatcattgccaacttytaaggtaatttcttccttttggaccctgactcctagcacttctcacagtgctcaaagactttactctgcatttataacattcgtcttttatacagtttct

SEQ ID NO: 13937 - DNA, 201 bp, Homo sapiens
tcacaggaaaacagcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgta

SEQ ID NO: 13938 - DNA, 201 bp, Homo sapiens
gccggcaccatggagtcaccttttagcccgggactctttcacaggctggatgaagattggggtgagtgggatctgagaatgtaccagggtggctcgggttygcgtctaaaggtttcttcctccctacttccgcccactcgtggtgacaggtgtggaccaaccctgcctggggagtgaggcccctcgtcactcctgttcgtg

SEQ ID NO: 13939 - DNA, 201 bp, Homo sapiens
gcgtctaaaggtttcttcctccctacttccgcccactcgtggtgacaggtgtggaccaaccctgcctggggagtgaggcccctcgtcactcctgttcgtgyccctggaagagtctgggagtatcgttcggcttctgtcctggccacagggagagtagaatattgtctaactggagttaactgtcgtttttcactattccca

SEQ ID NO: 13940 - DNA, 201 bp, Homo sapiens
gtttttgttttttttagagtttcttatattgcatcaaataaaagagtgtgctgaattgcacatctagtctttggaggaaaattagggtaaggcttactacrttagaatctaagtgaaaaggtttttgaaagtgaagtggtttgatgaaaagcaaagtatgcatacctccctcttctttactccttctttagaaccaaccct

SEQ ID NO: 13941 - DNA, 201 bp, Homo sapiens
aaccctaattattgcaagaaagtttcaggacaacaggttcaggctagtaatttaagttacatacttaatggtaaatagcttctaccattaagtatgaaagytagtagccattttgtaatcagtaaatgtaggacagtagaaattgcattgtattgcaattctaggcccacctttggccctagggatgggtgactttggaaa

SEQ ID NO: 13942 - DNA, 201 bp, Homo sapiens
  misc_feature (1)...(201): n = A,T,C or G, or insertion/deletion polymorphism (see Tables 1-2)
tgattttaagatgtgtatgttttattcttttaatattcttttgctgatttgaaacctacaggaaaacaattttgataatcttgattttgatttggatttgntgccttgggagtcagacatttgggacatcaacaaccaaatctgtacaggtaattatgtgtttcactggtaaaagttttaaaaagatcaattttattttgt

SEQ ID NO: 13943 - DNA, 201 bp, Homo sapiens
tggggttattgggctattctggtaggttaaaagattcctggtgttatgcattctacttctggtatggcaattatgtaaacaaatttcttgccaaaaatggrtatgaggagtttcatagttatgtttcagtagtgtaatgaatgaacagttcatatcagaaatagaaatagtgattttgaattatgaataatgtctctgtat

SEQ ID NO: 13944 - DNA, 201 bp, Homo sapiens
tgaatgaacagttcatatcagaaatagaaatagtgattttgaattatgaataatgtctctgtataagattaacctgagaaccagacagggcttagggaatsaaagggaagagcctgggttaccagaacctaggaacttggtggaggagtcccatgcatttaatacatgtacttctaagaaggggcagcacctggctgatac

SEQ ID NO: 13945 - DNA, 201 bp, Homo sapiens
atataccccctccccacatatatatataatttgtaacacaagtggaaacatactagatatattgttttctgcatctttcattttcactcgttatattttgrtgaccttagcttccatatctgattgaattttaaaagtagattttaccttctttcttgttcattttattataagtttttattgtccagtgggtaaaacctt

SEQ ID NO: 13946 - DNA, 201 bp, Homo sapiens
atatctttaacaggatggcatagacttactctgcattttgagttatttttcctttggtatagatggatcatgctgatagtcacttattacttaatatatakatacagtttctaatatacctttcctttgaagttaccctgaagtgtttttctgtttatatgtgggtctcctccttttctatgcaatttgctgcttaaggat

SEQ ID NO: 13947 - DNA, 201 bp, Homo sapiens
aactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgaca

SEQ ID NO: 13948 - DNA, 201 bp, Homo sapiens
cagaaagtcctgaaaactccaaaagggaaatatttactcagaggtctattcaaatttgcttagtctctgacgttttcctgtgtcgtacaaatccctcgtgyggcaaaagtagtttgtctttactaggccaccgtctcgtcagcgttacggagtattttgtccgcctgccgccgccgtcccagatattaatcacggagttcc

SEQ ID NO: 13949 - DNA, 201 bp, Homo sapiens
gtcttctagttctcagatgtctcccctttccttatatggtgaaaactctaatagtctctcttcagcggagccactgaaggaagataagcctgtcactggtyctaggaacaagactggtattactctatctcctaacttctgttatttctatttcagattgagcttaggttccatttcttaaaagaaaatgctggattaaat

SEQ ID NO: 13950 - DNA, 201 bp, Homo sapiens
caaccatattagtagttaaattcagtgggctaaacacatcaattaaaaggaagaaattttcaaactagatttttttaaaaaggaaagatccaactatataktgtttataagaaataacactttaaatatgaagacactgacagatggaaaataaaggtgaaaaaggatgtatgccatgcaaacatgaagcattaaaaagct

SEQ ID NO: 13951 - DNA, 201 bp, Homo sapiens
ttcccactggggaagtaccgggtgatctttttgtgtggctaacactggacgtctttaggaggtttagagcaaaatggctgggaccgccaaaaaggctacargctatttcctgagtgtgaaatgtgggcggtgagcacaatggagtgggtttttgtgtgtttggtgtatatgagagaatgtggttatatacaagaaattcta

SEQ ID NO: 13952 - DNA, 201 bp, Homo sapiens
ggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatatgtgcaggttaccatgctaaggattt

SEQ ID NO: 13953 - DNA, 201 bp, Homo sapiens
ttataaataaggtacttttatacttagaaaaattgtttttgatatgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttattt

SEQ ID NO: 13954 - DNA, 201 bp, Homo sapiens
aagtatatcttaaatcaaaacttgaatttgtacttattaggatttcaagctcatttttcctctggtgaccttgccagcattatcagatttgtattaagtgwcaaaagtttcctcttgtcaaagtgtaaaccttggctcattcttgggccatctgttgtacactaatagttttgatttattcttctggctgacatgcgtatt

SEQ ID NO: 13955 - DNA, 201 bp, Homo sapiens
tcatcattctctataacttattttctttattttctgtatccaccctctcactctctttttttataagaattaagctccatgaggacaggatttttttttcygttttgtttactactgtgtccccctgtgcctgtcatgtggtaggaattcactaaatgtttgttgaataaatgaatatttaatgttcaggcattatatata

SEQ ID NO: 13956 - DNA, 201 bp, Homo sapiens
ttgagttatttttcctttggtatagatggatcatgctgatagtcacttattacttaatatatatatacagtttctaatatacctttcctttgaagttaccytgaagtgtttttctgtttatatgtgggtctcctccttttctatgcaatttgctgcttaaggattatactcattaatttttgtttttattatgctacagga

SEQ ID NO: 13957 - DNA, 201 bp, Homo sapiens
caactgaagaaagaaaatggaacactgaagcggcagctggatgaagttgtgtcagaggtaagtgttagtaatacggctgagtcgagatgggctaaagtatyctctggattaataaatagagaaacttttacattttaaattaaattatgtaaaataatagtgctaggaaaaggagggtataataagtcctaaaacatttgc

SEQ ID NO: 13958 - DNA, 201 bp, Homo sapiens
gtcctaaaacatttgcagtaaggataaagcatttgaaggggaccctttgaattgtactccccaatctacatagaaaagttgtctccttttcctaggtttckcctcattcattgccttagcaccctcttttctggctaagtgaatcacactgaggcttctaaagtgccctgccatattttcccttttaaaaaagaaaacaat

SEQ ID NO: 13959 - DNA, 201 bp, Homo sapiens
atgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtg

SEQ ID NO: 13960 - DNA, 201 bp, Homo sapiens
aaaagttttagaaatttaagaagtatagaactgtagaaaaaaggaaaattactcagtgattcataaaagttttagaaatttaggaagtatagaacagtagraaaaaaagaaaattactcagtggtaactatcctctttatgattcttgcctgtcttttggatatatctatattctttctattgtatatagagattatatta

SEQ ID NO: 13961 - DNA, 201 bp, Homo sapiens
aatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatgtttgtcaaaaatgtgtctacacaaagta

SEQ ID NO: 13962 - DNA, 201 bp, Homo sapiens
ttttagaaatttaagaagtatagaactgtagaaaaaaggaaaattactcagtgattcataaaagttttagaaatttaggaagtatagaacagtagaaaaaraagaaaattactcagtggtaactatcctctttatgattcttgcctgtcttttggatatatctatattctttctattgtatatagagattatattatgaat

SEQ ID NO: 13963 - DNA, 201 bp, Homo sapiens
atacaatgtatctgagtaccaggtgttactgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagc

SEQ ID NO: 13964 - DNA, 201 bp, Homo sapiens
atccttacatgtagctgtctcatccactaatatataaggaaagaatttcttcctggggcagtttttcattaaaaacaggttctctttgaatcagatggctrtgaatgtcagtttgccatattatctctacttgtttaatatttttcttttgcaaatgagatggatgcctactttgggaacattttttatttctattacatt

SEQ ID NO: 13965 - DNA, 201 bp, Homo sapiens
cacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagag

SEQ ID NO: 13966 - DNA, 201 bp, Homo sapiens
tatattctagcaatagtaccatatttgggtatgcaccccttactggtcccttataaaaattattaacactgtcatatatacggcatggattataagggtarccttaagtaatagggacttattgtaagttatgtgagattaaagaagcacaggaaactggctcagaatccaaataatccctctgtgcttgtgcttcattgg

SEQ ID NO: 13967 - DNA, 201 bp, Homo sapiens
aaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgg

SEQ ID NO: 13968 - DNA, 201 bp, Homo sapiens
accctgagggcaggaaccctctatcttagtcatgactttgttcccaatacatggtatatcaggcatgtagcaggtattcaataaacattgaatgaataaaygaacaaattaattagataccaaatccatcagtttgacactatattctaaattagtttatatagtcaccgtaatgtgataaagaaattgtgatagtctagt

SEQ ID NO: 13969 - DNA, 201 bp, Homo sapiens
ggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgac

SEQ ID NO: 13970 - DNA, 201 bp, Homo sapiens
ggtatgatagtcacactgtattattatatctttatgcagtagcttttatttctgctgacatcatcaggcatctttgaaatttcttttttttttaacacttygaaatgctgtgaagcaaagtatcatccctctctttcctcaccctcttctcttccttaacacctttcttcagttctagctgttggcagctagatgcaactt

SEQ ID NO: 13971 - DNA, 201 bp, Homo sapiens
gagtaacatcttgaacccagatctcctgtctccaaattttgtgctcattccactatttcacattaaaacctgaagatctccctgctcttttcatcttaacrtaatttcagctttttgtgtgtggctctccaagccacagagcagcagcagcttttgaggataagaagcagtttcttttaaggataagaagcagtatggttc

SEQ ID NO: 13972 - DNA, 201 bp, Homo sapiens
tttttgaaaatagagtaaccatttgttaaaccgtatataccattgaagatgttttgggtataaaagggaatttccataataattacatagtaatcttttakagccaaagttatgaagaagatcaggatttgggaaaattgtggtcaatatttgattttccttttctgtttgatagccttatctaaattcccctagcttgaa

SEQ ID NO: 13973 - DNA, 201 bp, Homo sapiens
aaattttgtgctcattccactatttcacattaaaacctgaagatctccctgctcttttcatcttaacgtaatttcagctttttgtgtgtggctctccaagycacagagcagcagcagcttttgaggataagaagcagtttcttttaaggataagaagcagtatggttcttacctggtaagatggcttgaattcaaaattga

SEQ ID NO: 13974 - DNA, 201 bp, Homo sapiens
agtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcag

SEQ ID NO: 13975 - DNA, 201 bp, Homo sapiens
atacatgtaattatcaagtttttaaaacatatagaacactactattgtttaaacagtttataaataaggtacttttatacttagaaaaattgtttttgatrtgtgcaggttaccatgctaaggatttgaacaccttcagtaccctatttgtacttgcgtctatgcctagcatttttgttacgtgcatggatctgcaaagga

SEQ ID NO: 13976 - DNA, 201 bp, Homo sapiens
attttgagaacagagctgacagaattttctggtagattgattatggagagtgaggaagagaagtaaataattaagtaataatgatcccaaggtttttggcytgagcaactgggaaaatccaattgtcattaactgagatgaggacaaagcagtaggaggtttggtggggttgatgaggagctcattttggatatgttaggt

SEQ ID NO: 13977 - DNA, 201 bp, Homo sapiens
ttttaaaaaacaactgctgattgctgacgtctatgagggaagaaaaattaggggctgttattttcctatcaaccatcactctcattaacaagaacaggaawcattacgaataaataaaactcttacatcataccagaaaaaagaacagctgaatcccctaaaggatttcatattctatcatcagacaacgaaagaaaataa

SEQ ID NO: 13978 - DNA, 201 bp, Homo sapiens
taaccttccactccagcacagtttttcttgctcctccccatgttgatgctcatgcatgcctcagggcttttccatcttcctgaaaacctcttacccagatygttacatggctcgcttcacttcatttacttctctgctccagcatcactaccataaagaagcatcccaccagcactcttcacaatacagcagggaccatca

SEQ ID NO: 13979 - DNA, 201 bp, Homo sapiens
tcttcacttttctccccaaactcctacccatcttaggtctcccaggtgctcatgccagaaacttagaacagtcttgattccttgccttctctttcatccayttttgatccatctgccaatcctattaactttaccttcaaaatggactccaaatccaaccacttctcatcagatctatcttccacattaccaccaatgact

SEQ ID NO: 13980 - DNA, 201 bp, Homo sapiens
tgatcatgggaacaaactcccattgggagagcatcacctctgccttacatatctgagaaaagcccttgtttattgtaccctatcaactgaatctgctgggstatatattaaagtgggtattttaggccctgcttaaaaaataaaggttaaattgagcatattcattgctctgttaggattacataatgcctgatagtgcaa

SEQ ID NO: 13981 - DNA, 201 bp, Homo sapiens
cttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaactgggtaa

SEQ ID NO: 13982 - DNA, 201 bp, Homo sapiens
gatagatagaaacgtttatgctgagcccagggacaaatttgtgttagggagatgaggaagaaccagcaaggtaggtcaaccactgaggtgggaggaaaacygggtaagtgtgatattctggaagtcaagtgaagaaaatgcttcagttaaaatgaaaggatcaactatgttaatgctgttgataggtcaagtaagatgagg

SEQ ID NO: 13983 - DNA, 201 bp, Homo sapiens
ttttgtttttattatgctacaggaggagttggatttgtcttctagttctcagatgtctcccctttccttatatggtgaaaactctaatagtctctcttcascggagccactgaaggaagataagcctgtcactggtcctaggaacaagactggtattactctatctcctaacttctgttatttctatttcagattgagctt

SEQ ID NO: 13984 - DNA, 201 bp, Homo sapiens
atttttgagtgcttgccgtacacaagacattgggctgaatattgtggaaaatacaaagatgtgagaaataggaagcaatataaaataaattatgtgagtgraacagtctaagtactgtaatatatgctttactttgagctgttgagtattataaagatgaacatggaattggtgtcagactatgagtttgtatttaggaaa

SEQ ID NO: 13985 - DNA, 201 bp, Homo sapiens; identical to SEQ ID NO: 1872

SEQ ID NO: 13986 - DNA, 201 bp, Homo sapiens; identical to SEQ ID NO: 1874

SEQ ID NO: 13987 - DNA, 201 bp, Homo sapiens
tggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcgga

SEQ ID NO: 13988 - DNA, 201 bp, Homo sapiens
gaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaatttt

SEQ ID NO: 13989 - DNA, 201 bp, Homo sapiens
tctagggccagcttagcagggtgattctgcttccggatctctcttgagattgaagtcaagctgttgactggggctgaagacttgattgggtctcagggatrtgcctccacattcactcacgcagcaggtggcctctttctggggctgctcacaacatggcttccccaaagcaactgttccgtaagagtgagaaagcaagtg

SEQ ID NO: 13990 - DNA, 201 bp, Homo sapiens; identical to SEQ ID NO: 1877

SEQ ID NO: 13991 - DNA, 201 bp, Homo sapiens
taatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctc

SEQ ID NO: 13992 - DNA, 201 bp, Homo sapiens
aacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaa

SEQ ID NO: 13993 - DNA, 201 bp, Homo sapiens
gggattacaggcgtgagccaccgtgcctggccagaaaatgttctttgtcatctctccacctccccaggctaggtaggcaccttcctctttattcttgttgyaccatatgcatacccgtatcacacctatcctggatgataccagtttacatagctgcctcttttcctagatgcaagtgccttggtcaggggcaagggctta

SEQ ID NO: 13994 - DNA, 201 bp, Homo sapiens
ttgtggattccatatttgctaattcacctactaaaatctgctaaaatgtatttgtaacccctaatattagcagtgcttttgtcatcatttgcaaacatgcrtagatgctccctggtgaggttgaacaaggcagtgttctgccttttagtctcagctatataaacaaggtccttttcacagtccacatttttcatatttttg

SEQ ID NO: 13995 - DNA, 201 bp, Homo sapiens
aaaattcttgccctaaatgctttttttttggccttatcattagatggaacttgtcatgtttttctttcctagtcattaaatgaatagagcatttactgtgraaggggtgcttggtattctttattcttaaaggaattccaatgcaagaaaaagaattttgttttaattttactgtctttgttcatttggagatgtgtagtt

SEQ ID NO: 13996 - DNA, 201 bp, Homo sapiens
ttttttggccttatcattagatggaacttgtcatgtttttctttcctagtcattaaatgaatagagcatttactgtggaaggggtgcttggtattctttawtcttaaaggaattccaatgcaagaaaaagaattttgttttaattttactgtctttgttcatttggagatgtgtagtttaaagtcttatttcattctgtgc

SEQ ID NO: 13997 - DNA, 201 bp, Homo sapiens
gtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccggttacctctttcagttgctaagagtatcccaaactctta

SEQ ID NO: 13998 - DNA, 201 bp, Homo sapiens
ggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttc

SEQ ID NO: 13999 - DNA, 201 bp, Homo sapiens
aaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaa

SEQ ID NO: 14000 - DNA, 201 bp, Homo sapiens; identical to SEQ ID NO: 1856

SEQ ID NO: 14001 - DNA, 201 bp, Homo sapiens
tgtgtgtagttttgtatttctttcttcctatacattgttttgtatagttttgtatttctttcttcctatacattagccactatggaaattgtaaaagcacktattcattagattataagataatgtacgtaagggaagtttttattaaaatgtctctagacagacacctctgtatagataggtttgtctcatatacttgag

SEQ ID NO: 14002 - DNA, 201 bp, Homo sapiens
ataaatggctgcatgaatcattgaaagaaacttccctgcttttttaaaagagcaactagaagtatttactttttgaaaatagagtaaccatttgttaaacygtatataccattgaagatgttttgggtataaaagggaatttccataataattacatagtaatcttttatagccaaagttatgaagaagatcaggatttgg

SEQ ID NO: 14003 - DNA, 201 bp, Homo sapiens
ctcacataatgtaggtactagtaaattttctgtctggtagcaaaaacctcagtatatgaagaagatggaaacgaaaagccctttgaactaacctgcagtcraaccagttcacattttgattgataaatataattaaaccttcaaatacaattataaaacaaaacactagaattttggggggattccagataagtttcaata

SEQ ID NO: 14004 - DNA, 201 bp, Homo sapiens; identical to SEQ ID NO: 1865

SEQ ID NO: 14005 - DNA, 201 bp, Homo sapiens; identical to SEQ ID NO: 1866

SEQ ID NO: 14006 - DNA, 201 bp, Homo sapiens; identical to SEQ ID NO: 1869

SEQ ID NO: 14007 - DNA, 201 bp, Homo sapiens
tactgatctttgagaaaaaataaaggacccagtgagttacagaaatagatgctggaccatccctgttctctgcattagaaaactatactgctaacacatakaaataactgctcaccttgaactgaaattatccatgggaagccaaatacatccgtctatctatccatcaatcgatagatagatgtatttgtctcattctgt

SEQ ID NO: 14008 - DNA, 201 bp, Homo sapiens; identical to SEQ ID NO: 1870

SEQ ID NO: 14009 - DNA, 201 bp, Homo sapiens
cccacctcagacttaccatgtaagaaattgtttttcaagagttgaggaatgtgggtatttatattataaaatcctgcaggtgattctgatatgtatctttygttaagaacttctgttttagaaggacctaccattggcactgtttttgcttctgatcccagcttcctatgattaaatgctttctgaaagatacatagttag

SEQ ID NO: 14010 - DNA, 201 bp, Homo sapiens
gctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtc

SEQ ID NO: 14011 - DNA, 201 bp, Homo sapiens
cattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccc

SEQ ID NO: 14012 - DNA, 201 bp, Homo sapiens
aaaggcagtacagaactaggttgttgccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgt

SEQ ID NO: 14013 - DNA, 201 bp, Homo sapiens
aattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaagtactcagaattctcccatgttcac

SEQ ID NO: 14014 - DNA, 201 bp, Homo sapiens
acttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattggtagattagatctgtctaataatttttaactct

SEQ ID NO: 14015 - DNA, 201 bp, Homo sapiens
tatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcatggtacataagtgcc

SEQ ID NO: 14016 - DNA, 201 bp, Homo sapiens
aaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatcca

SEQ ID NO: 14017 - DNA, 201 bp, Homo sapiens
tgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatatt

SEQ ID NO: 14018 - DNA, 201 bp, Homo sapiens
accatctagtacattttagagccttgattcagaaatcagaattttagcataagtgaatgggttcttataaaatatcctgatccttgggctttacaaaataktgttataaaaattactgccaaagtgcaactaatattttggttgagagagattcttagaattcagacatagccttagaatgggaagtattttgggaaaaca

SEQ ID NO: 14019 - DNA, 201 bp, Homo sapiens
ggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtt

SEQ ID NO: 14020 - DNA, 201 bp, Homo sapiens
tccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttt

SEQ ID NO: 14021 - DNA, 201 bp, Homo sapiens
taagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattg

SEQ ID NO: 14022 - DNA, 201 bp, Homo sapiens
agaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggcta

SEQ ID NO: 14023 - DNA, 201 bp, Homo sapiens
atggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacag

SEQ ID NO: 14024 - DNA, 201 bp, Homo sapiens
ttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgg

SEQ ID NO: 14025 - DNA, 201 bp, Homo sapiens
tacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaa

SEQ ID NO: 14026 - DNA, 201 bp, Homo sapiens
ctggctaacacggtgaaaccccgtctctactaaaaatacaaaaaaattagccgggcgtggtggtgggcacctgtagtcccagctactcaggaggctgaggygggagaatggcgtgaacctgggagacggagcttgcagtgagccgagatcgcgccactgcactccagcctgggtgacagagtgagactccatctcaaaaaa

SEQ ID NO: 14027 - DNA, 201 bp, Homo sapiens
ggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaa

SEQ ID NO: 14028 - DNA, 201 bp, Homo sapiens
acgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttc

SEQ ID NO: 14029 - DNA, 201 bp, Homo sapiens
ctggtcacataataccacttgattttcgcctcaattaccccgttactgtgttactacctctgtaccagcagcattgtgcatgtcttaagctcattgaagayatgatgaaccatgtgttattgtatcgcttattccaaattaattgctcaataaatggtgattagacaaatgtgaattaccatcctgtctctgtagaaaatc

SEQ ID NO: 14030 - DNA, 201 bp, Homo sapiens
actgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttaggccataaattcacagtttgcttatccacttac

SEQ ID NO: 14031 - DNA, 201 bp, Homo sapiens
cctcatttaactttaattacctcctaaagactgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtg

SEQ ID NO: 14032 - DNA, 201 bp, Homo sapiens
gctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgat

SEQ ID NO: 14033 - DNA, 201 bp, Homo sapiens
gatacagatttaagatgtatgtatatatgcatatatatttaaagatactttctgagggagtttctaaggggaaaattggaagattaataaacgagccttaraaaacataagaagaaattatttaacatttgggttttagaaggccttatttaatcatttgattttaacttatttagtttgagcagtgtgttttcaaacctc

SEQ ID NO: 14034 - DNA, 201 bp, Homo sapiens
catcttggttgcttccaacttttggcaattatatataaaactgctgaaaacatttgtgtgcaggtttttgtgtggacatgcattttccaattgtttgggtraatatcaaggagcacaattgctggattgtgtggtaagaacatgttttttgtttgttttgtaagaaattgccaaactgtcttccaaagtggctataccatt

SEQ ID NO: 14035 - DNA, 201 bp, Homo sapiens; identical to SEQ ID NO: 1860

SEQ ID NO: 14036 - DNA, 201 bp, Homo sapiens
acttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatagaaataactgctcaccttgaactgaaatt

SEQ ID NO: 14037 - DNA, 201 bp, Homo sapiens
gagacggggtttcactacattggccaggctagtctcaaactcctgagctcaagtggtccacccacctcggcctcccaaagtgctgggattacaggcatgarccaccacacctggctaaggctgcttaattttttgatgtgaagatccaaataagagaaaaaagtgaaggagattgattttttaaaaaatggtttttttatg

SEQ ID NO: 14038 - DNA, 201 bp, Homo sapiens
aaaggtcattttgatacactgtatgtgcaaaagcagtttaccaaacagaattacatacagtgtaatcctttttttcttatataggaaaatacccacttccycccacttaaaaaaataccaaacaccacaatgtgtgtatgtttagcctacaaatcatattttttttgcctaggaagtattgaataatttaaatattttata

SEQ ID NO: 14039 - DNA, 201 bp, Homo sapiens
aggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccgcccttctttatctacctcttttcatctttccaacttccagaccttttttttctgct

SEQ ID NO: 14040 - DNA, 201 bp, Homo sapiens
gttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtatt

SEQ ID NO: 14041 - DNA, 201 bp, Homo sapiens
ctgggaataatttatatcaccgattatagaaagtggacttagtgctgagagacagtgaataaataaccagcacattctcctatctaaattcctctctaccyctgcactacctattcctcttcattttatgtatttacttatactgtttcatgcctgtttgccttcatagaatgtgggatacacaaagtcagtgttctggtt

SEQ ID NO: 14042 - DNA, 201 bp, Homo sapiens
tgtgcccatttccattgttttccaggtttcccttttcaaactgttaacagtcttctcttctttgaagactttaatttaattccttaggtgttcagtaagtmggatagattttgttggcaatagagtgaaacactactgtctgatagtgtttcgttctgtgacagttgctgttttggatgttcaagtacttcactgatttac

SEQ ID NO: 14043 - DNA, 201 bp, Homo sapiens
ctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatca

SEQ ID NO: 14044 - DNA, 201 bp, Homo sapiens
ggcagtcgtgtccattgtgaactccaataagaaagattaaaaagaaggaagaaaaagtccgctgtagaaatgaaaaaacaaatttatccattgtgacatcrtttagaaatagcagtcagaatttaaccaagaaagtctggctctatgttcttgatcatttccctctattgcctgtttaagatatccaaatatcatatcttt

SEQ ID NO: 14045 - DNA, 201 bp, Homo sapiens
ttgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacac

SEQ ID NO: 14046 - DNA, 201 bp, Homo sapiens
ttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaatt

SEQ ID NO: 14047 - DNA, 201 bp, Homo sapiens
attttaccttctttcttgttcattttattataagtttttattgtccagtgggtaaaacctttcctccatgttttccagttaaagatattaaggcagaaccycagccactttctccagcctcctcaagttattcagtctcgtctcctcggtcagtggactcttattcttcaactcagcatgttcctgtgagtagccagtctt

SEQ ID NO: 14048 - DNA, 201 bp, Homo sapiens
attaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtatgtgtgtgtgtgtgtgtgtgtgtatatatgtatatacttatataggtgaaat

SEQ ID NO: 14049 - DNA, 201 bp, Homo sapiens
attgtccagtgggtaaaacctttcctccatgttttccagttaaagatattaaggcagaacctcagccactttctccagcctcctcaagttattcagtctcrtctcctcggtcagtggactcttattcttcaactcagcatgttcctgtgagtagccagtcttttacaatgattttggttataatatgctatctggaaaata

SEQ ID NO: 14050 - DNA, 201 bp, Homo sapiens
agcctcctcaagttattcagtctcgtctcctcggtcagtggactcttattcttcaactcagcatgttcctgtgagtagccagtcttttacaatgattttgsttataatatgctatctggaaaatatgtatatggaggaggcagttaacatttattgaatactactatgagttatattgtctcatttattgagggaactgag

SEQ ID NO: 14051 - DNA, 201 bp, Homo sapiens
tacaatgattttggttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatt

SEQ ID NO: 14052 - DNA, 201 bp, Homo sapiens
agtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactca

SEQ ID NO: 14053 - DNA, 201 bp, Homo sapiens
atgggagggacagtgtgagatttatgcatcttgaattagagatgtcattggtgggtatttttgtgtatctcttgtaacagattggtgtgtatttctgtgtrtctcttgtaacggaataccaagtaattcttgactgatgaatttcattttctttcctttttgttagatactaccagccccctcacaagttagtgtcccttt

SEQ ID NO: 14054 - DNA, 201 bp, Homo sapiens
taatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagat

SEQ ID NO: 14055 - DNA, 201 bp, Homo sapiens
aagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagg

SEQ ID NO: 14056 - DNA, 201 bp, Homo sapiens
gctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgctttttttttatttaactgtgtctc

SEQ ID NO: 14057 - DNA, 201 bp, Homo sapiens
taaatagtctttcctccactgaacatccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaattt

SEQ ID NO: 14058 - DNA, 201 bp, Homo sapiens
taactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatcca

SEQ ID NO: 14059 - DNA, 201 bp, Homo sapiens
tctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatac

SEQ ID NO: 14060 - DNA, 201 bp, Homo sapiens
tagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaa

SEQ ID NO: 14061 - DNA, 201 bp, Homo sapiens
gattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataat

SEQ ID NO: 14062 - DNA, 201 bp, Homo sapiens; identical to SEQ ID NO: 1867

SEQ ID NO: 14063 - DNA, 201 bp, Homo sapiens
gctttcagctgggacctgagcctgggatgtgggccagggttcttggtttttcttcatttggacctctccacagctgcatgggtttcctcacagtttagtgkctgggttccaagaataagcatcatctattagaatagtgcttgctttataattgcttattgaatgaatgaaagaatctcaggttgttttcttgctcatgtt

SEQ ID NO: 14064 - DNA, 201 bp, Homo sapiens
agatggatatatggacacagtaatgaacaaatgattaaaaaattatttaaaccattgtttgacagggtaagattactttctaatgaaatagaacttggtartatgcccttgaagtctgataccctgacaaaccgcttctgaaaatcagcttacataactaccagggagaataaaaaggcatagtgcaaagcaaatgctgtg

SEQ ID NO: 14065 - DNA, 201 bp, Homo sapiens
ccttaagacatcattgccaacttctaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgtt

SEQ ID NO: 14066 - DNA, 201 bp, Homo sapiens
taagataatttttgtgaagctcattgaatgcgtctgagctccttaactcaaaaaaggctaaaagttactgaaatagctatggttaagggtatattgtcatyacaatgtgataatcattaccaaagtgggcacttggaaaaatagtgaccacttatgagccaaaccaatcaacattaaaactgatttccagtaagtacagct

SEQ ID NO: 14067 - DNA, 201 bp, Homo sapiens
tcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagt

SEQ ID NO: 14068 - DNA, 201 bp, Homo sapiens
ctgagctccttaactcaaaaaaggctaaaagttactgaaatagctatggttaagggtatattgtcattacaatgtgataatcattaccaaagtgggcactkggaaaaatagtgaccacttatgagccaaaccaatcaacattaaaactgatttccagtaagtacagctgccaagtgattatagagcagcctggatacagat

SEQ ID NO: 14069 - DNA, 201 bp, Homo sapiens
ggttggaatgcagtggtgcgatctcagctcactgcaagctccacctcccgggttcacaccattctcctgcctcagcctcccgagtagctgggactacaggygcctgccaccacgcccggctaattttttgtattttcagtagagttagggtttcaccgtgttagccaggatggtttcgatgtcctgacctcgtgatccgcc

SEQ ID NO: 14070 - DNA, 201 bp, Homo sapiens
tgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtaatgt

SEQ ID NO: 14071 - DNA, 201 bp, Homo sapiens
catctcaggatcttcatttctttttacacaatttagaattccttctgtatatccgtttgtctctttaagtctctgctaaatccatcaagctgtgtatcctrtaatactttttcccccagttgattttcattgccctttctttttgtctcttagatatttcttaaagtccctcattagcatttccctctcaggttatacagg

SEQ ID NO: 14072 - DNA, 201 bp, Homo sapiens
ctattacctagagcaggtaaataaagtcatttgcttgactgaaaggtaagagggttaaaacccaccattctaaatgtcaagtaatagttacgttgcagtcwgcttagttttatactataaattatgatgatttggttccatgtttttttttagtataatgtgattgctgttcagctttatattcagcgcatagcactatgc

SEQ ID NO: 14073 - DNA, 201 bp, Homo sapiens
atttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaaca

SEQ ID NO: 14074 - DNA, 201 bp, Homo sapiens
tatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtct

SEQ ID NO: 14075 - DNA, 201 bp, Homo sapiens
tcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagct

SEQ ID NO: 14076 - DNA, 201 bp, Homo sapiens
actacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtatt

SEQ ID NO: 14077 - DNA, 201 bp, Homo sapiens
cctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagta

SEQ ID NO: 14078 - DNA, 201 bp, Homo sapiens
atttactgtaatttcttattgttattaaaacctaacacttggtcatatgctatttactttatgtgtttctaatttttatttgcgtatttggcctaagcatrtttatatctgcttctgagtaatttctgcattttatatgtttttacttcataaaagatggaggccacctcaaaacaaattaggcatcaaaggaacatacct

SEQ ID NO: 14079 - DNA, 201 bp, Homo sapiens
aataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacag

SEQ ID NO: 14080 - DNA, 201 bp, Homo sapiens
gccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaa

SEQ ID NO: 14081 - DNA, 201 bp, Homo sapiens
ctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcattt

SEQ ID NO: 14082 - DNA, 201 bp, Homo sapiens
gctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcct

SEQ ID NO: 14083 - DNA, 201 bp, Homo sapiens
gatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatatt

SEQ ID NO: 14084 - DNA, 201 bp, Homo sapiens
cctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataa

SEQ ID NO: 14085 - DNA, 201 bp, Homo sapiens
cttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaaggg

SEQ ID NO: 14086 - DNA, 201 bp, Homo sapiens
tggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcat

SEQ ID NO: 14087 - DNA, 201 bp, Homo sapiens
ctcaaaagtggtagctactgttaaaatatactgtatttgcatcttagaagagcatttaacattcttgtgatatctttatggtcaagatgggaaattttgayctaggtggtatttcagttaattcataagtagataaacctacgtttttacagatttagaaggagctttttattttaataacaactcagtacaggatattga

SEQ ID NO: 14088 - DNA, 201 bp, Homo sapiens
agctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctt

SEQ ID NO: 14089 - DNA, 201 bp, Homo sapiens
ggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtatt

SEQ ID NO: 14090 - DNA, 201 bp, Homo sapiens
tttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggc

SEQ ID NO: 14091 - DNA, 201 bp, Homo sapiens
caactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaat

SEQ ID NO: 14092 - DNA, 201 bp, Homo sapiens
ctagaacaaatggaggaattatccttttccattctgtagtggtcatactacctaagaagtactgtggccaattctggacattacctctgagaagcatgttkataggacagtgatcaaatatgctaaaggaacttcagactatgctgtaaagaggagcatgtgaaagaatcaagaaactataatcttgaaaaagaaagcctg

SEQ ID NO: 14093 - DNA, 201 bp, Homo sapiens
aagttttttggtttgttttcacattcaatttagagaccctgaagcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttg

SEQ ID NO: 14094 - DNA, 201 bp, Homo sapiens
tttttaattttagtaaggcacatacatggtacttttaatatcaatgactagcagttgttgagtgactcctatgggacaggatccatgcttggcacttgacwtataacatctccagtaacagtcctacaagggttgtgtggttatactctttttattgaggaggaaacagtttgttcatggagggcaatttccccaggagtg

SEQ ID NO: 14095 - DNA, 201 bp, Homo sapiens
atgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagcaaattctgttttttcttggttataatgttatcttaatcagaaa

SEQ ID NO: 14096 - DNA, 201 bp, Homo sapiens
cagtgccgaaatatatttctttctatggcaacattcttattctactatcctttttatttttaagtagtttcatttttgtcactgttgggttattttaaacratttaattggagggaaagaaatacaaattcatcaaattttacctccagaattgaatttccttcactagttccttaataagtatttaagtaaaagggggtg

SEQ ID NO: 14097 - DNA, 201 bp, Homo sapiens
gtggctaggaaagacctcactgagaaattgacatttgaatgaagatctgaagtgggggcaggtaaaggtgtgtgcctctacaaaggccacagctgaggccrcccttctttatctacctcttttcatctttccaacttccagaccttttttttctgctgataactcataccttttaattaaactttaatttaatttaattta

SEQ ID NO: 14098 - DNA, 201 bp, Homo sapiens
tcttccaactctgctctccaccacttccttgcccctagcacacacacaattaatcagcacttacaaaaacaaaaatttacctctttacaaaaggtacaggsatagagtagaggctttgaatacttgtgcttcaattatttttctcctgtcatcttttatattaaaggaaataaaatataggggtgtctccttttcctggtt

SEQ ID NO: 14099 - DNA, 201 bp, Homo sapiens
ttttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggc

SEQ ID NO: 14100 - DNA, 201 bp, Homo sapiens
ctttctatggcaacattcttattctactatcctttttatttttaagtagtttcatttttgtcactgttgggttattttaaacgatttaattggagggaaaraaatacaaattcatcaaattttacctccagaattgaatttccttcactagttccttaataagtatttaagtaaaagggggtgcaatatcaagaagactaa

SEQ ID NO: 14101 - DNA, 201 bp, Homo sapiens
tacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtc

SEQ ID NO: 14102 - DNA, 201 bp, Homo sapiens
agctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaag

SEQ ID NO: 14103 - DNA, 201 bp, Homo sapiens
aggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattc

SEQ ID NO: 14104 - DNA, 201 bp, Homo sapiens
gtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatag

SEQ ID NO: 14105 - DNA, 201 bp, Homo sapiens
aagtagcttatctaaggacacaaaaatggtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctg

SEQ ID NO: 14106 - DNA, 201 bp, Homo sapiens
tcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaat

SEQ ID NO: 14107 - DNA, 201 bp, Homo sapiens
acatatacacccttatcccctccctcatgtaccacccatatataattctctttaccgcatcctttatcacactcctacaagccttgaagcaatctgaacayagaaaccatctttgattttcaactcctaattgggactgaacatacttgtcttgaacacagattgctgccttgttagtataggtatcctaatatggcacat

SEQ ID NO: 14108 - DNA, 201 bp, Homo sapiens
ttaaaggctgccctctcagaaaacgagcaactgaagaaagaaaatggaacactgaagcggcagctggatgaagttgtgtcagaggtaagtgttagtaatasggctgagtcgagatgggctaaagtatcctctggattaataaatagagaaacttttacattttaaattaaattatgtaaaataatagtgctaggaaaagga

SEQ ID NO: 14109 - DNA, 201 bp, Homo sapiens
tctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccac

SEQ ID NO: 14110 - DNA, 201 bp, Homo sapiens
ttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtga

SEQ ID NO: 14111 - DNA, 201 bp, Homo sapiens
taaacattggaacaaatgagtgaccaacagaaatggaggaattatgtattctattggatttaaaatagaatatatcatctgctcaagacacttagaattgrtagattagatctgtctaataatttttaactcttgggggtcacagaccccattcagaatctgatggcccctctctccaaaaacatgcacacacaaaacttt

SEQ ID NO: 14112 - DNA, 201 bp, Homo sapiens
ttagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtg

SEQ ID NO: 14113 - DNA, 201 bp, Homo sapiens
tttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaatt

SEQ ID NO: 14114 - DNA, 201 bp, Homo sapiens
cctccaaatagaatcttttgtgcttctctagggagattccctttgtgttgaattttatgagtagtgtaaattgtgtgggttgcatcataaaacaaagtgcraacacacacacaaagtcttattgatgagccaagttcctaagcactattaatgagttaaaagtgttaattaaggctgggcgcagtggcttacatctgtaat

SEQ ID NO: 14115 - DNA, 201 bp, Homo sapiens
tcagatatgatcattctgtttcaaatgacaaagccctgatggtgctaactgaagaaccattgctttacattcctccacctccttgtcagcccctaattaayacaacagagtctctcaggtgagtgttgtagattattgcagaaacatctgagttggttcccatgtttagttttggaacctagacaagtaattggtcaagtt

SEQ ID NO: 14116 - DNA, 201 bp, Homo sapiens
tctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaact

SEQ ID NO: 14117 - DNA, 201 bp, Homo sapiens
ctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaattattttttttaagttgtaggcactgatttccaaatgagttccataaa

SEQ ID NO: 14118 - DNA, 201 bp, Homo sapiens
tttttcagatgagaaaagttcaccaaagattttacccattggtgccagaaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaa

SEQ ID NO: 14119 - DNA, 201 bp, Homo sapiens
ccatttctgaacttagacatttactactatggtttaatgacaggtcttacttagaatctgttaagtgggggttccatctcaatgttgtttgccacaaaacrccattaagtcattccgtcattcatcaaatatttgttgttagaatttagactagcaactggcatctgcaagttcccaataatgagccaaggactgttcttg

SEQ ID NO: 14120 - DNA, 201 bp, Homo sapiens
tccttctctttattcttctgtcagctgtacttaagatatgtgtatcaagatcagaagctttcgtctgccactgtggtttcgtttatgtcttcagtctcttstgtgaaggttctcttggctttctagcactaaatcaaaatctggtgctcctggatgacacaacttcccgtaatgccccggtgaacggttgctaattttatt

SEQ ID NO: 14121 - DNA, 201 bp, Homo sapiens
cctttcctcctccctaaaaatatctaagttgaaatctcattttgtcacaatatcccatcctctacctctcctgattcctggatcactctctttcacttttytttttttcttttagagatggggtcttgttctcttgcccaggttggagctggagtatgcggtggagcaatcacagctcactgcatcttcagacccctgggg

SEQ ID NO: 14122 - DNA, 201 bp, Homo sapiens
agcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacag

SEQ ID NO: 14123 - DNA, 201 bp, Homo sapiens
ccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaat

SEQ ID NO: 14124 - DNA, 201 bp, Homo sapiens
cacagagagaaagtaatgattcaggattcattgttgtgaggttcaagaaacatttattttgaggaagtggaggtaaatattcaatgaagttaactacattrtcccagatatatagataagatagataaaatgtatatattatatagacacttatttttattataagatatgtactgttagagttggtagtataccagcttt

SEQ ID NO: 14125 - DNA, 201 bp, Homo sapiens
ggactcattctgttgcccaggctggggtacaatggcgtgacccatggctcactccagcctccacctcctgggctcaagcagttctcccacttcagcctccygagcagctcctgaacacaggcacattccactcccagctaatttttaaattgtttgtagagacagagtctccctatgttgcccaggctggtcttgaactcc

SEQ ID NO: 14126 - DNA, 201 bp, Homo sapiens
cctacttctgcaaaaattaatctctttgtgattttcccctttcttgcaaatggttggaaaaacttttataataataaacttaggaactggtgttacaatayggtatccaatgtgaatcatttgcctgttattagtacttgttacttgaagccacgtttttgttccttttaagatggcagctgaattgagcaggtgtttttt

SEQ ID NO: 14127 - DNA, 201 bp, Homo sapiens
ggggcagaactgaaagaaagtagctttttgaagccaaagtaaaaagagcttcaagcaggtcttgggcagtggtatcacatgctgctgagagcttgggagaygtagaaagctgaatttggcaattatcaggtcagttgtaatcttggaaagcagatttagtaggggtaggcatgaagtctgtattaaaattggttgagaaat

SEQ ID NO: 14128 - DNA, 201 bp, Homo sapiens
attctgttgcccaggctggggtacaatggcgtgacccatggctcactccagcctccacctcctgggctcaagcagttctcccacttcagcctcccgagcasctcctgaacacaggcacattccactcccagctaatttttaaattgtttgtagagacagagtctccctatgttgcccaggctggtcttgaactcctaggct

SEQ ID NO: 14129 - DNA, 201 bp, Homo sapiens
ggcagaactgaaagaaagtagctttttgaagccaaagtaaaaagagcttcaagcaggtcttgggcagtggtatcacatgctgctgagagcttgggagatgyagaaagctgaatttggcaattatcaggtcagttgtaatcttggaaagcagatttagtaggggtaggcatgaagtctgtattaaaattggttgagaaattg

SEQ ID NO: 14130 - DNA, 201 bp, Homo sapiens
gtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttactt

SEQ ID NO: 14131 - DNA, 201 bp, Homo sapiens
taaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagt

SEQ ID NO: 14132 - DNA, 201 bp, Homo sapiens
gtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctac

SEQ ID NO: 14133 - DNA, 201 bp, Homo sapiens
cttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaa

SEQ ID NO: 14134 - DNA, 201 bp, Homo sapiens
tcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataa

SEQ ID NO: 14135 - DNA, 201 bp, Homo sapiens
tctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctc

SEQ ID NO: 14136 - DNA, 201 bp, Homo sapiens
ttgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctagg

SEQ ID NO: 14137 - DNA, 201 bp, Homo sapiens
agcagattacatgcaattgaagttttctcatctacaaaatgctggctgcacagagttgatataatggttaaattagataatatatttagagcacttagcayggtacataagtgccccccaaaatggtaaatgataatgatgtgatgtcattgacaacagtatcactgaagtgaaatttgaggatctcagcttctatctgta

SEQ ID NO: 14138 - DNA, 201 bp, Homo sapiens
catctttttttgtttgtttgtttgtttgttttgagacagagcctcactctgtcacccaggctggagtgcagtggcgcaatcttggttcactgcaacctccrcctccagggttcaagtgattatcctgcctcagcctcccaagtagctgggattacaggcatgcgccgtgacacccggctaatttttgtatttttagtagag

SEQ ID NO: 14139 - DNA, 201 bp, Homo sapiens
ttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctct

SEQ ID NO: 14140 - DNA, 201 bp, Homo sapiens
ctcccgaagtgctgggattgcaggcgtcagccactacacctggcccctgcagagtctttatcaaacagaagtgaatattaggaggagcctggggaagaatyctctttgatttaccttggtgttaacactccagcgatacaactatggatcctccagaaagactatgtttttgctgtatcagtgccacctattaggaattgt

SEQ ID NO: 14141 - DNA, 201 bp, Homo sapiens
gaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgac

SEQ ID NO: 14142 - DNA, 201 bp, Homo sapiens
ctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggcc

SEQ ID NO: 14143 - DNA, 201 bp, Homo sapiens
ttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgt

SEQ ID NO: 14144 - DNA, 201 bp, Homo sapiens
tcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctca

SEQ ID NO: 14145 - DNA, 201 bp, Homo sapiens
tacaaaatgctggctgcacagagttgatataatggttaaattagataatatatttagagcacttagcatggtacataagtgccccccaaaatggtaaatgrtaatgatgtgatgtcattgacaacagtatcactgaagtgaaatttgaggatctcagcttctatctgtagctctaccacacatttgcagttcacttatatg

SEQ ID NO: 14146 - DNA, 201 bp, Homo sapiens
taaattgataaacctgatattgggttataataatgtcataagcactattctggtctaactctctctttttactaatatgtaaatacaccctacaaggtgaygtgatttatttttatttttatttttagattttccaattaattcattgcaatgctgggccaagaattaaggactcctaacttccaattttgtattttcatt

SEQ ID NO: 14147 - DNA, 201 bp, Homo sapiens
ctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatg

SEQ ID NO: 14148 - DNA, 201 bp, Homo sapiens
taaaagagaagtcgagtccttgagaaggggcaaaagggtggaattcagataacaggtggaaggatggccctttgctagtaaggcaggacattatggtagargcaagatgagttcatagataggaccttaggttccaggaagataaagagaagacacttctaacagtttctgttttcccagtgaaggacatctcaactgatg

SEQ ID NO: 14149 - DNA, 201 bp, Homo sapiens
atagtttgagacatcagacttggatgaggaagggtaaatcatgctactagtgggccagttactctgtggttttcttatgagactgtgctttaaggaaaagktaaccacggagcatatggcattgagtttgagtcatgtggaactggttagaagtaaaatgtttctattccagcattctctgagtttgtcagcttttcatta

SEQ ID NO: 14150 - DNA, 201 bp, Homo sapiens
agttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctg

SEQ ID NO: 14151 - DNA, 201 bp, Homo sapiens
ttagaaatttctttctgttactgctccagaatctgtgcttttcaattattggttctaattcagtatttttaggcctcagagaaaaagccttaatgccgtcytcacgtggtaggctaccaggtctttgaagatggccattttgtatcccacatcttctccacatctgctcatagaaatacagtttcttcatttgctccctta

SEQ ID NO: 14152 - DNA, 201 bp, Homo sapiens
cttggccagtgggatagtgagcctactagagacatttggattgtgaggccttggtggggtgtcagtatgccgtatgctttaaagtcaaatctctgcaacaraatgccaggtgtagagttacagttgattaataagacacagcccctgtactcaaggagtttgtaatctagagaatgaaagacatataattacaatatggtg

SEQ ID NO: 14153 - DNA, 201 bp, Homo sapiens
cccctggaagagtctgggagtatcgttcggcttctgtcctggccacagggagagtagaatattgtctaactggagttaactgtcgtttttcactattcccrctggggaagtaccgggtgatctttttgtgtggctaacactggacgtctttaggaggtttagagcaaaatggctgggaccgccaaaaaggctacaagctat

SEQ ID NO: 14154 - DNA, 201 bp, Homo sapiens
taatttttgtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtc

SEQ ID NO: 14155 - DNA, 201 bp, Homo sapiens
ttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaa

SEQ ID NO: 14156 - DNA, 201 bp, Homo sapiens
agtctcgctctgtcgcctgggttggaatgcagtggtgcgatctcagctcactgcaagctccacctcccgggttcacaccattctcctgcctcagcctcccragtagctgggactacaggcgcctgccaccacgcccggctaattttttgtattttcagtagagttagggtttcaccgtgttagccaggatggtttcgatgt

SEQ ID NO: 14157 - DNA, 201 bp, Homo sapiens
catatcatctgtgttctccatgccagttttatttttgtaatttattgttttttactttgcattctgtttattatttaaattcctttgtttcataagagagytgaaaacaggttagtgaagctgcaagaaagtaagtctttctttgtctgaggaagttgtcacacaagattattgaaataaaaatagaatgctaggtatgct

SEQ ID NO: 14158 - DNA, 201 bp, Homo sapiens
cagaaagataatattttaactaggcacattatgatttgaaaaaaaatttggagtctttttagtaaggatccaccctcggcctcccaaggtgctgggattasaggtatgagccaccgtgcctggccatccgttgttttttgtttgtttgttttattatattgagaagtccacagcaaagaatcacagtgatgaaccagttgc

SEQ ID NO: 14159 - DNA, 201 bp, Homo sapiens
cagattggtgtgtatttctgtgtatctcttgtaacggaataccaagtaattcttgactgatgaatttcattttctttcctttttgttagatactaccagcsccctcacaagttagtgtccctttccatctgttgtattgtcttagacttctcctcattcaccaccttgatgcttttacaagataacaaagcttatggagat

SEQ ID NO: 14160 - DNA, 201 bp, Homo sapiens
gggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtg

SEQ ID NO: 14161 - DNA, 201 bp, Homo sapiens
ggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtgg

SEQ ID NO: 14162 - DNA, 201 bp, Homo sapiens
cactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagca

SEQ ID NO: 14163 - DNA, 201 bp, Homo sapiens
gaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggg

SEQ ID NO: 14164 - DNA, 201 bp, Homo sapiens
actttaaaataaattcattccatccaaatttagcagccatctattgcaaagtttgcttcctttttccatgacatttaaatatacaaaagccttttttttaaaaaaaaaagcattttttagtaggtaaatgtcagtcactttcttaaactagcctgtcctagaccaacagaccagttctactttcaaaacaaaacatagcat

SEQ ID NO: 14165 - DNA, 201 bp, Homo sapiens
gaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggtt

SEQ ID NO: 14166 - DNA, 201 bp, Homo sapiens
tttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcagtatccatc

SEQ ID NO: 14167 - DNA, 201 bp, Homo sapiens
ttgggagaatcacgtgaacccaggcagcggaggttgcagtaagcagagattgtgccactgcactccagcctgggcgacagagtgagactccctctcagttaaaaaaaaaaaaaaaaaaaaaaaatcaccttaatgccttttatctctggttacttcaacaccataattaccataaataattcatctctgttggaatatttg

SEQ ID NO: 14168 - DNA, 201 bp, Homo sapiens
tctatgagaggtttatgtcattattgaaagaagttcaagtctgaggatttggtactattcagatatgggagtcatttccgtatggagatctcttaggtagwttagtcatcattgtactcatactgatatctgtatacactgggtacaagaaaacttttgcagcattcttatctctggatttagtttgttggcaccagatat

SEQ ID NO: 14169 - DNA, 201 bp, Homo sapiens
gagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgtta

SEQ ID NO: 14170 - DNA, 201 bp, Homo sapiens
tgtctgcagagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatcc

SEQ ID NO: 14171 - DNA, 201 bp, Homo sapiens
cttattccaaaattgaccacatagttggaagtaaagtagaccaatatccctgatgaacatcgatgaaaaaatcctcaataaaatactggcaaactgaatcyagcaacatatcaaaaagcttatccaccatgatcaagtgggcttcatccctgggatgcaaggctggttcaacatacacaaatcaataaatgtaatccagca

SEQ ID NO: 14172 - DNA, 201 bp, Homo sapiens; identical to SEQ ID NO: 1880

SEQ ID NO: 14173 - DNA, 201 bp, Homo sapiens
ttacatcactacgaccaccatcacttactgattcaccaaaaattgcataaattatcttacttgtttttattagtttttattaaatgtatagctcacatttrtttcaatatttaatattagaagtgcttggggtctttatttagaagtttggtgatgtttttatagccagaaatatgctgtaggaacgtaactctcatttat

SEQ ID NO: 14174 - DNA, 201 bp, Homo sapiens
tgtacttgaccatctagtacattttagagccttgattcagaaatcagaattttagcataagtgaatgggttcttataaaatatcctgatccttgggctttrcaaaatagtgttataaaaattactgccaaagtgcaactaatattttggttgagagagattcttagaattcagacatagccttagaatgggaagtattttg

SEQ ID NO: 14175 - DNA, 201 bp, Homo sapiens
atacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaa

SEQ ID NO: 14176 - DNA, 201 bp, Homo sapiens
ggttgtgatgaacaaggtaaatatagggtgtcataagagcacacattaaccaatcttggaggggctgtcctatgcaaggaggtcttcatggagacctaacmgctaagctaagacctgcctgttctgcaagtaccttacttaaagctattacataatagctgctggggatgaaaatattctagaaggtatgatagtcacact

SEQ ID NO: 14177 - DNA, 201 bp, Homo sapiens
ctttttcaaatcaaaaagcaatattgagtcatcaggcacttggaatgctctttggaacctacaaatgattagattcatttccacccacagggtgaaacatycatttctatgtttaattaatttctatgtttaattaattaaactatattttataggttaaatcatgaacttcgaggatgggttcatagacatgaagtagaa

SEQ ID NO: 14178 - DNA, 201 bp, Homo sapiens
tggaacctacaaatgattagattcatttccacccacagggtgaaacattcatttctatgtttaattaatttctatgtttaattaattaaactatattttawaggttaaatcatgaacttcgaggatgggttcatagacatgaagtagaaaggaccaagtcaagaagaatgacaaataatcaacagaaaacccgtattcttc

SEQ ID NO: 14179 - DNA, 201 bp, Homo sapiens
aaacccgtattcttcaggtatgtttctgtttgtctttgaacaatagttggcgtatttgttggaaggcttctcccagctgggttactctcttccctagaagkttggtaaacttgagctttagcctcttcccactgtctcctgctgcttccgatgcagctatcattgccactgaagtcctcctcccaggttttatagcactag

SEQ ID NO: 14180 - DNA, 201 bp, Homo sapiens
aaggtatagtggacatttttatagttgtatactttttgataaacatttccctgtgttatttagaatttgtattagagccaaatggagccaggtccttgacwaacaaggcaaagggaggtcacagtatggtaactattgcacagtataatgcttgaaaattattacagatttgtttacttttatctctttaaggatttgtag

SEQ ID NO: 14181 - DNA, 201 bp, Homo sapiens
acatctcactttcaaacatcctgctctgactgccttcgcctgttttaccagcttacttcctttagtattccagtttcaatagttgttcagtccttctgagrttttgccatgtttccagtgtctctcattctcttcagttcatcacgtccctcttacccagtttaaataccatggacagtcattgtcactatttccttcctt

SEQ ID NO: 14182 - DNA, 201 bp, Homo sapiens
tactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctc

SEQ ID NO: 14183 - DNA, 201 bp, Homo sapiens
tccctcttgaggtttgataattttctagaatggctcacagaactcaggaaaacactctatttactattactggttttattataaaggatatgtggggcaarctaaatgggagagacgcatagggtaaggtataggggaagagtgcagagctttcatgccctctccaggtgcaccaccctcctagtacctccttgtgtttgc

SEQ ID NO: 14184 - DNA, 201 bp, Homo sapiens
actccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctcc

SEQ ID NO: 14185 - DNA, 201 bp, Homo sapiens
ctccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctcca

SEQ ID NO: 14186 - DNA, 201 bp, Homo sapiens
acctttcctccatgttttccagttaaagatattaaggcagaacctcagccactttctccagcctcctcaagttattcagtctcgtctcctcggtcagtggrctcttattcttcaactcagcatgttcctgtgagtagccagtcttttacaatgattttggttataatatgctatctggaaaatatgtatatggaggaggca

SEQ ID NO: 14187 - DNA, 201 bp, Homo sapiens
accttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctccagggtt

SEQ ID NO: 14188 - DNA, 201 bp, Homo sapiens
tttcacattatgataaatatatattttcatagtgccagatttactgtaatttcttattgttattaaaacctaacacttggtcatatgctatttactttatrtgtttctaatttttatttgcgtatttggcctaagcatgtttatatctgcttctgagtaatttctgcattttatatgtttttacttcataaaagatggagg

SEQ ID NO: 14189 - DNA, 201 bp, Homo sapiens
cagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctacccta

SEQ ID NO: 14190 - DNA, 201 bp, Homo sapiens; identical to SEQ ID NO: 1864

SEQ ID NO: 14191 - DNA, 201 bp, Homo sapiens
gtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagata

SEQ ID NO: 14192 - DNA, 201 bp, Homo sapiens
atggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaaca

SEQ ID NO: 14193 - DNA, 201 bp, Homo sapiens
ctctgaagaggatatacattgatgagtgaagatattagggagggtagggagaaagaatagaagtttttacatataaatacaaatagaagtatttaaaaaawttttttttcttagctttatctgatagcctgccttctggaattgtgaaaggctaacaatgaatttgacttttattcctacttcatttgaagtattctctca

SEQ ID NO: 14194 - DNA, 201 bp, Homo sapiens
tgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctg

SEQ ID NO: 14195 - DNA, 201 bp, Homo sapiens
tggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacag

SEQ ID NO: 14196 - DNA, 201 bp, Homo sapiens
gtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgt

SEQ ID NO: 14197 - DNA, 201 bp, Homo sapiens
ggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacagg

SEQ ID NO: 14198 - DNA, 201 bp, Homo sapiens; identical to SEQ ID NO: 1871

SEQ ID NO: 14199 - DNA, 201 bp, Homo sapiens
tgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtc

SEQ ID NO: 14200 - DNA, 201 bp, Homo sapiens
gagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacagga

SEQ ID NO: 14201 - DNA, 201 bp, Homo sapiens
gcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtct

SEQ ID NO: 14202 - DNA, 201 bp, Homo sapiens
tgctattcctatcaaactatcaatgacatttttcacacaattaggaaaaactattctaaagttcacatggaactgaaaaagagcctaaatagccaaagcasccctaagcaaaaagaacaaagccagaggcatcaagctacctgatttcaaactgtactacaagactacagtaaccaaaacagcatgatactggtataaaaa

SEQ ID NO: 14203 - DNA, 201 bp, Homo sapiens
tcatatggaaaaccaaatttcttagccatgttactgaatgtcagtcatttcccttacttgatctgcatcaccaacattaagtgccatgtatcagatttctrtatatgttccattataatctcatgggaccaccatagtacatgcggtccattgttgacagacacatcattatgtggtgcgtaagtgtacttatagttttac

SEQ ID NO: 14204 - DNA, 201 bp, Homo sapiens
cctttccccccattctagggcctcaatactgacatcactctctcaccagcacgtatcattccagctggaaacaccccgcaatcgaacccccagtccttccrtcccaggagtctctcccctctgataagtctcttctgcctcccccaggtgccccaggctcccccaaaaacctgctaaaagtctagcctttgtctttgcagc

SEQ ID NO: 14205 - DNA, 201 bp, Homo sapiens
ggcggggcggagctgagtggcacagggggcgaggcttgtagcagcgagtcccccctcccctcctttcggacgaagaaggaagacttgggccccgcgactgsgcaggaaaaaggggagggagcagcctctccccgcatgcggcccgggagggaagccccgcccccttcccgcgggtaaaggacacccgtctcccaacagaaa

SEQ ID NO: 14206 - DNA, 201 bp, Homo sapiens
agcgccattctgcgccccctacccccggggcacggacacggccacagcacggggggcggtgaggccccggggacacgagacacgggggagggagaggggamcccgcccgcagatgacccgggggaccggcgaccggacgcggcggggcggagctgagtggcacagggggcgaggcttgtagcagcgagtcccccctcccct

SEQ ID NO: 14207 - DNA, 201 bp, Homo sapiens; identical to SEQ ID NO: 1890

SEQ ID NO: 14208 - DNA, 201 bp, Homo sapiens
ttagagacagggtcttactatgttgcccaggttgacctcagcttcgtgggctcaagcggtcctcctgcctcagtcttccaagtagctgagactacaggtgygtgccaccccactacacattaaatttggggaagcactgctttaactctgtctcactgcagtccaacgtcactaaacccccaagtcaggacaatggactct

SEQ ID NO: 14209 - DNA, 201 bp, Homo sapiens; identical to SEQ ID NO: 1884

SEQ ID NO: 14210 - DNA, 201 bp, Homo sapiens; identical to SEQ ID NO: 1886

SEQ ID NO: 14211 - DNA, 201 bp, Homo sapiens
ggaagaggaggaggaggaggggctggaggaagatgagccccgcttcaccatcatccccaacccactggacaggagagaggaggctggaggtgcctccagcraggaggaaagcggtgaggacacaggtaagtggcctgggctggtgtgggtgggaaggaaccgagtcagcctgggtcactgctgccctcctgtccccgcagg

SEQ ID NO: 14212 - DNA, 201 bp, Homo sapiens; identical to SEQ ID NO: 1891

SEQ ID NO: 14213 - DNA, 201 bp, Homo sapiens
ggaacagtccagagccaagcttggcgcagcgcccccccatggggatgatggcatgttctggtgaaggcaggggcagggctcggaggaggggcatccatgcrtcgtgcacagcctgttcatgcgctcacgccccgccccgcgccccctacctgctcccagctgatctccttggtctcctgacccgttagtaggaagagggga

SEQ ID NO: 14214 - DNA, 201 bp, Homo sapiens; identical to SEQ ID NO: 1885

SEQ ID NO: 14215 - DNA, 201 bp, Homo sapiens
ccacagtcaaacataattcctccgtggacagtgagttcatgcctcttgggtttttttgttagtttatttgtttggtttttatgagatggaatctggctctrtcacccaggctggagtacaatggtgcaatctcggctcagtgcaacctctacctcctgggttcaagcgattctcctgcctcagcctcccaagtagctggga

SEQ ID NO: 14216 - DNA, 201 bp, Homo sapiens; identical to SEQ ID NO: 1887

SEQ ID NO: 14217 - DNA, 201 bp, Homo sapiens
gaaagctgtccaccatcttgagttggccccggagctccttcttgttaaggtgatctaacattcgagcgtccaccagcgactccatgaagtagctgcggtaytggggcagccccaggctgggcagccagtcgttccccacccactcgtggttcatgtcgccatatgccaggatctggggccatgggcaggtgagggaagagt

SEQ ID NO: 14218 - DNA, 201 bp, Homo sapiens
tacacagacccaaacgctcctagagggagagcgtcggcaaggaacgcccttgggaaggtccccgagtccaggaatggggaaggagcagggctggggcgtgrccatccgcgggcggggtcagcgggccgcggaccctctggggtcagtccaggggcgaactcctcaccccggatctgtggagtcaactatgaacgtcgtgca

SEQ ID NO: 14219 - DNA, 201 bp, Homo sapiens
cccattctagggcctcaatactgacatcactctctcaccagcacgtatcattccagctggaaacaccccgcaatcgaacccccagtccttccgtcccaggrgtctctcccctctgataagtctcttctgcctcccccaggtgccccaggctcccccaaaaacctgctaaaagtctagcctttgtctttgcagctgccaaac

SEQ ID NO: 14220 - DNA, 201 bp, Homo sapiens
ctccgccccttcctttgactccacccctctccgggtctcacctctcctttaaccccgcccctctcctggccccgcctccaaccgtgaccattaatagtcaggccccgccccctcagctcagcctctcgaggagccgctgggagcagagccctctgagctgttgccgcgcccacctcgtccagccgcctgtctgtgcctaag

SEQ ID NO: 14221 - DNA, 201 bp, Homo sapiens
actccgccccttcctttgactccacccctctccgggtctcacctctcctttaaccccgcccctctcctggccccgcctccaaccgtgaccattaatagtcaggccccgccccctcagctcagcctctcgaggagccgctgggagcagagccctctgagctgttgccgcgcccacctcgtccagccgcctgtctgtgcctaa

SEQ ID NO: 14222 - DNA, 201 bp, Homo sapiens
ggtctgcgctccaggtgagcatgggcggggccctggaaaaacctgaggaaggtgccgggcccagcgtggtgaatcctggtgggggcggagcctggcccggwaggctggtggggcggggctaagaggggaggcgtggccaaggctctgagcacgtgggccggggcctggctcgaggaacaccaggtggagttgctggagcca

SEQ ID NO: 14223 - DNA, 201 bp, Homo sapiens
tcaaacagttgtcctgagacctagagcgtcaccatcacctgtggacttgctggaattgcagaatctcagaccttactccagacctactgaagtcggtatckgcattttcacaagaccctcaggtgattcgaaatatacattatatttatttttaaatttctttctttctctctttctctctctctctctctctctctctct

SEQ ID NO: 14224 - DNA, 201 bp, Homo sapiens; identical to SEQ ID NO: 1889

SEQ ID NO: 14225 - DNA, 201 bp, Homo sapiens
cgtgatcactgagtgacgcctggggcggggaggccgaccgagagtcgggggcgagggctcccccaccgtccccctgcccccacgccacgtcgcccagcggmatcgtggaaagaggattctcccatgcaaaccccggagccagaggagaaggggaagcgccattctgcgccccctacccccggggcacggacacggccacag

SEQ ID NO: 14226 - DNA, 201 bp, Homo sapiens
gacatcggggtaggggccggggcactggtcagagcaaggggagcaaggccaagtccctgtgtcctgggaggaggtcagtgggcagtgctggcaagggtccyggagggattgtggtcactcatcctcctgcttatgcgccccctccagacggtgactgtgaaggaggaccaggtgttgcagcagaacccacccaagttcgac

SEQ ID NO: 14227 - DNA, 201 bp, Homo sapiens
acagaatgagatagaggacttgatggtggacgtagagcgctccaatgctgctgctgcagccctggacaagaagcagagaaactttgacaaggtggaccatrggcgggggccgcagccagcatgcagggcaagggggcatgaggggttcagtgagaggccaaaggcaacctccttggaggtggaggaggagggctaagccca

SEQ ID NO: 14228 - DNA, 201 bp, Homo sapiens
ggtcagaagacctgggttcagacctaccagctggcctgggcaagttactttaccacttcgaatctcattgcaaattcttcttcttcttcttcttcttcttyttttttttttaaagaaacttctctataggaaaatgcaaattaagacaccaatgaaataccattttaaaacactagactttgcttgctcagatggtctaca

SEQ ID NO: 14229 - DNA, 201 bp, Homo sapiens
aattagccgggtgtggtggcagatgcctgtagtcccagctactctggaggctgaggcaggagaatggcatgagcccgggaggcagagcttgcagtgagccragatcgagccactgcactctagcctgggcgacagagcgagactccatctcaaaaaaaaaaaagttgaacagctgcatacttctccattccactcctgagt

SEQ ID NO: 14230 - DNA, 201 bp, Homo sapiens
caaaaacaagattcagctggaggccaaagtaaaggagatgaatgagaggctggaggatgaggaggagatgaacgcggagctcactgccaagaagcgcaagytggaagacgagtgctcagagctcaagaaggacattgatgacctggagctgacactggccaaggtggagaaggagaagcatgcaacagagaacaaggtgag

SEQ ID NO: 14231 - DNA, 201 bp, Homo sapiens
ggcttctccttctgagatctgctctgcctcagggactttctactctaagacaaatgatagagctctattctcctctaacccttcctctggtagttcagccstctgaacgcagggtgaaaaaaaaaaaaggcttcaaggagcaccttcctgtgagctgctctgttcatattcttcccggtactaaccccagccactaaccca

SEQ ID NO: 14232 - DNA, 201 bp, Homo sapiens
ccgtggaggctgttaatgccaagtgctcctcactggagaagaccaagcaccggctacagaatgagatagaggacttgatggtggacgtagagcgctccaaygctgctgctgcagccctggacaagaagcagagaaactttgacaaggtggaccatgggcgggggccgcagccagcatgcagggcaagggggcatgaggggt

SEQ ID NO: 14233 - DNA, 201 bp, Homo sapiens
tggaggctgttaatgccaagtgctcctcactggagaagaccaagcaccggctacagaatgagatagaggacttgatggtggacgtagagcgctccaatgcygctgctgcagccctggacaagaagcagagaaactttgacaaggtggaccatgggcgggggccgcagccagcatgcagggcaagggggcatgaggggttca

SEQ ID NO: 14234 - DNA, 201 bp, Homo sapiens
ccttcccttgatcctggttttatcttgcctcttggtcttcatcgacacttgtcacaatcatgcttctttgtctctctcccttgtccttccttcttggcacktgttctcacctccctgcctctctgcttctaaccctgtttccacaccccgtccctcgcactcatattgactcggtgccctttcttttctgcctctgcgtct

SEQ ID NO: 14235 - DNA, 201 bp, Homo sapiens
gtgagtagggcatggcgccggggcagaagggaaggaggtctgggaaagaagatgcagaggtggagccacttgcagggggagctgagagggctggagaaaasccaaggccagtggggatgccaggacatgctcctttgaggagcccagaatctgatccctctcaaattgacctgagctggtgcaacaggtgccacccagggc

SEQ ID NO: 14236 - DNA, 201 bp, Homo sapiens
cgtggcaagaaggacaatgccaatgcgaacaaggtgccatgggggacacaggctcggcagaacaggggttggggggcaggctgacccgagttacccctaaycctcccctccctgtgacgtggtggggacagccacactgagctgggctcccgatggtcagcccagtatggaagaccttcctgacaggagacactcaccctg

SEQ ID NO: 14237 - DNA, 201 bp, Homo sapiens
agggcatggcgccggggcagaagggaaggaggtctgggaaagaagatgcagaggtggagccacttgcagggggagctgagagggctggagaaaagccaagsccagtggggatgccaggacatgctcctttgaggagcccagaatctgatccctctcaaattgacctgagctggtgcaacaggtgccacccagggccatgtt

SEQ ID NO: 14238 - DNA, 201 bp, Homo sapiens
cagaagggaaggaggtctgggaaagaagatgcagaggtggagccacttgcagggggagctgagagggctggagaaaagccaaggccagtggggatgccagsacatgctcctttgaggagcccagaatctgatccctctcaaattgacctgagctggtgcaacaggtgccacccagggccatgttccccctgccagagagga

SEQ ID NO: 14239 - DNA, 201 bp, Homo sapiens
gggaaagaagatgcagaggtggagccacttgcagggggagctgagagggctggagaaaagccaaggccagtggggatgccaggacatgctcctttgaggascccagaatctgatccctctcaaattgacctgagctggtgcaacaggtgccacccagggccatgttccccctgccagagaggatgctgaggaagaagaacc

SEQ ID NO: 14240 - DNA, 201 bp, Homo sapiens
attgacctgagctggtgcaacaggtgccacccagggccatgttccccctgccagagaggatgctgaggaagaagaacctcagtgttcgcctaagaggggtsttgtagataaagagggcacagacacagcattaaatgatgcccccttcttgcacttgtatccctcttccctgtgcctcagtttcctccatgagtccacttt

SEQ ID NO: 14241 - DNA, 201 bp, Homo sapiens
aaagagggcacagacacagcattaaatgatgcccccttcttgcacttgtatccctcttccctgtgcctcagtttcctccatgagtccactttctcaaattmcgttcacccaaatcaagagtaattcttagacccagatgaacacaaagatcagaaacttttgagctgagcactctccttgactggcactcagaagctctgg

SEQ ID NO: 14242 - DNA, 201 bp, Homo sapiens
aagagggcacagacacagcattaaatgatgcccccttcttgcacttgtatccctcttccctgtgcctcagtttcctccatgagtccactttctcaaattcmgttcacccaaatcaagagtaattcttagacccagatgaacacaaagatcagaaacttttgagctgagcactctccttgactggcactcagaagctctggt

SEQ ID NO: 14243 - DNA, 201 bp, Homo sapiens
caagtgcctctaacgtgggaccacaggatccctggggccctgcctctccctccaagggcatctcccttaggcctctgaaagccccagggatttgtccccayacacttctccctcttgccagctgccccctcacacctcttattctttttgcagcaaaaaatgcacgatgaggagtgacactgcctcgggaacctcactctt

SEQ ID NO: 14244 - DNA, 201 bp, Homo sapiens
ccaggtctgccccaagacccttggaacatagggactgaagagtgatggtcatgggcacagggtgtccccaggatggtctggggatctggcaagagaaaggwaccctaggacagtctctaggatgggagatacaatgggaagggaaattacctggggaaagtgtcccaggggacatcggggtaggggccggggcactggtca

SEQ ID NO: 14245 - DNA, 201 bp, Homo sapiens
aatcaggtaacaaagtgtagtatatatttgatcatttttctctctccatgtctagaacaccagcctcatcaaccagaagaagaagatggagtcggatctgwcccagctccagtcggaagtggaggaggcagtgcaggagtgcagaaacgccgaggagaaggccaagaaggccatcacggatgtaagtgaccgcccaccttc

SEQ ID NO: 14246 - DNA, 201 bp, Homo sapiens
acaatcagacattgccaactgttccctggggcacaaaattgcccctagttgagaaccactgcttgagaggaacctaagttcctggtagcttttcagagccrgggggattccagtggaggggtccaggcggtgggtctgagccctttgtgtctgacccaggcacgcatcgaggagctggaggaggagctggaggccgagcgc

SEQ ID NO: 14247 - DNA, 201 bp, Homo sapiens
accaacctcatgcccagccttgtctcctgctccagacctactcgggcctcttctgtgtcactgtcaacccctacaagtggctgccggtgtacaatgccgargtggtggccgcctaccggggcaagaagaggagtgaggccccgccccacatcttctccatctccgacaacgcctatcagtacatgctgacaggtgagcctg

SEQ ID NO: 14248 - DNA, 201 bp, Homo sapiens
gccttgtctcctgctccagacctactcgggcctcttctgtgtcactgtcaacccctacaagtggctgccggtgtacaatgccgaggtggtggccgcctacmggggcaagaagaggagtgaggccccgccccacatcttctccatctccgacaacgcctatcagtacatgctgacaggtgagcctggtggcccctggtctct

SEQ ID NO: 14249 - DNA, 201 bp, Homo sapiens
ttgatctgctcagccctggaggtgccagcaaagccccatgctggagcctgtgtaacagctccttgggaggaagcagaataaagcaattttccttgaagccragatcctgactccagactcttcttcactgccctgaggacccggggatggggtctggactaggggaggtggaaatgcaggggagtgggggcaaattcaaag

SEQ ID NO: 14250 - DNA, 201 bp, Homo sapiens
cagtttgacttgagtctatgagtttttccagcaaatgaagaatctacttctacttcctgaaaactcttctaactagtctttccccaggtttctttctttctttttttttttttttaataactctaagtgctaccatgaagacttcagaacagttcaaagaatccttccaccttcgactgtggggataagagtcaggggagg

SEQ ID NO: 14251 - DNA, 201 bp, Homo sapiens
gtgcccctaaccaaccccctgcctagggcaggacatgacttgtgaaatggcccacaagcccctcatttcacctccaggagagttggcccggcagctagagsaaaaggaggcgctaatctcgcagctgacccgggggaagctctcttatacccagcaaatggaggacctcaaaaggcagctggaggaggagggcaaggtgag

SEQ ID NO: 14252 - DNA, 201 bp, Homo sapiens
gaaatggagcctggagctggaaagagtcctctgcaagggaaagaccctccagtctaggttctgccctgcagctaagcgtcatttaatgcctcttttcttaytcgtaaggggatggggtgagcagactgggaaactcctcaaacagtgaggtgccacatcagcccacatggtgaataaggctgggcttggttgaagtactac

SEQ ID NO: 14253 - DNA, 201 bp, Homo sapiens
gggtgtccccaggatggtctggggatctggcaagagaaaggtaccctaggacagtctctaggatgggagatacaatgggaagggaaattacctggggaaastgtcccaggggacatcggggtaggggccggggcactggtcagagcaaggggagcaaggccaagtccctgtgtcctgggaggaggtcagtgggcagtgctg

SEQ ID NO: 14254 - DNA, 201 bp, Homo sapiens
caggtctgccccaagacccttggaacatagggactgaagagtgatggtcatgggcacagggtgtccccaggatggtctggggatctggcaagagaaaggtwccctaggacagtctctaggatgggagatacaatgggaagggaaattacctggggaaagtgtcccaggggacatcggggtaggggccggggcactggtcag

SEQ ID NO: 14255 - DNA, 201 bp, Homo sapiens
cctcctttctttaattcaagtctctcttcagactgcgccctcccacaccttctgtgtccccctcctgccctctggcattccccatctctgaccctctcttycttcctctggtcgactcagcccctcccacactcacccttcctgtcttgcttcctgaaggcaaacctggagaaagtgtctcggacgctggaggaccaggcc

SEQ ID NO: 14256 - DNA, 201 bp, Homo sapiens
ggggtaggggccggggcactggtcagagcaaggggagcaaggccaagtccctgtgtcctgggaggaggtcagtgggcagtgctggcaagggtcccggaggrattgtggtcactcatcctcctgcttatgcgccccctccagacggtgactgtgaaggaggaccaggtgttgcagcagaacccacccaagttcgacaagatt

SEQ ID NO: 14257 - DNA, 201 bp, Homo sapiens
gggtaggggccggggcactggtcagagcaaggggagcaaggccaagtccctgtgtcctgggaggaggtcagtgggcagtgctggcaagggtcccggagggrttgtggtcactcatcctcctgcttatgcgccccctccagacggtgactgtgaaggaggaccaggtgttgcagcagaacccacccaagttcgacaagattg

SEQ ID NO: 14258 - DNA, 201 bp, Homo sapiens
aggcggtgggtctgagccctttgtgtctgacccaggcacgcatcgaggagctggaggaggagctggaggccgagcgcaccgccagggctaaggtggagaarctgcgctcagacctgtctcgggagctggaggagatcagcgagcggctggaagaggccggcggggccacgtccgtgcagatcgagatgaacaagaagcgcg

SEQ ID NO: 14259 - DNA, 201 bp, Homo sapiens
ccgagaactccctgcaccccatccctgttctgccgctgtctcccacttctccctcacctgggggtgaccctgaccccaggacaaaatctattcattccatrttctttgttcaacattatctacccactattcactacccatgactgcctccaaagccaaggtctgcacaaaggaaaatgtcagtctgattagaggccaaag

SEQ ID NO: 14260 - DNA, 201 bp, Homo sapiens
attgtggtcactcatcctcctgcttatgcgccccctccagacggtgactgtgaaggaggaccaggtgttgcagcagaacccacccaagttcgacaagattsaggacatggccatgctgaccttcctgcacgagcccgcggtgcttttcaacctcaaggagcgctacgcggcctggatgatatatgtgagtggctcctgcac

SEQ ID NO: 14261 - DNA, 201 bp, Homo sapiens
ccctctgggccgaggttccactaggaggtccctgcacagtgtgtgagggtggcatcctctgcccggcttcacttatactcaactgagacaccaaagaggtygtttacatttccagaaccatccagggcttctgggctgaacagagggccaggatttcactctgtccttcccgccagttccctcactctgtcccattcgtcc

SEQ ID NO: 14262 - DNA, 201 bp, Homo sapiens
ttgcctctgggctttaggatcctttttatttaagccacatcttctcgcctggccctcttcatcaagctgtgggtgccccctgccctctgcccccatggccrcctttttctggctctactctctttccttcctcacctgccttcctcccctccgcccacctcagacctgctggagaagtcccgggtgatcttccagctgaaa

SEQ ID NO: 14263 - DNA, 201 bp, Homo sapiens
agaagagaatctagagaatggggcacagggagtccctcccacctcctggtgcccccccccctccccaggcgaagaacgccctggcccatgcactgcagtcrgcccggcatgactgcgacctgctgcgggagcagtacgaggaggagacagaggccaaggccgagctgcagcgcgtcctgtccaaggccaactcggaggtgg

SEQ ID NO: 14264 - DNA, 201 bp, Homo sapiens
tgccccctgccctctgcccccatggccacctttttctggctctactctctttccttcctcacctgccttcctcccctccgcccacctcagacctgctggaraagtcccgggtgatcttccagctgaaagctgagagaaactaccacatcttctaccagattctgtccaacaagaagccggagttgctgggtgaacctgcct

SEQ ID NO: 14265 - DNA, 201 bp, Homo sapiens
ttgagaggctgagaatcccatagcccatctccagctcattcacccatccccactgtcccaccacaggaggagcaagccaacaccaacctgtccaagttccrcaaggtgcagcatgagctggatgaggcagaggagcgggcggacatcgctgagtcccaggtcaacaagcttcgagccaagagccgtgacattggtgccaag

SEQ ID NO: 14266 - DNA, 201 bp, Homo sapiens
ggtcaccaacaatccctacgactacgccttcgtgtctcagggagaggtgtccgtggcctccattgatgactccgaggagctcatggccaccgatgtgagtkagggggctgctgcggccgttcgagggaccccaggagctcctggggccaccgctccaacccccctctttgtctctcgctctgtcccagagtgcctttgacg

SEQ ID NO: 14267 - DNA, 201 bp, Homo sapiens
aagccccatgctggagcctgtgtaacagctccttgggaggaagcagaataaagcaattttccttgaagccgagatcctgactccagactcttcttcactgmcctgaggacccggggatggggtctggactaggggaggtggaaatgcaggggagtgggggcaaattcaaaggcctggcctaggaggccttcgtggagcagc

SEQ ID NO: 14268 - DNA, 201 bp, Homo sapiens
atttcagctcctgtttcagtggtaggttcatggatagtcattttgctttcatgctgcataacttacatacttattatagacattcttatatgtaaaccccyacataatttttaacatatttgaagttcttatgagaatagaaaaaccaaacagagtagacattctataagtggtagtttccattaccactaatatcccagc

SEQ ID NO: 14269 - DNA, 201 bp, Homo sapiens
agggaagggatggctcccgagagggccaggaggtggaggaaagagtaagtctcctccaactaaacaagttcagcccctttggagttcctgccacagctggrttgcttaggcaggcctgggactgtgggccacagaggtcaggggcttgaaaggcactggggctgtcggccccactgggaacctgggaagcagtggttcagc

SEQ ID NO: 14270 - DNA, 201 bp, Homo sapiens
aggtgggtgtgcacaagaaggaagtctacgtgcctacgaacttgcttagtagggcccatgattgggaagctctcttttatagtgccccaccctgcctccaygtttccttgccagggatgccctgctggtaatccagtggaacattcgggccttcatgggggtcaagaattggccctggatgaagctctacttcaagatcaa

SEQ ID NO: 14271 - DNA, 201 bp, Homo sapiens
aaactgccctttcatcaaattgattaataaatatttatcaagcaactccatgttcagtgtagtgatgttggaggtgggtgtgcacaagaaggaagtctacrtgcctacgaacttgcttagtagggcccatgattgggaagctctcttttatagtgccccaccctgcctccacgtttccttgccagggatgccctgctggta

SEQ ID NO: 14272 - DNA, 201 bp, Homo sapiens
agagctcatagaacagggggagccaggctgccctgatgggaatgggatctgcaggtgaccctggaattctgtgggcagagcagatcactgcagagcatggrtgactctggacacttccctcctcaggtatcgcatcctgaacccagtggccatccctgagggacagttcattgatagcaggaaggggacagagaagctgct

SEQ ID NO: 14273 - DNA, 201 bp, Homo sapiens
accaccttcctgttggttgagaaataagccagtctccagccctcttgcttatgggcattcctcagaagagacaaggccgcaggcgggaggccccataggcyggggctgacttgctctcagtgaacctctgctctttgtcagcataggccagagcccggattgtctgacccacacccagcccagccacggccttcatgaaat

SEQ ID NO: 14274 - DNA, 201 bp, Homo sapiens
gcgctgcaatggcgtgctggagggcatccgcatctgcaggaagggcttccccaaccgcatcctctacggggacttccggcagaggtgggtatgagggtgcmccagagctcatagaacagggggagccaggctgccctgatgggaatgggatctgcaggtgaccctggaattctgtgggcagagcagatcactgcagagcat

SEQ ID NO: 14275 - DNA, 201 bp, Homo sapiens
ccaccttcctgttggttgagaaataagccagtctccagccctcttgcttatgggcattcctcagaagagacaaggccgcaggcgggaggccccataggccrgggctgacttgctctcagtgaacctctgctctttgtcagcataggccagagcccggattgtctgacccacacccagcccagccacggccttcatgaaatg

SEQ ID NO: 14276 - DNA, 201 bp, Homo sapiens
ccctagaattaacttctatggcccctgaagcttttttgctctctgtagttcctcactacagtaggtctctgaatcctttgtgcttgcaggatttctctgtyggtttgacttccaatcccactggacttcaagtttagaaggaggcaaaagagcatacactatggatttcatgttttccacactttgcttattttcttccct

SEQ ID NO: 14277 - DNA, 201 bp, Homo sapiens
gtaagaggtaccagcacagcgccccttcagcaggccagcgctactggctccagattccttttcctgtcagggtatgggactgtggaagcctgggagtgtgytcagtgattctctctttgcctcttcaccctgccctcagcccatgggcatcatgtccatcctggaggaggagtgcatgttccccaaggccactgacatgac

SEQ ID NO: 14278 - DNA, 201 bp, Homo sapiens
atgataaactgcagctggaagaaaagcttaagaagtaggagactgtggtggccaggaggggctaatggaggtgtctggcctggtagatagagtgcagggtsctgcgcctccactggccacagttgccttgggtatgctgggaataaggtcaatcacagccctcttccgccactttctgggctggcgaggggagggggaggt

SEQ ID NO: 14279 - DNA, 201 bp, Homo sapiens
tgataaactgcagctggaagaaaagcttaagaagtaggagactgtggtggccaggaggggctaatggaggtgtctggcctggtagatagagtgcagggtgstgcgcctccactggccacagttgccttgggtatgctgggaataaggtcaatcacagccctcttccgccactttctgggctggcgaggggagggggaggtg

SEQ ID NO: 14280 - DNA, 201 bp, Homo sapiens
ccagtgcatgaaagtgggagctcaatagccctgaggtaactgaggctgcagcagctgcttagggttctacacaatatctggaactccaggcagcctcataracccaaccatccctgacttacaggcgctcaggaacactagccttcccccatagagcaagaatacattacgttagcaaaactgtttgagaagggggactca

SEQ ID NO: 14281 - DNA, 201 bp, Homo sapiens
aggcccatggcccaggctgcaagtaatgtatgaacacaattccactcctctggggctgcacagggactggcccgccttcattagtaatttgccctcccatsttcttggatgccccttctgggttttagctagaatatcgggccatcctcaggttcttctaccctaggtctgggcaacttgtttggcctcttggacacagaa

SEQ ID NO: 14282 - DNA, 201 bp, Homo sapiens
aagagagcataggctttggagccaaaggtctgactttccacttgctcagcaagtccttacacctctctgagccctagttccttcacctgtgaaacaggggractaatatccaccctgcagattactgggaggattaggtgagatcatatgagaggtatgagcaggaggcattctgtatgtgttcccctctgggccgaggtt

SEQ ID NO: 14283 - DNA, 201 bp, Homo sapiens
aaaaatctgcatgtgtggctgaagatgggcacagacacggtcaagtctgtatgtgagagtgctgaactggggttctgtgtgaaaatctgcctgaggcggcrgggagaatcactgccattgcgtgagcaggttggatgttggccactctatcaggagcattagggaaggggtggggactccagacgtgtccccaaaccaggg

SEQ ID NO: 14284 - DNA, 201 bp, Homo sapiens
gaagatgggcacagacacggtcaagtctgtatgtgagagtgctgaactggggttctgtgtgaaaatctgcctgaggcggcagggagaatcactgccattgygtgagcaggttggatgttggccactctatcaggagcattagggaaggggtggggactccagacgtgtccccaaaccagggtggcctcaagaccttgggag

SEQ ID NO: 14285 - DNA, 201 bp, Homo sapiens
gcagggaggggcagcaaaggcaaggggagaagagtaaaatgatggaggagggaaaggtgattgcatttgctccccctccaaaccagcttctcccaccctcycacccccagacagaggaagacaaaaagaacctgctgcggctacaggacctggtggacaagctgcaactgaaggtcaaggcctacaagcgccaggccgagg

SEQ ID NO: 14286 - DNA, 201 bp, Homo sapiens
gcgtctagaggcccagacccggccctttgacattcgcactgagtgcttcgtgcccgatgacaaggaagagtttgtcaaagccaagattttgtcccgggagrgaggcaaggtcattgctgaaaccgagaatgggaaggtgagtagggcatggcgccggggcagaagggaaggaggtctgggaaagaagatgcagaggtggag

SEQ ID NO: 14287 - DNA, 201 bp, Homo sapiens
gcccgatgacaaggaagagtttgtcaaagccaagattttgtcccgggagggaggcaaggtcattgctgaaaccgagaatgggaaggtgagtagggcatggygccggggcagaagggaaggaggtctgggaaagaagatgcagaggtggagccacttgcagggggagctgagagggctggagaaaagccaaggccagtgggg

SEQ ID NO: 14288 - DNA, 201 bp, Homo sapiens
ggagcccagaatctgatccctctcaaattgacctgagctggtgcaacaggtgccacccagggccatgttccccctgccagagaggatgctgaggaagaagracctcagtgttcgcctaagaggggtcttgtagataaagagggcacagacacagcattaaatgatgcccccttcttgcacttgtatccctcttccctgtgc

SEQ ID NO: 14289 - DNA, 201 bp, Homo sapiens
gagtaattcttagacccagatgaacacaaagatcagaaacttttgagctgagcactctccttgactggcactcagaagctctggtccctggtttgctcacrccagccaagagaatcacccctggttaccagctgcggctcagggctgtgtgcctcatgaactcgttgactgaatgttacaacccattgaagtgtagaataa

SEQ ID NO: 14290 - DNA, 201 bp, Homo sapiens
ctgtcccaggctctccccaccaacctcatgcccagccttgtctcctgctccagacctactcgggcctcttctgtgtcactgtcaacccctacaagtggctrccggtgtacaatgccgaggtggtggccgcctaccggggcaagaagaggagtgaggccccgccccacatcttctccatctccgacaacgcctatcagtaca

SEQ ID NO: 14291 - DNA, 201 bp, Homo sapiens
ggtatgaaatcaggtaacaaagtgtagtatatatttgatcatttttctctctccatgtctagaacaccagcctcatcaaccagaagaagaagatggagtckgatctgacccagctccagtcggaagtggaggaggcagtgcaggagtgcagaaacgccgaggagaaggccaagaaggccatcacggatgtaagtgaccgcc

SEQ ID NO: 14292 - DNA, 201 bp, Homo sapiens
ctgctagtttccagttcccttccacctaattttgtcctgcaatcttgtaactcaaacctaaaatggacatcccagagaacccgggcctggctttgttctcrcccaggcaacttccctctgaccaaccccagaaccctaccctccagaacttgccccccgaacatcgatccctggaaacacatgtgctgctgccacaggggc

SEQ ID NO: 14293 - DNA, 201 bp, Homo sapiens
gccaggacacctggtggaatggcccagcccagagacttctggctgcaccacctattctgatgcttgagtttgatgaggaaagaagctagggctacgtagtygttttttagtgtgtagattccacaaaagcctgaactcacgtcacaaattatgtggcagcccctgtccctttgatgattctggtggagagtgtctggggac

SEQ ID NO: 14294 - DNA, 201 bp, Homo sapiens
aatctggccataataataaccacttagacagtgggtaggagtgtggggttccagagtcaaacaggcctgagttggaacacagcttgaggactttcactgcrgcgttgggcaaaatctttaatctctctctgcctcagttttctcatctgtaaaatggaattaactgtacatacctcatatgattttacacatgattattat

SEQ ID NO: 14295 - DNA, 201 bp, Homo sapiens
tggctgcaccacctattctgatgcttgagtttgatgaggaaagaagctagggctacgtagtcgttttttagtgtgtagattccacaaaagcctgaactcaygtcacaaattatgtggcagcccctgtccctttgatgattctggtggagagtgtctggggaccagggtttaagggcctaagggatggtccttgtggctcct

SEQ ID NO: 14296 - DNA, 201 bp, Homo sapiens; identical to SEQ ID NO: 1915

SEQ ID NO: 14297 - DNA, 201 bp, Homo sapiens
ccgcatggctgccgaggcccagaagcaagtcaagagcctccagagcttgctgaaggtacatgggggcgggaggtcccctcaggggactggcctccatgtgscctggagaagcagtggtgtctggatacaggcaccagattcctcctgcccctgggttactgcagggacctctgacaggtgccctcagtgaagggcaccgag

SEQ ID NO: 14298 - DNA, 201 bp, Homo sapiens
tggcctggagaagcagtggtgtctggatacaggcaccagattcctcctgcccctgggttactgcagggacctctgacaggtgccctcagtgaagggcacckaggctggcttctgctcacacccactctcctgatgctcaggacacccagatccagctggacgatgcggtccgtgccaacgacgacctgaaggagaacatcg

SEQ ID NO: 14299 - DNA, 201 bp, Homo sapiens
gtgacagaggcagtcattgtccctgtcttcaggggaagccctcctccactgccctgacatggaggggacagccataccctgctgggctcggcacagtgcaygggcacagccccaatggccactcacacccactttctgactgctcccacccctcatgccccctgcagttcaacagctttgagcagctctgcatcaacttca

SEQ ID NO: 14300 - DNA, 201 bp, Homo sapiens
ctgcagggacctctgacaggtgccctcagtgaagggcaccgaggctggcttctgctcacacccactctcctgatgctcaggacacccagatccagctggaygatgcggtccgtgccaacgacgacctgaaggagaacatcgccatcgtggagcggcgcaacaacctgctgcaggctgagctggaggagctgcgtgccgtgg

SEQ ID NO: 14301 - DNA, 201 bp, Homo sapiens
taaaagtgggcttgttgttttaaaaaaaaaatgaccacctttaattctttctggagaaagggtatgaaatcaggtaacaaagtgtagtatatatttgatcrtttttctctctccatgtctagaacaccagcctcatcaaccagaagaagaagatggagtcggatctgacccagctccagtcggaagtggaggaggcagtgc

SEQ ID NO: 14302 - DNA, 201 bp, Homo sapiens
agccctctcctcccctcccctagattatagcccatctcacaaccagggactgggagtctaggagtgccagctctttttaagaccctaggtctcctctcttyaaccatcagcttcctccctgttctcttctcccaggaacaagacaacctcaatgatgctgaggagcgctgcgaccagctgatcaaaaacaagattcagctg

SEQ ID NO: 14303 - DNA, 201 bp, Homo sapiens
ccactctcctgctcaaaacagccccccactgactggaacttctgcagagatccccagttccatccccctaaaccacaagtgcctctaacgtgggaccacargatccctggggccctgcctctccctccaagggcatctcccttaggcctctgaaagccccagggatttgtccccacacacttctccctcttgccagctgcc

SEQ ID NO: 14304 - DNA, 201 bp, Homo sapiens
gctttgagctttctggccctctggtccccagaggaaatctcggaccttactgagcagctaggagaaggaggaaagaatgtgcatgagctggagaaggtcckcaaacagctggaggtggagaagctggagctgcagtcagccctggaggaggcagaggtgagggccgagaactccctgcaccccatccctgttctgccgctg

SEQ ID NO: 14305 - DNA, 201 bp, Homo sapiens
gatccccagttccatccccctaaaccacaagtgcctctaacgtgggaccacaggatccctggggccctgcctctccctccaagggcatctcccttaggccyctgaaagccccagggatttgtccccacacacttctccctcttgccagctgccccctcacacctcttattctttttgcagcaaaaaatgcacgatgaggag

SEQ ID NO: 14306 - DNA, 201 bp, Homo sapiens
tccccagttccatccccctaaaccacaagtgcctctaacgtgggaccacaggatccctggggccctgcctctccctccaagggcatctcccttaggcctcwgaaagccccagggatttgtccccacacacttctccctcttgccagctgccccctcacacctcttattctttttgcagcaaaaaatgcacgatgaggagtg

SEQ ID NO: 14307 - DNA, 201 bp, Homo sapiens
gaatgagatagaggacttgatggtggacgtagagcgctccaatgctgctgctgcagccctggacaagaagcagagaaactttgacaaggtggaccatgggygggggccgcagccagcatgcagggcaagggggcatgaggggttcagtgagaggccaaaggcaacctccttggaggtggaggaggagggctaagcccaggc

SEQ ID NO: 14308 - DNA, 201 bp, Homo sapiens
gggattgcagggagcatggggcactgagctctcattagaggggtgccagagcaatgaaccatgtcaggcaaatcctgctgggtgctgggctctgatggccrggctgggaaggggagcatgtgatgctgagccctgtatggagaacagtaggaatcctgagttttgattggtctctgtggcccccaggggagaatccggggc

SEQ ID NO: 14309 - DNA, 201 bp, Homo sapiens
gctgttttgccacacccagttgattgtactgtatctggctttgggatatcaacatgcacacgttggtgggaagagagcataggctttggagccaaaggtcygactttccacttgctcagcaagtccttacacctctctgagccctagttccttcacctgtgaaacagggggactaatatccaccctgcagattactgggag

SEQ ID NO: 14310 - DNA, 201 bp, Homo sapiens
cttatactcaactgagacaccaaagaggtcgtttacatttccagaaccatccagggcttctgggctgaacagagggccaggatttcactctgtccttcccrccagttccctcactctgtcccattcgtccccaggggaaattcattaggatccactttggggccactggaaagctggcttctgcagacatagagacctgtg

SEQ ID NO: 14311 - DNA, 201 bp, Homo sapiens
ccctcttcatcaagctgtgggtgccccctgccctctgcccccatggccacctttttctggctctactctctttccttcctcacctgccttcctcccctccrcccacctcagacctgctggagaagtcccgggtgatcttccagctgaaagctgagagaaactaccacatcttctaccagattctgtccaacaagaagccgg

SEQ ID NO: 14312 - DNA, 201 bp, Homo sapiens
tagcccctcagccacacccttgccctggagaggcgagggatatggtgaaggtggggatatgcccacagcagtgcttgtgaaagacctgacccagagatgcyacagatgtagagacagagctgagaagagccagttgtggcaagaggccatgggccggataagggggctgtgctccagcctgactcaggcacacgttggttg

SEQ ID NO: 14313 - DNA, 201 bp, Homo sapiens
agttcacccttcgggttaaaaataactgaggtaagggccatggcagggtgggagaggcggtgtgagaaggtcctgtcttcccactatctgctcatcagccytttgaaggggaggaatgtgcccaaggactaaaaaaaggccgtggagccagagaggctggggcagcagacctttcttgggcaaatcagggggccctgctgt

SEQ ID NO: 14314 - DNA, 201 bp, Homo sapiens
cccctgggagtgggagaacaatcactcgcttgctcctacattcaacagccatttgctgagagccagctgtggaccagacatgggaaggcagtggggactgygtggtgacagaggcagtcattgtccctgtcttcaggggaagccctcctccactgccctgacatggaggggacagccataccctgctgggctcggcacagt

SEQ ID NO: 14315 - DNA, 201 bp, Homo sapiens
tcatgtttcagagccctcagaatgccataaaactgtgtgtggaaaaaagcatgtgtacattcatacatacatgtgtgtgcttgtgcatgtgtgtgtgtgtrcgtgtgtgtgtgtacatgcgtttttctggagagacagtctttagcttcaacaaattcttaaaaggattcctgccccaagaaaaatcaagaaccaccaggt

SEQ ID NO: 14316 - DNA, 201 bp, Homo sapiens
gtaaaagcaaaggaggcaagaaaaagggctcatccttccagacggtgtcggctctccaccgggtaagaagggcccaggggtgccaggacacctggtggaayggcccagcccagagacttctggctgcaccacctattctgatgcttgagtttgatgaggaaagaagctagggctacgtagtcgttttttagtgtgtagatt

SEQ ID NO: 14317 - DNA, 201 bp, Homo sapiens
tcattgatagcaggaaggggacagagaagctgctcagctctctggacattgatcacaaccagtacaagtttggccacaccaaggtgagtctagagccccaytgggtggttgcagggcaggtggccatgttgagtggagcagagaggagtttaggaggcagaagcctaattctggcttccttatcaaccttatcaagggctg

SEQ ID NO: 14318 - DNA, 201 bp, Homo sapiens
ctcccctctgaggctgcggcctgttgcatctaccccttgcctgcaggtgttcttcaaggcagggctgcttgggctgctggaggagatgcgggatgagaggmtgagccgcatcatcacgcgcatgcaggcccaagcccggggccagctcatgcgcattgagttcaagaagatagtggaacgcaggtgagacaggaggaaaag

SEQ ID NO: 14319 - DNA, 201 bp, Homo sapiens
gcttgctcctacattcaacagccatttgctgagagccagctgtggaccagacatgggaaggcagtggggactgtgtggtgacagaggcagtcattgtcccygtcttcaggggaagccctcctccactgccctgacatggaggggacagccataccctgctgggctcggcacagtgcacgggcacagccccaatggccactc

SEQ ID NO: 14320 - DNA, 201 bp, Homo sapiens
cagaggagaaagctggcgtctacaagctgacgggagccatcatgcactacgggaacatgaagttcaagcagaagcagcgggaggagcaggcggagccagasggcaccgaaggtgggaggggcaggcaggcagccctgggaaggcctgaggtgctgaccaggctctctgcgggactcagatcccagagactctgaggcttgt

SEQ ID NO: 14321 - DNA, 201 bp, Homo sapiens
cttcagaggagaaagctggcgtctacaagctgacgggagccatcatgcactacgggaacatgaagttcaagcagaagcagcgggaggagcaggcggagccmgacggcaccgaaggtgggaggggcaggcaggcagccctgggaaggcctgaggtgctgaccaggctctctgcgggactcagatcccagagactctgaggct

SEQ ID NO: 14322 - DNA, 201 bp, Homo sapiens
tgcatgagctggagaaggtccgcaaacagctggaggtggagaagctggagctgcagtcagccctggaggaggcagaggtgagggccgagaactccctgcaycccatccctgttctgccgctgtctcccacttctccctcacctgggggtgaccctgaccccaggacaaaatctattcattccatattctttgttcaacatt

SEQ ID NO: 14323 - DNA, 201 bp, Homo sapiens
cattgtccctgtcttcaggggaagccctcctccactgccctgacatggaggggacagccataccctgctgggctcggcacagtgcacgggcacagccccartggccactcacacccactttctgactgctcccacccctcatgccccctgcagttcaacagctttgagcagctctgcatcaacttcaccaacgagaagctg

SEQ ID NO: 14324 - DNA, 201 bp, Homo sapiens
agcgggtgaagcagaagctggagaaggagaagagcgagttcaagctggagctggatgacgtcacctccaacatggagcagatcatcaaggccaaggcaggstctgctcggcctcccctcgccctctcccctgcacagcggagcctcccccatgccttctctctctgtctgccatctcccttgtcattctcattctcttcat

SEQ ID NO: 14325 - DNA, 201 bp, Homo sapiens
ggccgagcagaagcgcaacgcagagtcggtgaagggcatgaggaagagcgagcggcgcatcaaggagctcacctaccaggtgcggcggacgccagacaccrggagtagatgtggaagtttcttctctggccccactgccccgccctcacagggctcctctcacctcctccttgagatgctgttggtagatttaacgttctt

SEQ ID NO: 14326 - DNA, 201 bp, Homo sapiens
gctggtagtactgggtggcatagaggaagaggaaggcaagtgtgatgaagaactccagtagcgccgcggccatgtaggcagagatggaggccgtgaagcaratgaagatgatgagggtcagggcctgcaggaccgagcatgtggaacatgccaagaaggggacacaggcaggggccagggctttgccttcccctccttgga

SEQ ID NO: 14327 - DNA, 201 bp, Homo sapiens
tccactcctgagtacattcctacagagaaactcttatacatgtacaccatgacatgaaaaataatcttttagcagcattggtcataatagcaaagatcttraaacaacttgaatttccatccacaggggaatgggtaaatagtattacagtcattcagtggaatattataaaacagtgaaaagatgtgaactccaactaca

SEQ ID NO: 14328 - DNA, 201 bp, Homo sapiens
gtggcttctgatacagaaagtgtgcaagcaccagcctgagctcttgaggggctaaggagtcctgcagggctgaactcacaaaagcagcaatggcagctccrtcccgggaggtcacagctgcaaaggagaccaccaggaagatgatgatggcactgacacagcgcaggaagtcctgggggccaggggtgcagggttaacagg

SEQ ID NO: 14329 - DNA, 201 bp, Homo sapiens
agagaggctggggcagcagacctttcttgggcaaatcagggggccctgctgtcctcctgtcacctccagagccaaaggatcaaaggaggaggagccaggargggagagaggtgggagggagggtccctccggaaggactccaaatttagacagagggtgggggaaacgggatataaaggaactggagctttgaggacagat

SEQ ID NO: 14330 - DNA, 201 bp, Homo sapiens
atcttaaaacaacttgaatttccatccacaggggaatgggtaaatagtattacagtcattcagtggaatattataaaacagtgaaaagatgtgaactccarctacatgatacaatatgtttgaacattaaagcatattgttagtaaacaaaggcaaatcttggaaggatacatacagtatgatgcaatttttataaagctc

SEQ ID NO: 14331 - DNA, 201 bp, Homo sapiens
gaggaaggaaggctacctgtcactcccccacccccacccttctcctgcaggaaggagtttgacattaatcagcagaacagtaagattgaggatgagcaggygctggcccttcaactacagaagaaactgaaggaaaaccaggtgactttttttcccagtgcatgaaagtgggagctcaatagccctgaggtaactgaggct

SEQ ID NO: 14332 - DNA, 201 bp, Homo sapiens
cttcattagtaatttgccctcccatcttcttggatgccccttctgggttttagctagaatatcgggccatcctcaggttcttctaccctaggtctgggcawcttgtttggcctcttggacacagaataacagtcctgttagtctcatcagctctcggcaataggctatggctcctccttcatccccaagatcttgctcaga

SEQ ID NO: 14333 - DNA, 201 bp, Homo sapiens
ggattccagtggaggggtccaggcggtgggtctgagccctttgtgtctgacccaggcacgcatcgaggagctggaggaggagctggaggccgagcgcaccrccagggctaaggtggagaagctgcgctcagacctgtctcgggagctggaggagatcagcgagcggctggaagaggccggcggggccacgtccgtgcagat

SEQ ID NO: 14334 - DNA, 201 bp, Homo sapiens
ccttcaagcgggagaacaagaaccttcagggtgtgctgggggtccaagaggccagagatgagttggtgggagggagggccatgcaggggcagggggaacayaggctttgagctttctggccctctggtccccagaggaaatctcggaccttactgagcagctaggagaaggaggaaagaatgtgcatgagctggagaaggt

SEQ ID NO: 14335 - DNA, 201 bp, Homo sapiens
tgcctgcaggtgttcttcaaggcagggctgcttgggctgctggaggagatgcgggatgagaggctgagccgcatcatcacgcgcatgcaggcccaagcccrgggccagctcatgcgcattgagttcaagaagatagtggaacgcaggtgagacaggaggaaaagggaggcatgcactagagatgtagaggcagatccgcaa

SEQ ID NO: 14336 - DNA, 201 bp, Homo sapiens
gatatcaacatgcacacgttggtgggaagagagcataggctttggagccaaaggtctgactttccacttgctcagcaagtccttacacctctctgagcccyagttccttcacctgtgaaacagggggactaatatccaccctgcagattactgggaggattaggtgagatcatatgagaggtatgagcaggaggcattctg

SEQ ID NO: 14337 - DNA, 201 bp, Homo sapiens
gagtgccatcctcccacagaagggactgggctgggggcatacacgctgatgcctagggtgtagttgggaggagaggtttaaggctgggattgcagggagcmtggggcactgagctctcattagaggggtgccagagcaatgaaccatgtcaggcaaatcctgctgggtgctgggctctgatggccaggctgggaaggggag

SEQ ID NO: 14338 - DNA, 201 bp, Homo sapiens
agacctccctggatgcagagacacgcagccgcaacgaggtcctgagggtgaagaagaagatggaaggagacctcaatgagatggagatccagctcagccaygccaaccgcatggctgccgaggcccagaagcaagtcaagagcctccagagcttgctgaaggtacatgggggcgggaggtcccctcaggggactggcctcc

SEQ ID NO: 14339 - DNA, 201 bp, Homo sapiens; identical to SEQ ID NO: 1895

SEQ ID NO: 14340 - DNA, 201 bp, Homo sapiens
tcaccaaggggcagagcgtgcagcaggtgtactactccatcggggctctggccaaggcagtgtatgagaagatgttcaactggatggtgacgcgcatcaaygccaccctggagaccaagcagccacgccagtacttcataggagtcctggacatcgctggcttcgagatcttcgacgtgagttgggacccctgggagtggg

SEQ ID NO: 14341 - DNA, 201 bp, Homo sapiens
ctgggggtccaagaggccagagatgagttggtgggagggagggccatgcaggggcagggggaacacaggctttgagctttctggccctctggtccccagargaaatctcggaccttactgagcagctaggagaaggaggaaagaatgtgcatgagctggagaaggtccgcaaacagctggaggtggagaagctggagctgc

SEQ ID NO: 14342 - DNA, 201 bp, Homo sapiens
tggagcctgtgtaacagctccttgggaggaagcagaataaagcaattttccttgaagccgagatcctgactccagactcttcttcactgccctgaggaccyggggatggggtctggactaggggaggtggaaatgcaggggagtgggggcaaattcaaaggcctggcctaggaggccttcgtggagcagcactgaaaaccc

SEQ ID NO: 14343 - DNA, 201 bp, Homo sapiens
tgatagagctctattctcctctaacccttcctctggtagttcagccctctgaacgcagggtgaaaaaaaaaaaaggcttcaaggagcaccttcctgtgagstgctctgttcatattcttcccggtactaaccccagccactaacccaggctgagtccccatagggcactcatgataagagccaattccaacaactgtgagc

SEQ ID NO: 14344 - DNA, 201 bp, Homo sapiens
aaatggacatcccagagaacccgggcctggctttgttctcgcccaggcaacttccctctgaccaaccccagaaccctaccctccagaacttgccccccgamcatcgatccctggaaacacatgtgctgctgccacaggggcttccacctgcccacaaagcaggccccccaccatcagacccctctcacctttgttcccatg

SEQ ID NO: 14345 - DNA, 201 bp, Homo sapiens
gatagagctctattctcctctaacccttcctctggtagttcagccctctgaacgcagggtgaaaaaaaaaaaaggcttcaaggagcaccttcctgtgagckgctctgttcatattcttcccggtactaaccccagccactaacccaggctgagtccccatagggcactcatgataagagccaattccaacaactgtgagca

SEQ ID NO: 14346 - DNA, 201 bp, Homo sapiens
tctagaacaccagcctcatcaaccagaagaagaagatggagtcggatctgacccagctccagtcggaagtggaggaggcagtgcaggagtgcagaaacgcygaggagaaggccaagaaggccatcacggatgtaagtgaccgcccaccttccgcctcccctaaagacagaaacaaggccttgggtccaggccaggccactg

SEQ ID NO: 14347 - DNA, 201 bp, Homo sapiens
aaccacttagacagtgggtaggagtgtggggttccagagtcaaacaggcctgagttggaacacagcttgaggactttcactgcggcgttgggcaaaatctktaatctctctctgcctcagttttctcatctgtaaaatggaattaactgtacatacctcatatgattttacacatgattattataaagattaaatgaggta

SEQ ID NO: 14348 - DNA, 201 bp, Homo sapiens
gtgtccccaggatggtctggggatctggcaagagaaaggtaccctaggacagtctctaggatgggagatacaatgggaagggaaattacctggggaaagtstcccaggggacatcggggtaggggccggggcactggtcagagcaaggggagcaaggccaagtccctgtgtcctgggaggaggtcagtgggcagtgctggc

SEQ ID NO: 14349 - DNA, 201 bp, Homo sapiens
tcttctcagctcttcttctctgggcgatagtcctggctgacaccgtgtatcttctcatcctccctctcaaccctgccctgtgccctgtctgcccgccctcrccccaccccttcccaggcctccctggagcacgaggagggcaagatcctccgggcccagctagagttcaaccagatcaaggcagagatcgagcggaagctg

SEQ ID NO: 14350 - DNA, 201 bp, Homo sapiens
cagagacacgcagccgcaacgaggtcctgagggtgaagaagaagatggaaggagacctcaatgagatggagatccagctcagccacgccaaccgcatggcygccgaggcccagaagcaagtcaagagcctccagagcttgctgaaggtacatgggggcgggaggtcccctcaggggactggcctccatgtggcctggagaa

SEQ ID NO: 14351 - DNA, 201 bp, Homo sapiens
ttagtaatcttagatacaatgtctagaatgtatgcactttcataggaaaagggaaagcaggtacaaaacgatcaatagtctaaaagtgggcttgttgtttwaaaaaaaaaatgaccacctttaattctttctggagaaagggtatgaaatcaggtaacaaagtgtagtatatatttgatcatttttctctctccatgtcta

SEQ ID NO: 14352 - DNA, 201 bp, Homo sapiens
tgtatgcactttcataggaaaagggaaagcaggtacaaaacgatcaatagtctaaaagtgggcttgttgttttaaaaaaaaaatgaccacctttaattctytctggagaaagggtatgaaatcaggtaacaaagtgtagtatatatttgatcatttttctctctccatgtctagaacaccagcctcatcaaccagaagaag

SEQ ID NO: 14353 - DNA, 201 bp, Homo sapiens
tgacttcagccttcattgctctgtggatccctgactgacaaccttgcattgcccctttgacctacgatagagtcagagaatcttccccaccacctctttgmcctggatcattgcagggaggggcagcaaaggcaaggggagaagagtaaaatgatggaggagggaaaggtgattgcatttgctccccctccaaaccagctt

SEQ ID NO: 14354 - DNA, 201 bp, Homo sapiens
ggggcagtggatggccgtgaaggactctgagtgctggacatgtttgagaagagtgcaaggcagttgcaggatacccttgggaaggctgttgcaggaatatkcatgaggcatgggtgcctcagggacagggagctggaacctcaggttgagaggctgagaatcccatagcccatctccagctcattcacccatccccactgt

SEQ ID NO: 14355 - DNA, 201 bp, Homo sapiens
ggatggccgtgaaggactctgagtgctggacatgtttgagaagagtgcaaggcagttgcaggatacccttgggaaggctgttgcaggaatatgcatgaggyatgggtgcctcagggacagggagctggaacctcaggttgagaggctgagaatcccatagcccatctccagctcattcacccatccccactgtcccaccac

SEQ ID NO: 14356 - DNA, 201 bp, Homo sapiens
tcatggatagtcattttgctttcatgctgcataacttacatacttattatagacattcttatatgtaaacccctacataatttttaacatatttgaagttmttatgagaatagaaaaaccaaacagagtagacattctataagtggtagtttccattaccactaatatcccagctgggaggatataaactgccctttcatc

SEQ ID NO: 14357 - DNA, 201 bp, Homo sapiens
acttcagaggagaaagctggcgtctacaagctgacgggagccatcatgcactacgggaacatgaagttcaagcagaagcagcgggaggagcaggcggagcmagacggcaccgaaggtgggaggggcaggcaggcagccctgggaaggcctgaggtgctgaccaggctctctgcgggactcagatcccagagactctgaggc

SEQ ID NO: 14358 - DNA, 201 bp, Homo sapiens; identical to SEQ ID NO: 1921

SEQ ID NO: 14359 - DNA, 201 bp, Homo sapiens
cctcttcatcaagctgtgggtgccccctgccctctgcccccatggccacctttttctggctctactctctttccttcctcacctgccttcctcccctccgsccacctcagacctgctggagaagtcccgggtgatcttccagctgaaagctgagagaaactaccacatcttctaccagattctgtccaacaagaagccgga

SEQ ID NO: 14360 - DNA, 201 bp, Homo sapiens
atgaaatcaggtaacaaagtgtagtatatatttgatcatttttctctctccatgtctagaacaccagcctcatcaaccagaagaagaagatggagtcggayctgacccagctccagtcggaagtggaggaggcagtgcaggagtgcagaaacgccgaggagaaggccaagaaggccatcacggatgtaagtgaccgcccac

SEQ ID NO: 14361 - DNA, 201 bp, Homo sapiens
tgcaggcaaatcatttagtcatttagagccacggatttctccactataaaaaacactggaatacctactggcaggatctaatgacatcagggcatggcaarctgactgctgccaatcaaaccacaccaacagtgatggatggggagtgtggagtagatgggtgaactacttttccagcaggggtgaaggtttgccctgagc

SEQ ID NO: 14362 - DNA, 201 bp, Homo sapiens
cgacaagattgaggacatggccatgctgaccttcctgcacgagcccgcggtgcttttcaacctcaaggagcgctacgcggcctggatgatatatgtgagtrgctcctgcacactgcagaggcttcctgtgctgcgtggaggcctaaataagccaggggggctctcccaagaagagggggagagactcccaagggacccaag

SEQ ID NO: 14363 - DNA, 201 bp, Homo sapiens
acagatacaaaaattagcctggcatggtggctcatgtctgtagtcccagctacttgggaggctgaggcaggaaaatcacttgaacccaggaggtggaggcygtagtgagccaagatcgtgccactgcactcaagcctgggtgacagagcaagcctctatcttaaaaaaaaaaaaaggaagtgctcacttatcctttccctc

SEQ ID NO: 14364 - DNA, 201 bp, Homo sapiens
gatggtgacgcgcatcaacgccaccctggagaccaagcagccacgccagtacttcataggagtcctggacatcgctggcttcgagatcttcgacgtgagtwgggacccctgggagtgggagaacaatcactcgcttgctcctacattcaacagccatttgctgagagccagctgtggaccagacatgggaaggcagtgggg

SEQ ID NO: 14365 - DNA, 201 bp, Homo sapiens
tgggtcagaagacctgggttcagacctaccagctggcctgggcaagttactttaccacttcgaatctcattgcaaattcttcttcttcttcttcttcttctttttttttttttaaagaaacttctctataggaaaatgcaaattaagacaccaatgaaataccattttaaaacactagactttgcttgctcagatggtcta

SEQ ID NO: 14366 - DNA, 201 bp, Homo sapiens
gggtcagaagacctgggttcagacctaccagctggcctgggcaagttactttaccacttcgaatctcattgcaaattcttcttcttcttcttcttcttctttttttttttttaaagaaacttctctataggaaaatgcaaattaagacaccaatgaaataccattttaaaacactagactttgcttgctcagatggtctac

SEQ ID NO: 14367 - DNA, 201 bp, Homo sapiens
gggaacaggggaggaaagcccatggttgggaggcggaggacaggcatttggcctgcaggagaaggtgaccctcacccatgttttcagttcacccttcgggktaaaaataactgaggtaagggccatggcagggtgggagaggcggtgtgagaaggtcctgtcttcccactatctgctcatcagccctttgaaggggaggaa

SEQ ID NO: 14368 - DNA, 201 bp, Homo sapiens
ggaacaggggaggaaagcccatggttgggaggcggaggacaggcatttggcctgcaggagaaggtgaccctcacccatgttttcagttcacccttcgggtkaaaaataactgaggtaagggccatggcagggtgggagaggcggtgtgagaaggtcctgtcttcccactatctgctcatcagccctttgaaggggaggaat

SEQ ID NO: 14369 - DNA, 201 bp, Homo sapiens
ttcagagcttacatctcattgggaaaataaaaccaacacatataaatcaggacaagtattgttactgtggtgttcagagaagtgatggctggggtgagcasgacaggtgagtggtgtaggagtcaaaggagaggtgcatagatgagggtagagtagtcaaggacagcttctctgcagatgctaacactggagctacatcta

SEQ ID NO: 14370 - DNA, 201 bp, Homo sapiens; identical to SEQ ID NO: 1926

SEQ ID NO: 14371 - DNA, 201 bp, Homo sapiens
catacataaaacatgttcctgcccttcagagcttacatctcattgggaaaataaaaccaacacatataaatcaggacaagtattgttactgtggtgttcasagaagtgatggctggggtgagcaggacaggtgagtggtgtaggagtcaaaggagaggtgcatagatgagggtagagtagtcaaggacagcttctctgcag

SEQ ID NO: 14372 - DNA, 201 bp, Homo sapiens
aagtagctgagactacaggcatatgccaccatacttgattaattttttgtagagatatggtctcgctatgttgtctcgagcaatcctcccacattagcttmccaaagtgctggaatgagccaccacacctggcctcttcaaatctttttctgccacattttctttttttttttttttttttgtttcttccctcaactttta

SEQ ID NO: 14373 - DNA, 201 bp, Homo sapiens; identical to SEQ ID NO: 1927

SEQ ID NO: 14374 - DNA, 201 bp, Homo sapiens; identical to SEQ ID NO: 1929

SEQ ID NO: 14375 - DNA, 201 bp, Homo sapiens
cttaccagttggtcctccagcactggaggctgttagtagtagttgtctaacagagctagccccagagaagttaatgttctactaatggagaataggacatycttgattaaccacagtataacatattatgggtttagaagcccaaatcattgtattttattcatttgtaaatcaaatcaaagatttaaaaaataaattcag

SEQ ID NO: 14376 - DNA, 201 bp, Homo sapiens; identical to SEQ ID NO: 1930

SEQ ID NO: 14377 - DNA, 201 bp, Homo sapiens
atttcaggcttatgatgaaaagtgacctggagctttggatccagtcttgccctcagcacctgtcagcatgcttttgtttttaggattcttcatatgttccytgtttttcagtgagctttctacagggaccacacactccttagaatcctatcaaatactgttgtcaaaattctttcgtcatcctctctgcactagaacttt

SEQ ID NO: 14378 - DNA, 201 bp, Homo sapiens; identical to SEQ ID NO: 1932

SEQ ID NO: 14379 - DNA, 201 bp, Homo sapiens; identical to SEQ ID NO: 1934

SEQ ID NO: 14380 - DNA, 201 bp, Homo sapiens; identical to SEQ ID NO: 1935

SEQ ID NO: 14381 - DNA, 201 bp, Homo sapiens
ggagacgttgaggcagcagagacagcagatccgagtcactatcttgcctccaaacattttttccacagaggttgaacttggggccgggggctcctcgggcrgagagggcgagctggactgcttgagtttctggcagatccttgtgcccgttttctcctcttcgtgcagcctggggcagagagcacagagtcactacatgta

SEQ ID NO: 14382 - DNA, 201 bp, Homo sapiens; identical to SEQ ID NO: 1936

SEQ ID NO: 14383 - DNA, 201 bp, Homo sapiens; identical to SEQ ID NO: 1937

SEQ ID NO: 14384 - DNA, 201 bp, Homo sapiens
agggcagagccctcgtgaaggggatttttgcccttacaaaagcagcttgagggcttccgttgtcccctccaccatctgttagaaacagggccctcaccagrcaccaaatctgctggtgccttgatcctggactttccagcctccagcactgtggactgtaaatttcatgtttataaataacagtctgaggtattttgtttt

SEQ ID NO: 14385 - DNA, 201 bp, Homo sapiens
ccacagaggttgaacttggggccgggggctcctcgggcggagagggcgagctggactgcttgagtttctggcagatccttgtgcccgttttctcctcttcrtgcagcctggggcagagagcacagagtcactacatgtacatgcgggtccccttccggggcactcagcttatccatgcccatttaccttccccaacagcca

SEQ ID NO: 14386 - DNA, 201 bp, Homo sapiens
atctgtcacccatcccatagggaaggtctcaccttggtcccttctctccttcatctctgtctgtcctagcccatttcaggccatcctgcacagtcacactkgacccttgtttgtgcgggttctttgtgatgattattgacgattcagtgttcatttatgtttacttgggaggggacagataaaaggaggaaacagtgattt

SEQ ID NO: 14387 - DNA, 201 bp, Homo sapiens
agcaactactcagctttgctgttgtagtatatatgcagccataaacaattatgtaaataagttgatacagctgtgttctagtgaaaccacagaaacagacsagatgtaatgtatgggctgtagtttgctgacccctgttctggtgtaataatatgctttggcaggcctgctcaaataatgtactcagtatgcaggcccact

SEQ ID NO: 14388 - DNA, 201 bp, Homo sapiens
gggccgctgccggtaaaacagcacataggctgtgtccttagggaagaaggaggtgacgttgctgacagattcgaaggaagagaaggacacccgagtgtcaytgaacaggtaccactggttctcgggctctggcctatcggcagttcccagagaaggggcagggcgggcagcgccctcacgggcatagcagtagtagtgacc

SEQ ID NO: 14389 - DNA, 201 bp, Homo sapiens
acacaagtttacctacataacaaacatgcacgtgtacccctgaacctaaaagtttaaaaagaaaaaatgccaatgaaaacattataaacttatgaaaatcmaaaagggtaccctatatatggaattataactgattcatatattgtatgtgctatttaaagtttatatattcaggccaggcatggtggtgcatgcctatag

SEQ ID NO: 14390 - DNA, 201 bp, Homo sapiens; identical to SEQ ID NO: 1946

SEQ ID NO: 14391 - DNA, 201 bp, Homo sapiens
ttttaaatacatgtttctcattgaggggaaaaaaattaaataaaatagtttcagaacctgtgtctgggaagtccacatcagggttatttttgttatacctkgttcctttggagccatagattatgtgaagggccagagagaacgtggatgcttatcaatttgcaattttgatgatccaaaggaaggtttttggaaatattt

SEQ ID NO: 14392 - DNA, 201 bp, Homo sapiens
ctattaactgccatttggagatgggggacggatgaagtctaacattgtttaaacattcatatactagagtctgaacaaccttcaaaatatgcttttagtcmccattttacagatgcctaaaccaaagtatagaaagagaaagtgctttgcctcaaggtcacacagctagtaattgtctcaccctcctgccctttcccttct

SEQ ID NO: 14393 - DNA, 201 bp, Homo sapiens
acatgtttctcattgaggggaaaaaaattaaataaaatagtttcagaacctgtgtctgggaagtccacatcagggttatttttgttataccttgttccttkggagccatagattatgtgaagggccagagagaacgtggatgcttatcaatttgcaattttgatgatccaaaggaaggtttttggaaatatttgctctttc

SEQ ID NO: 14394 - DNA, 201 bp, Homo sapiens
aagtccacatcagggttatttttgttataccttgttcctttggagccatagattatgtgaagggccagagagaacgtggatgcttatcaatttgcaatttkgatgatccaaaggaaggtttttggaaatatttgctctttcatttgtcactcaaagcctgctttgccttttcttcagtagaccctaacccttctgtctctg

SEQ ID NO: 14395 - DNA, 201 bp, Homo sapiens
caggaaacttacagtcatggcggaaggtgagggagaagcaggcacatcttacatggctggagcaggaggaagagagtgaggggagaggtactacacacttytaaataaccagatctcacaataactcactcactatcatgagaacagcaccaaaggggaactccacctccataatccaatcatttcccatcaggccccacc

SEQ ID NO: 14396 - DNA, 201 bp, Homo sapiens
tgttataccttgttcctttggagccatagattatgtgaagggccagagagaacgtggatgcttatcaatttgcaattttgatgatccaaaggaaggttttkggaaatatttgctctttcatttgtcactcaaagcctgctttgccttttcttcagtagaccctaacccttctgtctctgccccagaattaagaaccagagg

SEQ ID NO: 14397 - DNA, 201 bp, Homo sapiens
gccagagagaacgtggatgcttatcaatttgcaattttgatgatccaaaggaaggtttttggaaatatttgctctttcatttgtcactcaaagcctgcttkgccttttcttcagtagaccctaacccttctgtctctgccccagaattaagaaccagaggttgttaaaaccaaaccagtggatcctaatctgaatctctgt

SEQ ID NO: 14398 - DNA, 201 bp, Homo sapiens
actgaattcttacaaattaaacaaaagcctttccaatagctcctagagaggctaaggaagtctctgtatgggaatgttttccagctacatatgcaatactycaagcagctggactgatgtaaattggggctcccaggagcaagatagtccatttacttgatcacctgaattaatctttggaatttggttctgtttctcatg

SEQ ID NO: 14399 - DNA, 201 bp, Homo sapiens
agagatctttttaaagttgcaagcagaagtgggattttggcaagttttagtgccaaaacagctttgaaagaatttttctggagctacatactttttttttycttttttcttttttctttttttagagacaaggtgtcactctgtcatcttggctgattgcagtggcgcgatcatagcccactgcagcctcaatctcttggg

SEQ ID NO: 14400 - DNA, 201 bp, Homo sapiens
tgtaaataaggagactgagactctgagaggtgaagtgacttccccaagtatgcagctaaatagactgagtcacagatatgactccacaggctgagctcaargaaggggctgcagaggtgaggatgggtcactcctcttttattcatactcacagccaaagcattcaacatagggggcatgaaggatgcatttgatgacaag

SEQ ID NO: 14401 - DNA, 201 bp, Homo sapiens
ttgtttgctgtttcctgtcatcaacttaaaggttctttccactgtctcacaacatttgtgttcgaatgtgcatattctgcggtacttaaaacagtgaacawataggcaatccatctggcttattgatacttgttcagggagtgggggttataacccctgctattaactgccatttggagatgggggacggatgaagtctaa

SEQ ID NO: 14402 - DNA, 201 bp, Homo sapiens
gtagagcattaatgagctggtgatcctgcctaggaccatgagaagggtacagcctgagataggtcagatgacagggcgtagaaggtgaactgtgtcccctytgacatgagttgaataaccttagaaaatcaacaccaccacaacgttaacccaccagctatcatactgcctaagattacatctttaaacttttatttcttt

SEQ ID NO: 14403 - DNA, 201 bp, Homo sapiens
ctaaggaatttggactagcttagagagccagccaaatgaataatgaccttggcttggggtgtagtactataagctattatccgtccttaatacctcacttwctaacacaacagagaaaagcttgagataagagggaaaatgaccaatagacagggagtggtaggcagtggggaatgtaactgtccttggaggtcttaggag

SEQ ID NO: 14404 - DNA, 201 bp, Homo sapiens
attttgagttagtttttttatctgttttaaggtaaaggtccaagaactttgttcttgtgggttgacttagttttccagttctatgtgttgctttttttttkttaatctagtttagcaaactttctaccaatatttcttcgacttttttttttttttaagagacagggtctcagtctggcacctaggctggagtacatagct

SEQ ID NO: 14405 - DNA, 201 bp, Homo sapiens
tatctctacttgcaccagtgcataagccgaagagcagaaaatgcaaggtaggaggctgccacagccattaggtgggttagtgaccgctcacagggcctagyacttttcagtccttgcttttttaaagacaagcaaaacattatatcgtttcaggtagacaaacacgtctatgacaaaacataattttttgcttctgtagcc

SEQ ID NO: 14406 - DNA, 201 bp, Homo sapiens
tcgcttgaaccctggaggcggaggttgcagtgagccaagatcatgccattgcactccagcctgggtaacaagagtgaaactccatctcaaaaaaaaaaaaatgcattaaggtcaggcacagtggctcatacttataatcccagtgctttaggaggctgagttgggaggatctcttgagaccagcctaggcaacatagcaag

SEQ ID NO: 14407 - DNA, 201 bp, Homo sapiens
tccctcaggggaatgacctttctttctccaatatttaaagggttggcaacagctcatttgttgctttgtcaatgggagaggtaattcccctaatggatttygagtcctctgtagaaaggttgacctggtctttggggaatgaacctcacagaattcaatcagtgtaattactgatacagggctttttggtttcccagatgt

SEQ ID NO: 14408 - DNA, 201 bp, Homo sapiens
tcagaccattcaaggacatgaaagcaaggtccctcaggggaatgacctttctttctccaatatttaaagggttggcaacagctcatttgttgctttgtcartgggagaggtaattcccctaatggatttcgagtcctctgtagaaaggttgacctggtctttggggaatgaacctcacagaattcaatcagtgtaattact

SEQ ID NO: 14409 - DNA, 201 bp, Homo sapiens
caaactagcttatcttgtcatttcttctcttggttatttcaaagcataaatttgggattcgatggtttcagttttagcttaaatctgtatccttggtgatsaacttaaattagatgctaatattttgaaggaggacatgtttatgcaaaccagagtgagaacttttagtctaagggtcagcaaactttctctgtaaagggc

SEQ ID NO: 14410 - DNA, 201 bp, Homo sapiens
atgattccattttttgtgatgttctagaaaagacaaatttaatctatagtaacagcagatcagtgtttgcctggcaccaggatagggagtgaggattcacytggaaagggcacaggggaactctttggggtcatggaaatgttgtgtcttgattgaagtggtggttagatggtaaatacatttgtaaaattcagccatctg

SEQ ID NO: 14411 - DNA, 201 bp, Homo sapiens
gttataaacttaaaatgttacaacttggacattgggagcccctttaaatcgtatcttttgactcaacatctctctctctctctctctctctctctctctctaacattttttgtagagatgggatctcaccatctttcccatgctggtctcaaactcctgggctcaagagatcctcctatcttggcctcccaaagtgctggg

SEQ ID NO: 14412 - DNA, 201 bp, Homo sapiens
cagaaataataggaattctgcccaacccctcactccctccacccccacatttctcagaggcgtgtattgaaattgtaggtgggacaattctttgttatgcragattttatcctatgcatggtttgaggttaatatacctgtcctctgccctctaatgcctgtaaggctttccaatcattgtgacaacttaccccaccactg

SEQ ID NO: 14413 - DNA, 201 bp, Homo sapiens
atcctcccacctcagcctctcgagtagctggcattacaggcgcacaccaccacacctggctaatttttgtatttttttttttttttttttggagagacagrgttttgccatgttgcccaggctggtctcaaactcctgggctcaaatgattttgtccacctcgcctcccaaagtattaggattacatacgtgagccaccac

SEQ ID NO: 14414 - DNA, 201 bp, Homo sapiens
tacaattgtattctcttatttagaacaaatatggtgggttttttgttgttgttgttgttgttgtttttctttgagacgaagttttgctctgttgcccaggytggactgcagtgacaagatcttggctcactgcaactgccgcctcctaagttcaagcgattctccagcctcagcctcctgagtagctgggattaacaggga

SEQ ID NO: 14415 - DNA, 201 bp, Homo sapiens
ctgcaacctctgcctcctgggctgaagccatcctcccacctcagcctctcgagtagctggcattacaggcgcacaccaccacacctggctaatttttgtawttttttttttttttttttggagagacagggttttgccatgttgcccaggctggtctcaaactcctgggctcaaatgattttgtccacctcgcctcccaaa

SEQ ID NO: 14416 - DNA, 201 bp, Homo sapiens
aggtctttgatccattttgagttagtttttttatctgttttaaggtaaaggtccaagaactttgttcttgtgggttgacttagttttccagttctatgtgktgcttttttttttttaatctagtttagcaaactttctaccaatatttcttcgacttttttttttttttaagagacagggtctcagtctggcacctaggct

SEQ ID NO: 14417 - DNA, 201 bp, Homo sapiens
tgtttattctttgaaaaaattaacttcattttgttgatcagttttattttgtctcaattttatttctgctctgatcttttttttccccttttactaatttkgggtttggttcttgtttttctgcttccttgagatgcatcattaggatgtttatttgaaaattttctacttttttggtattagcatttattgccataaact

SEQ ID NO: 14418 - DNA, 201 bp, Homo sapiens
agttataaacttaaaatgttacaacttggacattgggagcccctttaaatcgtatcttttgactcaacatctctctctctctctctctctctctctctctctaacattttttgtagagatgggatctcaccatctttcccatgctggtctcaaactcctgggctcaagagatcctcctatcttggcctcccaaagtgctgg

SEQ ID NO: 14419 - DNA, 201 bp, Homo sapiens
aaattaatgactttagattagctggccataaccataagtgaatatgaaaatgaccatcttcctttgggagttttatcaagaggcataattcttaccttgtrtggtcttttggacttcggaaatacttggttgtcatcagaccttgatgttttacttccctgaacctcagctacactatctggaaaatgggaataaggattc

SEQ ID NO: 14420 - DNA, 201 bp, Homo sapiens
tttccctctgcctttttgttcttccaggctctcaacaaattggatggtgctcacccacactgggtgagaatggatcttccttactcagtccactgattaawatgccagtctctcccagaaacaccctcaaagacacacccagaaataatgctttaccagctatctgggtatcacttaacccagtcaagttggcacctaaaa

SEQ ID NO: 14421 - DNA, 201 bp, Homo sapiens
tgttgtggtggaagagggatgtgtgaatttgggactagactagacagccttgctgactctgtcataaatatatcagtattttgtaggcagccatttatcakcctacaccacttacttggaagcaaaacctgacaggctctgatattatctgtagcaaacatggttttcttgttcatgagggtgtctgtgttttttgtgctt

SEQ ID NO: 14422 - DNA, 201 bp, Homo sapiens
gagaatcgcctgaacctgggaggtggaagttgcagtgaacgagatgatgccactgcacaccagcctgggtactctaaaaatatatataaataaataaaacstggaagtggagagaaggtgttgtggtggaagagggatgtgtgaatttgggactagactagacagccttgctgactctgtcataaatatatcagtattttg

SEQ ID NO: 14423 - DNA, 201 bp, Homo sapiens
tcacatttttatactcgcttccttctctcaactttgtgtttgtaaaatttactcatgttgtgtatatagcttggttgtgttttcttaaaatcttgatctgwtcctgtttcttccaatcacatagatgctaagttcaaactccttgataatggcagcattcaaggtcctccaggatcctgtcttgtaacctgcctctccatc

SEQ ID NO: 14424 - DNA, 201 bp, Homo sapiens
tagtttttggccacattggaccttaatctcaggatgctcagaacttaaaggggagaaagacatataagcattagaaatgccaaagcagggagtagaaatgkcaaacccggggaaagaaatgccagcgtggggtaagcacaggttagtaagggaaaacaagcagaagcacctccagctctacctgggggagtcaataaaggc

SEQ ID NO: 14425 - DNA, 201 bp, Homo sapiens
agctcctatatgtgttaagcactctgccatgtagtttttggccacattggaccttaatctcaggatgctcagaacttaaaggggagaaagacatataagcrttagaaatgccaaagcagggagtagaaatgtcaaacccggggaaagaaatgccagcgtggggtaagcacaggttagtaagggaaaacaagcagaagcacc

SEQ ID NO: 14426 - DNA, 201 bp, Homo sapiens
agagctagccccagagaagttaatgttctactaatggagaataggacattcttgattaaccacagtataacatattatgggtttagaagcccaaatcattktattttattcatttgtaaatcaaatcaaagatttaaaaaataaattcagaagatcagtccaaactggagtgaaacctgtgtggactaacagactgctaaa

SEQ ID NO: 14427 - DNA, 201 bp, Homo sapiens
tgcacccctacctcctctgtgaaatccctattaatcttcctacctggaattcactttttctctgaattgccacagcagttttttattctctctctctctcwcacaacatttggaactttctgccttgtagaatggatttttatattaatacattactattatttgatgatggagctcacagtaggtgcataataatttgaa

SEQ ID NO: 14428 - DNA, 201 bp, Homo sapiens
cttgaacttgggaggcagaggttgcagtgagcccagatcacgccattgcactccagcctgggtgacagtgcaagactctgtctcaaaaaaaaaacaaaaaaccacaagataccactaagaaaatgaatatgtataattattatttgtcaattaaaaataataatttaaattccaaaaaagaaaaggcaagccacagactgg

SEQ ID NO: 14429 - DNA, 201 bp, Homo sapiens
aatactgcttttgctgtattccataggctttggtatgttgtgtttctattttcatttgtttccagacatttctaaatttcattctttttcttttttttttkttttgagacggagtctcgctctgtcgcccaggctggagtgcagtggcatgatctcggctcactgcaagctctgcctcccaggttcacaccattctcctgc

SEQ ID NO: 14430 - DNA, 201 bp, Homo sapiens
aaagggaccacattttagcatggtttgcgcagtgggggcacccagagacctggctgctagaacaaattccctgccctctgagtatgtaactttgggcaagmgtcccttgttcaactcctcttacttggttactgaggtgataatcagtctccctcaacatgtgtcactattatctatcatatgcctggcactatgccaggg

SEQ ID NO: 14431 - DNA, 201 bp, Homo sapiens
tttcctctggcataaattatgatatatgccaaaggcctttgagacttaatccttcttaaataatttcaggcttatgatgaaaagtgacctggagctttggmtccagtcttgccctcagcacctgtcagcatgcttttgtttttaggattcttcatatgttccttgtttttcagtgagctttctacagggaccacacactcc

SEQ ID NO: 14432 - DNA, 201 bp, Homo sapiens
aggtgactaggcactcagtcactggtaagaaaatcacttgatctctctgaactgtaggctttctgtcagtaaagtattaatattaaactaaatgatcccgkgggttatttccagacctgtgcttctgtgatatggaaaaagaataaatggttaagaatcagaaagaacaagctggtgatttaagcttgttagtacaagttt

SEQ ID NO: 14433 - DNA, 201 bp, Homo sapiens
gtaatcacagctactcagggtgctgaggcaggagaatcgctttgaacccaggaggcggaggttgcagtgagccaagattgcatcactgcactccagcctgkgagacagaatgagactccgacacacacacacacacacacacacacacacacacacaccacacacgcgcgcgcgcgcaccaagggagagactgtatggtgg

SEQ ID NO: 14434 - DNA, 201 bp, Homo sapiens
ctcctgtaatcacagctactcagggtgctgaggcaggagaatcgctttgaacccaggaggcggaggttgcagtgagccaagattgcatcactgcactccascctgggagacagaatgagactccgacacacacacacacacacacacacacacacacacacaccacacacgcgcgcgcgcgcaccaagggagagactgtat

SEQ ID NO: 14435 - DNA, 201 bp, Homo sapiens
gcacctaggttgattccctgtctttgctgttgtaaatagtgctgcaataaacatatgagtgcatatgtctttctggtagaataatttattttcctttgtayatatactcagtaatgggattgctgagttgaatggtagttctatttttagtctttgcaaaatctccaaactgctttctacagtggccgaagtaatttacat

SEQ ID NO: 14436 - DNA, 201 bp, Homo sapiens
ggtgatcatataaaaatcactttatgatttatagagtgcttttatatatatatatatatgtggtatagaaggcccgtttattacatagggtcttagaatcrcatgaatatgaacccacaacattaatgactttagtctaaacgtggtcttggataagtaaatttaattttttgagcttcaacttctgcatcagtaaaatag

SEQ ID NO: 14437 - DNA, 201 bp, Homo sapiens
aagaccagcctggccaacgtggtgaaaccccatctctaataaaaatacaaaaattagccagtgtggcagtgcacacctgtaatcccagctacttgggaggytgaggcacaagaatcacttgaacccaggaagcggagcttgcagtgagccaagattgtgccactgcactccaccctgagcaacagagtaagactctgtctc

SEQ ID NO: 14438 - DNA, 201 bp, Homo sapiens
cttttcatgtgcttcttggtcattttgtatcccttctttggagagatgtctattcaagtcctttgtcaatttttagttaagttgtttgtttttgttgttaytgtagttctttatatattctagttattaaccccttataatcctgtactagtcagtgttctccagagggacagaactaataatatgtatatatgaaaggga

SEQ ID NO: 14439 - DNA, 201 bp, Homo sapiens
gaatcgcttgaacttgggaggcagaggttgcagtgagcccagatcacgccattgcactccagcctgggtgacagtgcaagactctgtctcaaaaaaaaaamaaaaaaccacaagataccactaagaaaatgaatatgtataattattatttgtcaattaaaaataataatttaaattccaaaaaagaaaaggcaagccaca

SEQ ID NO: 14440 - DNA, 201 bp, Homo sapiens
tcattaatattttactatgcttgctgtatcacttatctatttgtctatccattcctttgaccacccattgtgcatcttattttttatagcatttaaagtamattgcagacattagcatatttctccctaaatactttagcatgcatatcattccctagagttccacatctgttgagtatttttctttgaggtaaaatgtac

SEQ ID NO: 14441 - DNA, 201 bp, Homo sapiens
ttttaattaatataaagagcctacaagactggccttataaactctctactctctttctcctagccacgcaacccagacacaaaaccccaaaaatgttcttyatttttgctaacatttttaaatgaaaaatttcaaacataaagcaagattgaaagaattttacaattaacacctatttatcaaccatctagattctgtcat

SEQ ID NO: 14442 - DNA, 201 bp, Homo sapiens
ggctagaggtagaattagaactttgtatttagtggtaaggtcaccttggacctctgaagatcttgattacgattaaacatccggttatgtgtagcgctacrtaggattcagaactctacaaaatcagtagatacagtcttctctctctaggatctgtgctgggaaacagagttctggttttaaatttcagctttgttacga

SEQ ID NO: 14443 - DNA, 201 bp, Homo sapiens
aaaatttctcaggaaagtttgataaaatccctggtttatgcttttttgaagaacttaaacacatatagcaaactcaaggcctatcacagcatttgctatcrtagttgttagtaatatgtttggagaggaatttggggggatggctattaagtgagaagctagaggtagaataaccactgcaagcaataagcattttacaaa

SEQ ID NO: 14444 - DNA, 201 bp, Homo sapiens
aggagacgttgaggcagcagagacagcagatccgagtcactatcttgcctccaaacattttttccacagaggttgaacttggggccgggggctcctcgggmggagagggcgagctggactgcttgagtttctggcagatccttgtgcccgttttctcctcttcgtgcagcctggggcagagagcacagagtcactacatgt

SEQ ID NO: 14445 - DNA, 201 bp, Homo sapiens
gaacctcagttgcctcattttaatctcagtatacttggtacttctgtgtactttctctctctgagaagacctgtgatcatttaatgagttctgagcttggkctttttttttttttttttttttttttaagtgagacagggtctctctctgtttcccaggctgaagagcggtggcgcaatcatagctcactatagcctcgga

SEQ ID NO: 14446 - DNA, 201 bp, Homo sapiens
atgacccatttgcctaacttttttttcaatgtgatgaatgaaaatatagacaacagaatgtttcacaagacagccaactcaaagagaataagaatgaggasgtgtgcaatttgcttttacctttaaaaagaagcatattacagaacctcttgattgtctttcttttttttttctttttttcttttttttacctctgtcatc

SEQ ID NO: 14447 - DNA, 201 bp, Homo sapiens
cgagtagctgggattacaggcgtgtgccaccatgcccactaatatttgtatttttagtagagacggagtttcaccatgttggccaggctggtctcgaactyctgatctcaagtgatctgtccgcctcagcctcccaaagtgctgggattacaggcatgagccaccacacccagactgattttgtatttatttggatctttt

SEQ ID NO: 14448 - DNA, 201 bp, Homo sapiens
tttctttctttttctttctttctttctttctttctttttgggacggaaaatgccatctctttctttctttctttctttctttctttctttctttctttctyactttctttctttctttctttctttgagaaggagtttcactcttgtcacccaggctggaatgcaatggcactatctgggctcactgcaatgtctgcgtcc

SEQ ID NO: 14449 - DNA, 201 bp, Homo sapiens
gattgagaccatcttggctaacacggtgaaaccccgtctctactaaaaatacaaaaaattagccgggcgcagtggcgggtgccggtagtcccagctactcsggaggctgaggcaggagaatggcgtgaatccgggaggcggagcttgcagtgagcagagatagcgccactgcctggggggaagagcaagactccgtctcaa

SEQ ID NO: 14450 - DNA, 201 bp, Homo sapiens
ggtctcaatctcttgacctcgtgatccgcccaccttggcctcccaaagtgctgggattacaggcgtgagccactgcgccggctttcctggttttttttttyctacacattttacaggtttatgtttttcctttaagtccgtgatccactgtgagttaattttcatgtaagatgtgagacttagattgaggttcttttgttg

SEQ ID NO: 14451 - DNA, 201 bp, Homo sapiens
atttctgtatttttagtagaggtggggtttcaccatgttggccaagcaaccaaagaaatttttaaaagaacaacaataaagtcaggatttatattacttgrtttcaagaattcctgtcaaactatggtaatcaagataatgttgtattggtgaaaggacaaaaacctgtagatcactagaagaattagcaagtccaggaga

SEQ ID NO: 14452 - DNA, 201 bp, Homo sapiens
gcatcgatgccaacatctgttttgttttttttttaatggccattcttgcaggagtaaggtggtatcgcattgtggttttgatttgcatttgcctgatcatkagtgacgttgagcattttttcatatgtctgttagccatttgcatatcttcttttgagaattgtctgttagtgtccttagctcactttttgatgagattgt

SEQ ID NO: 14453 - DNA, 201 bp, Homo sapiens
ggtgttcccagaatgtaaagttttatgaggagaatggctgtgacaatcatgggatgactggtccttcaaaccagaacaaccacagtactggtcattaagakatctggtttttttgacactgtgtgtatccttgttagtgtattggttaaggtcagggctttgggtctgtcagaaatgggattgaattctgtttttgtcacc

SEQ ID NO: 14454 - DNA, 201 bp, Homo sapiens
cttacactattggtgggaacatgaattagtacaaccactagggagaacagtttggaggctcctcaaaaaatagagctaccatgtgatccagcaatcccacrgctgagtatttaccccaaagaagggaatcagtattttacacagagatacctgcactcccatgtttgttgcagcactgttcacaatagcccaggcttggaa

SEQ ID NO: 14455 - DNA, 201 bp, Homo sapiens
ggttaggatgtgatgtgttcacttacatgactggaagcctctgccccttcggaagttcagtttccccctaactgaaactggtgatatgtgtaaccttaagsctctggggaacagtatgcctttacatctacttttcttttggggtattcagaatttttgcatcctgttgtaagttaaaactctgctagtttgcttatttca

SEQ ID NO: 14456 - DNA, 201 bp, Homo sapiens
atatttgttctttaggagtcaccatttaaacaagaccccaagagtgacattaggtgtaaccaaagtgaaattgttgactacttgatgagattcgtgaggayaggcattaaatgatatcttttaagaaaccattggcagtcctggagctgatgaccctagtgcaggatcattatggttgcttctttcatcatctcaatttga

SEQ ID NO: 14457 - DNA, 201 bp, Homo sapiens
aatcacataactagcagaagatcaaggtgggacttaaacctaggggactgacttcaggcaagatgcttaaccacttaaagctactcagtttgttcatctayaaaatgaggataatagcgtctacttcctaagtggttgtattaaaaattacaccatgtgagtgaagaattttggcatgtcatatgggacgcagtgcaagct

SEQ ID NO: 14458 - DNA, 201 bp, Homo sapiens
tacctcccactggatccctcccacaacacgtgggaattcaagatgagatttgggtggggacacagccaaaccatatcacccaggcttgtcttaaactcctrggctcaagtgatccacccgccttggcctcccaaagtgctgggattacaagtatgaaccactgtgcctgactaccttttttttaaagagttgtgataggac

SEQ ID NO: 14459 - DNA, 201 bp, Homo sapiens
gattctgaggcatttttaaacattgcacttagccattcagatgataacttggatcagaaattttgagaagtggtgggatgaagaagatccctgaagagagsagtaactgagacaaaggcgaggctagcaatagagagacaagtgagggaattagacctttggtatcatcatgaaaaggtgagttttgggaaacaaagagta

SEQ ID NO: 14460 - DNA, 201 bp, Homo sapiens
ctccactattactatcttgaagttcttaatagtttttttaacaggaagttctgcgttttcattttacactgggctctgcaaattatgtagccagtcattcytgaactagatatcctaacctaggaattctgtgatttttatcttccttggggaaggataatgagcccctatttattaagttctttggtataatcttcttgc

SEQ ID NO: 14461 - DNA, 201 bp, Homo sapiens
gtttacacaaacacttgtacaagaatgttcacagcagtattattcataatagccaaaaagtggaaacaacccaaatatccatcaataaatcaaatatggtrtatacatatatattactaagccataaaatggtatgaagtactgaaaacatgttaagtgaaagaagacagagaggaccatctttttatgattccgtttgta

SEQ ID NO: 14462 - DNA, 201 bp, Homo sapiens
tttactatattaaatcttccagtccatgaatttattttacatttatttatatatgtctttcttccttcgtttattttcttctccttccaccatcccccccmccaaccacccccaccagaatcttgctgtgtcacacaggctggcgacagtggcacaatcatggctcactgcagcctcaaattcctgggctcaggtgatcct

SEQ ID NO: 14463 - DNA, 201 bp, Homo sapiens
caggtacaaacctcaaaataacccagatgttggaattatcagacacagatttcaaagctcctgtgaaaacaacattccatgtaataaaggaaaacacactygaaactaatggaaagaaaaaaccctctgccaccggacactgtggctcacacctgtaatcccagcactttgggagcccgaggcaggtgagtcatctgaggt

SEQ ID NO: 14464 - DNA, 201 bp, Homo sapiens
atcttggctaacacggtgaaaccccgtctctactaaaaatacaaaaaattagccgggcgcagtggcgggtgccggtagtcccagctactcgggaggctgakgcaggagaatggcgtgaatccgggaggcggagcttgcagtgagcagagatagcgccactgcctggggggaagagcaagactccgtctcaaaaaaaaaaaa

SEQ ID NO: 14465 - DNA, 201 bp, Homo sapiens
ctcagagtcttcccttggaagggggatggggaatcataggtccagaaagatctcatgggatctcatgttactgcctgtctgtcttttcttttttcttcctscgctttatagttcttataaacattaggaaacttatatttctgaactcgagaatctatttatactagtgtttagtactttgatccacaaatgtttacttac

SEQ ID NO: 14466 - DNA, 201 bp, Homo sapiens
agtaaatcacaagagtgcttcatttcaaatatgaatgaatccttgatgggaccaactaaccaacccaagccccacacgaaggaacaggagaagggtctgcygcagctaaggggtacgataggtataaacaaagcttgtaacctgacctcttgcaaatcaacagcacagtgcatggctaaagatagacttgctatccccaaa

SEQ ID NO: 14467 - DNA, 201 bp, Homo sapiens
cctcccagagagagtaaggaaggcttttgggcattcaagtggaatcttgaaggattaataggattttcacagggaatatcacattaaagcagtttgctttkcctggaatgtcagatgttttgaggctgagaaataggcatggaggggagggaaggttgaaaatttcaggtagcagtttggaaccaaatgaaggaaggccct

SEQ ID NO: 14468 - DNA, 201 bp, Homo sapiens
cataaaattaaattaaattaaaatttaaaatgtagttgtttattcattgttctgcctgtctttgtgagggggacaagcagtaggggtttcttcttggccawtttgctagcattacttccttttttttttttcttaatagaaatgggtgcaatgtggtatctcattgtgcttttgatttgtatttccctaatgattagtggt

SEQ ID NO: 14469 - DNA, 201 bp, Homo sapiens
acataaaattaaattaaattaaaatttaaaatgtagttgtttattcattgttctgcctgtctttgtgagggggacaagcagtaggggtttcttcttggccmttttgctagcattacttccttttttttttttcttaatagaaatgggtgcaatgtggtatctcattgtgcttttgatttgtatttccctaatgattagtgg

SEQ ID NO: 14470 - DNA, 201 bp, Homo sapiens
ggtctttaaacaaaattgcctaaattatgggctagtgatgcatgtccgctcagggcttgggggtggggggattgtcaccccaactggttccgatagatggygcctatcttcatgtaaatcattcaaatgatttgttttccatttttttcccagcaaaaaccggggaccatttaaacagacacacacagcagggagtggaga

SEQ ID NO: 14471 - DNA, 201 bp, Homo sapiens
tatcaattcttttaaaatctcttggcctaacatgaggtctgtcctatagaatgtcacatgtgctaatgagaagaattatactctgcagctgttggatgaartgttgttaggtccatttgatctaaagcgcagtttaaatctaattgtttccctgttgattttctgtctaggtgatctgtccatgctgagagtgaggtgttg

SEQ ID NO: 14472 - DNA, 201 bp, Homo sapiens
ttagccaggctggtcttgaactcctgacctcaaggaatctgcccatcttgaatctgcccatcttggcctcctaaagtgctgggattacagatgtgagccascacacccagccatttgtctattttttgtttttgatggtgcttctgaggtcttagctgggcccttttttgtttttgcttttgatgggagacttttttttgc

SEQ ID NO: 14473 - DNA, 201 bp, Homo sapiens
ctgataacatcagatctccaccagtcctctgaacaaaatatgaattctgtaacaagggtgaagggagaaatggctatttggtctctcagtgagtgacccaraaagtgttaggagtgtctggtctgcatcctttcagcttatcacatgctttcaacttgctaggcaagcagggcacagacacgccgagctgtgaagccctgc

SEQ ID NO: 14474 - DNA, 201 bp, Homo sapiens
cttactgcaccctcagcctcccgtatgccctctctttctatgcgtcctgtgcttaaaatctagactgtctttctactctttcaacctagtgtatttttgastccctcctcaaagtagaatagactcattttcataattatttatactctctctccctgttttaacacttataatatgtcttgtattgtaagtgttataggc

SEQ ID NO: 14475 - DNA, 201 bp, Homo sapiens
atatgaaatacctgaagatcttactgaaatgctcactctgactcagtaagcctggcctaggtcctggggtcctttctaataaactccagatgataccagcrcagattgtctacagctcacactaagtagaaggctttatatagtagtaacaattgccgccaccaccactccagtgatcctgctgacgcatcagagaacaaa

SEQ ID NO: 14476 - DNA, 201 bp, Homo sapiens
cagaatgggaataactaattcaaaggcttactaatgagtgtaaaatgataaaacatacataaaatagtagtagagagtaaatacattttacctgttcttcytatgccccatcctcttctactacatagacaactgcctgggagcagataaggtgaggtcttaaaatcatagttgtagtgaaaggcaaagtacttagctgta

SEQ ID NO: 14477 - DNA, 201 bp, Homo sapiens
tgagatcagattcccctgtgtctttgtgtttgtttgagctagaactcaaccacatcaccacctgagagttgacagttgaaaatatttctaaacctccagartcttctatcttctgccctgactttggtataccaaagataacagaactcttctttgatgactaaggacttctcaaggtctcaaatcatcttttctgatacc

SEQ ID NO: 14478 - DNA, 201 bp, Homo sapiens
tgaggccggagtatcacttgaacccaggaagcagaggttgtggtgagccgagatcgtaccactgcatttaagcctggatgacagagcgagactctgtctcmcaaaaaaaaaaaaaaaaaaaaaaggaaagatatttgtaagtcatctgaggtataacagaagagttttaagagggacggtgacataatgacgtgacatggt

SEQ ID NO: 14479 - DNA, 201 bp, Homo sapiens
gcctcaattaatgagtcttcagtaagcaaagcctcatttaacaaagccagccttagcttttttttttcctgtaattagatgtttaaatttcattttttttttaaatttcaacttgtttttcagatgccagggtacatgtgcaagtgtgttacatgggtatattgtctaatgctgaggtttggccttctgttcatcctatca

SEQ ID NO: 14480 - DNA, 201 bp, Homo sapiens
ctgactttgcattataatgtgctgtgtttttgtccctgttctcctggaatataagcatctgccagaaacaggcctggatatttttgcccctttggacactwtgcattgtactggaagcacccccaggggtccctatggcaggctgaggttctctctgcttactaacccatattgccaaagtccttggtctagaatattcct

SEQ ID NO: 14481 - DNA, 201 bp, Homo sapiens
aattaatgactttagattagctggccataaccataagtgaatatgaaaatgaccatcttcctttgggagttttatcaagaggcataattcttaccttgtayggtcttttggacttcggaaatacttggttgtcatcagaccttgatgttttacttccctgaacctcagctacactatctggaaaatgggaataaggattcc

SEQ ID NO: 14482 - DNA, 201 bp, Homo sapiens
gctgtctctggcccatcactgtaaaattaatgactttagattagctggccataaccataagtgaatatgaaaatgaccatcttcctttgggagttttatcmagaggcataattcttaccttgtatggtcttttggacttcggaaatacttggttgtcatcagaccttgatgttttacttccctgaacctcagctacactat

SEQ ID NO: 14483 - DNA, 201 bp, Homo sapiens
ttccttcaatctgtgaaaacatgtgaatacaactgatccttgaacaaaatgggcttgaactgcatgggtccatttatacttggattcttttcagtaaaagwgacactgagtgtgcttgcctctcctgcctccccttcctccccttctacctcttctgcttctgtcactgctgagacagcaagtctaacctcttcttttcct

SEQ ID NO: 14484 - DNA, 201 bp, Homo sapiens
aactgatccttgaacaaaatgggcttgaactgcatgggtccatttatacttggattcttttcagtaaaagtgacactgagtgtgcttgcctctcctgcctmcccttcctccccttctacctcttctgcttctgtcactgctgagacagcaagtctaacctcttcttttcctctttctcctcagcctactcaatgtcaagat

SEQ ID NO: 14485 - DNA, 201 bp, Homo sapiens
catcactgtgtttacagcctgatgtacaaagtgatgagagaaagattggtattttcctggaattttatttgaaacacagggaagcacaggtaagaaacaasgttgaagaaagaaacaggaaaatgtctttaaaaaaagaggctgggtgcagggctttatacctgtaatcctagccctttggaaggctgaggcaggaggatt

SEQ ID NO: 14486 - DNA, 201 bp, Homo sapiens
accatctgtacggcatataattgtgaccaaaacagtgacagttaccttccaagcatccgtcatgtcttggaaagcagctcgtacctctttggccaatctcraggtctcaaccagctccatgtgtactccaggaataggagcaataagagtggctaaatgcatgatataaaatgatctctattcctcacagcagtcctacaa

SEQ ID NO: 14487 - DNA, 201 bp, Homo sapiens
gttgtccttttggttctcattaattccccgtataccatctgtacggcatataattgtgaccaaaacagtgacagttaccttccaagcatccgtcatgtctkggaaagcagctcgtacctctttggccaatctcaaggtctcaaccagctccatgtgtactccaggaataggagcaataagagtggctaaatgcatgatata

SEQ ID NO: 14488 - DNA, 201 bp, Homo sapiens
catggctgcttctaagtcacaaaacggacagcaagaaggaagaggaggagcaagaggtttataaatcactgagaactgactattcttttttttttttttttaagacggagtctcgctctgttgcccaggctggagtgcagtggcgcgatctcagctcactgcaacctccaccctccacctcccgggttcaggcgattctcc

SEQ ID NO: 14489 - DNA, 201 bp, Homo sapiens
ataatggtaacaacatcacagtcactgttctcagaaagccatgggttagacaaggaagcatagtgaccatggatataatgggagcatgggccaagtgctgytggcacacagaagaagaagcaagtccaggaagatttgggagagaatatgatatctgtgtagggtctaaaagtctgcatatgagcttgccagtagagtaga

SEQ ID NO: 14490 - DNA, 201 bp, Homo sapiens
cccaaatttctgcctagcagcaattagctggaactgggtggtagctttccatttaagccaaagcatatgctttctagtctgctgtatcacatgcacgcacrcacacatacatgcacacaccagtcactcatatatgtacctacctgaccctttacacttccagaccatatgcccttcgaaggcaggatttttgtctgtttt

SEQ ID NO: 14491 - DNA, 201 bp, Homo sapiens
aatggagtaatgagctatcgattctgttaacaaatgtccagtttactgaaagacttgtaatgggagttaattttgggggtcaatacagctgtcaatggaamagtttttccccagaggcccatcagctttttctgttgtacactggcaggtgtcctgcccagcagcagaaatgcctggagagtaattaatactgtagagcat

SEQ ID NO: 14492 - DNA, 201 bp, Homo sapiens
tgccagtagaaacgagaaatagccaaaagagaaatggaaaatggtcttagcctcatttccaccttaccagtcttatatgaatgcaagtaattggcagactrcctgcaaacaaatttggtaaaggtgacttttagttttccagattttctaactagaaggggaatggaattgatgttgagtgggccaacctatcgtacatac

SEQ ID NO: 14493 - DNA, 201 bp, Homo sapiens
tttgtgctatcatagcttatatgaatagaaagctcagacacagtgaggacttgatcaatattgaaaggaaatttaaatcataccaggtaccctataagctkctcccccaggcaaataaagccagtgttaagttgatctccctaggttggtgggcagggaaagtcccaagcctggtggcttcctcagtcacttctttaaaaa

SEQ ID NO: 14494 - DNA, 201 bp, Homo sapiens; identical to SEQ ID NO: 1940

SEQ ID NO: 14495 - DNA, 201 bp, Homo sapiens
ctctaccattctttctccaacttccaccttctttctcttttccctgcctctaagagaacggtgtgggttgtcaggggagaaaacatatcattccattcttktattactttctagcccctccttaactaagtcttgtctgtgacatcactgtggggaattctgccttacttcctaatagggcaaaaacttctgacccctccc

SEQ ID NO: 14496 - DNA, 201 bp, Homo sapiens; identical to SEQ ID NO: 1941

SEQ ID NO: 14497 - DNA, 201 bp, Homo sapiens
tagactcaagaataaagtcatggggtacagggtaaagtaagatagtagatataatcaggagcttctagctgaactggagtcacctttaatgccaggcacawgaacttgacttcattttataggcatcaagaaagagcatctttgaatgttgctgaagatgaaaaatatcttgggcatggtagtagggaggtgggagggagg

SEQ ID NO: 14498 - DNA, 201 bp, Homo sapiens
gagcatagcaattgctcaataaaagtgtattgaagaaatgacacataataggcattcaataaatgttgaatgaataaatgaatatatccaataaaagcatrtgcttcctttattggatgagagatgtgaaaccatagactcaagaataaagtcatggggtacagggtaaagtaagatagtagatataatcaggagcttcta

SEQ ID NO: 14499 - DNA, 201 bp, Homo sapiens
cagcatacattgttgaatccaaatctaccatttaccatcggggtgactttcaatgagttctttaaactttctgagcctgttgtctcatctgtaatagagayaatagtgcctacctcatcaaaagtgttagaattaagtaagatgatttgtaacttagtaccagacacctcattaataatcaaatgttttttgcaataccac

SEQ ID NO: 14500 - DNA, 201 bp, Homo sapiens
tccagcctgggagacaagagcaagactccattcaaaaaaaaaaaaaagatttagaaggcatgattaattctaactagggagacaaggcatttccatctctraaatgagatgcctcgagccaaagaaggttgtaaaaggacgtgtgaccaggaactgtgctgtgtcactaagctacagtcactcgctctctttcctctttgc

SEQ ID NO: 14501 - DNA, 201 bp, Homo sapiens
tgctggagccaagtgagaggattctcctctgctccagaagcagaggtgtaccccacctcccactctcccaagctgctttgaaaaaggctgctaaaactcaycgacttaaaaaaaattttttaaaagaaaaaaaactccctgacttgagaggatttctcagtcctgatgaaggaaatctctagcagctcttcttgtccctag

SEQ ID NO: 14502 - DNA, 201 bp, Homo sapiens
gtaatcccagcactttgggaggccaaggcgggcagatcacctgaggtcagaagtttgagaccagcctggccaacatggtgaaaccctgacactactaaaartacaaaaattagctaggtgtggcagtgggtgcctgtaatcccagctactcgggaggctgaggcaggagaatcacttgaacccagaaggcggaggtttcag

SEQ ID NO: 14503 - DNA, 201 bp, Homo sapiens
ctgggagccttcagtctgtgttttaccaagctttccggtgattctgatgcatactgaagtttgagaaccacttctttattttgtagttcagtaccaggagytatctgataatataaaataccttatgtttatctagagctgcactgtccaatacagtagtcattagccataggcagttatttaaattttaataaaaccaag

SEQ ID NO: 14504 - DNA, 201 bp, Homo sapiens
tgagaccttgtctcaaaaaagaaaaaaatctcccagttagtatacctgatgctaggcttgctcttctcaagcttttcacacagcagccagagtgatctttytagaacataaatccagccatagcactcctcttttctgttgtccttaggatgatgtccaaattccttatcttcttcccacattgaacaaggataagaccct

SEQ ID NO: 14505 - DNA, 201 bp, Homo sapiens
ttctctcctccttcccttcttcctccctctctatcctttcctcctgactgctctgcccaccagcttccttggagtccaggccttcgatgtacaggctggtkgggggggtgtcctctgtgatgcagtgtttcctttgcctccgaggacccaccctgcctggcccctgtgcactggttggtgggggcaactcccgggctgtga

SEQ ID NO: 14506 - DNA, 201 bp, Homo sapiens
acgttgctgacagattcgaaggaagagaaggacacccgagtgtcattgaacaggtaccactggttctcgggctctggcctatcggcagttcccagagaagsggcagggcgggcagcgccctcacgggcatagcagtagtagtgaccactctccgaagacactccagagtgcaccaccacactgcagaggtcataggcctgg

SEQ ID NO: 14507 - DNA, 201 bp, Homo sapiens
ggctcatccttccagactcactcaagataaaacatctctgaaggaggcttccctgacattgtctaccaccacccccagcaagggctgataccaactgtcarcagctacatactcacccctacttgactgtaatgatttgcatccatgtcatctcctgccctactgtgacattcccagaccacccctcactgggcaggtggc

SEQ ID NO: 14508 - DNA, 201 bp, Homo sapiens
ctcatatgatctccaaagtaatcctgtaagattatttttgagtagggggtataaagtgaatcagcccattcatcctgcctcgcatagactagacataactrtgtctgattggattactgaggctactaataccagccttctatctatctcttttttcatttatgtgggaacctgattgtaaagatacagtaaattaagcac

SEQ ID NO: 14509 - DNA, 201 bp, Homo sapiens
ataaaagctgttctcattttccttacagtagaaaaatatacccagaagttatgtttattgctcccccaatgagatgttttacttaaaaaaaaaaaaaaaaattgacaggagactgacatccttgcccaggtgactaggcactcagtcactggtaagaaaatcacttgatctctctgaactgtaggctttctgtcagtaaag

SEQ ID NO: 14510 - DNA, 201 bp, Homo sapiens
caaattaggaagtactatataatatatgaaaacagtactatttaacacaacagcatgtcaataataattcagacctttttcagttacaatgttggactttytagagaattttgtggagatatgttagattggtaaataaaagctgttctcattttccttacagtagaaaaatatacccagaagttatgtttattgctcccc

SEQ ID NO: 14511 - DNA, 201 bp, Homo sapiens
ctgagctcaagtgatcctcctgcctttgcctcccaaagggctgggacctccttgttctaattggaatgttttctaggcatagaacattgtgctaaacacgrttagagaaaaagatatggtctggatcctggattctaacagcttatagtttcacttcacatgacagatttatgaattcccaattagaataaatggcaaaat

SEQ ID NO: 14512 - DNA, 201 bp, Homo sapiens
ttctgagaggtttatcattttcattcttatatttaggtctttggtccattttgagttaatttttgtatatggtataagggtccagctgtttttttacatgyggatatccagttttcccagcaccatttgctgaaaagttctgttatttcttttgtatttgtgtgatagtcctaggatgtgttataattaccttatagatga

SEQ ID NO: 14513 - DNA, 201 bp, Homo sapiens
aaccatttcaaaatctctgccatcactgtgtttacagcctgatgtacaaagtgatgagagaaagattggtattttcctggaattttatttgaaacacaggraagcacaggtaagaaacaaggttgaagaaagaaacaggaaaatgtctttaaaaaaagaggctgggtgcagggctttatacctgtaatcctagccctttgg

SEQ ID NO: 14514 - DNA, 201 bp, Homo sapiens
aggctgagaggcctgcaacctcagcggcctctggggcacagcacctctgttgtgcagcagcagggaggggcagtgatggagggaaaacataacacagaccrcaccattgttaggggatgaggttgctgggataatgctgtgagaagggatgaaaagaacgattctccattcttgattgttgtgatttccagggatgagcca

SEQ ID NO: 14515 - DNA, 201 bp, Homo sapiens
gactaagaagggcagattgcttgagctcaggagttgaaaaccagcctggataacatggcaaaacccagtctctacagaaaatacaaaaagtagccaggcayggtcacatgtgcttgcattcccagctactcagcaggctgtggtgggaggatcacttgagcctgggggaggtcaagactgcagtgagccaagatcattcca

SEQ ID NO: 14516 - DNA, 201 bp, Homo sapiens
gcatgaccatcaccaccatccatctccagaacttctcatcttacaaaactggaactgtgtacccattaaacagaaactccctattaccccctactcaccarcccctaatccctggcaaccattgttctactttttgtccttatgaatttgattctaggtatgttatataaatgggatcatacagtatttgtccttttgtga

SEQ ID NO: 14517 - DNA, 201 bp, Homo sapiens; identical to SEQ ID NO: 1951

SEQ ID NO: 14518 - DNA, 201 bp, Homo sapiens
cacccggctctaaatttcattcttaattttttcattgacccattaaatcattcaagagcatgttgtttaattttccatgtatttgtacaattttgaaattkcctcgttactgatttctagttttattccattgtggttagaaaagatgcttgatgtgatatcaattcttttaaaatctcttggcctaacatgaggtctgtc

SEQ ID NO: 14519 - DNA, 201 bp, Homo sapiens
ttgtcactagtgtttgttacataaataacctcagggcaaaaaatggttttagtgctctctttctttccagaatttctgctttcacttattttttttattgyggtgaatgaaacatatataacatcaaaattatttttaagtgaacaattcagtggcattaaatacattcacattgttgcatgaccatcaccaccatccatc

SEQ ID NO: 14520 - DNA, 201 bp, Homo sapiens; identical to SEQ ID NO: 1952

SEQ ID NO: 14521 - DNA, 201 bp, Homo sapiens; identical to SEQ ID NO: 1953

SEQ ID NO: 14522 - DNA, 201 bp, Homo sapiens
tcattggatgagggcccaccctaatccagtatgacttcctcttaactatgtacagagacgctattttcaagtaaggtcacattctgaaataccaggtagayatgagttttggaaggacactagtaaacctagtatagacactaagaaataatcacataaattcaggcagagatctttttaaagttgcaagcagaagtggga

SEQ ID NO: 14523 - DNA, 201 bp, Homo sapiens
cataggcatttgtgtgggtgtgggggggtgtgtccgtgttgccatgcaggatttgaaaatagttttcatttttagatttataggtttctgtgtagtcactrtaacaatcattgttatggtttctggattttaggtaatagactttccctcttataggctataaaagaaatgtactatgttttataatttcattttatatta

SEQ ID NO: 14524 - DNA, 201 bp, Homo sapiens; identical to SEQ ID NO: 1954

SEQ ID NO: 14525 - DNA, 201 bp, Homo sapiens
tacatcacatggtattctgcctttgtgtttctctgtctctgtgtctcttttataaggataccagttcattggatgagggcccaccctaatccagtatgacytcctcttaactatgtacagagacgctattttcaagtaaggtcacattctgaaataccaggtagacatgagttttggaaggacactagtaaacctagtata

SEQ ID NO: 14526 - DNA, 201 bp, Homo sapiens
tttccttgctttgtccataggcatttgtgtgggtgtgggggggtgtgtccgtgttgccatgcaggatttgaaaatagttttcatttttagatttataggtytctgtgtagtcactataacaatcattgttatggtttctggattttaggtaatagactttccctcttataggctataaaagaaatgtactatgttttataa

SEQ ID NO: 14527 - DNA, 201 bp, Homo sapiens
gtaggagattagccctttgtaataggaattgtgaattttagcgaaatatttatgacttctaacccaagttaccatttttttccttgctttgtccataggcrtttgtgtgggtgtgggggggtgtgtccgtgttgccatgcaggatttgaaaatagttttcatttttagatttataggtttctgtgtagtcactataacaat

SEQ ID NO: 14528 - DNA, 201 bp, Homo sapiens; identical to SEQ ID NO: 1955

SEQ ID NO: 14529 - DNA, 201 bp, Homo sapiens
tctaatgagagaaaagtaatatttaagtgtatttttaatttgtattccttttgtaagtcaacattgatcttttcacatgtttaaaaatcatttatagttayttgtctgtgaacatttgcttatttttctgcagggttaatgttcttactgatttgtaggagctctttatgtaggagattagccctttgtaataggaattgt

SEQ ID NO: 14530 - DNA, 201 bp, Homo sapiens; identical to SEQ ID NO: 1956

SEQ ID NO: 14531 - DNA, 201 bp, Homo sapiens
ctacaaaatcagtagatacagtcttctctctctaggatctgtgctgggaaacagagttctggttttaaatttcagctttgttacgatttatctcagtttcytcaacagtaaactaggagtgatttccaaaccttttttaaagcattgctttttaaccaaatctcacatgaaacagaataatttatgaaacaattgagaggg

SEQ ID NO: 14532 - DNA, 201 bp, Homo sapiens
gtatgtttgccagtctaatgagagaaaagtaatatttaagtgtatttttaatttgtattccttttgtaagtcaacattgatcttttcacatgtttaaaaawcatttatagttatttgtctgtgaacatttgcttatttttctgcagggttaatgttcttactgatttgtaggagctctttatgtaggagattagccctttg

SEQ ID NO: 14533 - DNA, 201 bp, Homo sapiens; identical to SEQ ID NO: 1957

SEQ ID NO: 14534 - DNA, 201 bp, Homo sapiens
attgtgaacagcagctgctcacttcactttttccttgtagtggtcgtagcaatagtagtgatgatttctatgtctgtaggacaagatgaacagaatataawttaaatatttggtgtttttacagaactttatagtctatacaacacttacgcagtctcatttaagcatgaggaaacaaagtgagataggtaggggctgata

SEQ ID NO: 14535 - DNA, 201 bp, Homo sapiens
acatgttagtttatctctaggataagtttctggcattgcctggttaaaggatatatactcttacacttttggtagattatatgtaattttgccacattgcyctccagagggtttgtaactatttacactcctgcctctttttccacagtcttgccaagatgattaccaaagttctgtatgtttgccagtctaatgagagaa

SEQ ID NO: 14536 - DNA, 201 bp, Homo sapiens
cacaggtaaagcttggagaatgtacaggtacacattgtgaacagcagctgctcacttcactttttccttgtagtggtcgtagcaatagtagtgatgatttytatgtctgtaggacaagatgaacagaatataatttaaatatttggtgtttttacagaactttatagtctatacaacacttacgcagtctcatttaagcat

SEQ ID NO: 14537 - DNA, 201 bp, Homo sapiens
actcttttaaatagatcccaaaatgcacatatgtcattgtgcacatgttagtttatctctaggataagtttctggcattgcctggttaaaggatatatacwcttacacttttggtagattatatgtaattttgccacattgctctccagagggtttgtaactatttacactcctgcctctttttccacagtcttgccaaga

SEQ ID NO: 14538 - DNA, 201 bp, Homo sapiens; identical to SEQ ID NO: 1959

SEQ ID NO: 14539 - DNA, 201 bp, Homo sapiens
tttcctcatgcccccttgtaatccatccttcccttacctcattcctagagaaccagtaacagcctttctgccactacagattgatttgcattttccataawtttacatagatggaatcatattgtaagtactagttttcctgacttctttcattctgcataatgcttttgggattcatccatgtttttccatgtgtcatta

SEQ ID NO: 14540 - DNA, 201 bp, Homo sapiens
tgggatctgaggagaaacagaaagttaacatttgactactttcttttgcttagtagcctatttcatttaatcactttatcacctttatttccatttttcawatgatgaaattgagtattttttcttccctgcctagcacttttataactccccggggctaaaaatcttctccgtctacccactccccatccttggctgggt

SEQ ID NO: 14541 - DNA, 201 bp, Homo sapiens
tagataatacatgcacatggcttaaacacaaaatatttgaaaagtatactgtgagaagtctcttctctatccttctgccaccatctgctcatttctaatamcctggtgtatttatctttataatgtatgttggcctgttaacatattagatatgttagaatatatctaatagagattataaatacgcatacaaatacgtat

SEQ ID NO: 14542 - DNA, 201 bp, Homo sapiens; identical to SEQ ID NO: 1961

SEQ ID NO: 14543 - DNA, 201 bp, Homo sapiens
ttcaagtgattctcctgcctcggcctcctgagtagctgggattacaggcacgtaccaccacgcccggctaatttttatatttttattagagacagggtttygccatgttggccaggctggtctcaaactcttgacctcaggtgacccgcccacctcggcctcccagagtgctgggattacagatgtgggccactgtgccca

SEQ ID NO: 14544 - DNA, 201 bp, Homo sapiens
ttttttttgagacagagtctccctctgtcagccaggcttcagtgcagtagctcggctcactgcaacctccgcctcctgggttcaagtgattctcctgcctyggcctcctgagtagctgggattacaggcacgtaccaccacgcccggctaatttttatatttttattagagacagggtttcgccatgttggccaggctggt

SEQ ID NO: 14545 - DNA, 201 bp, Homo sapiens
agtggtgtgagatggtctctcattgtggttttgagttgcatttctctgatgattagtgatgtttgtacatttaaaaatgtttgttggcccattgtgtgtcwtcttttgagaagtgtctgttcatgtcctttgcccactttataatggtattatttgtgttttttattgaattatttaagttcttagataaagattctcagt

SEQ ID NO: 14546 - DNA, 201 bp, Homo sapiens
aatgcttttcaatgtaaagtctcaggtttccagggtaaaccatcttcacttagcagaactaattcctttaacaagcatttgttgattccaactgtgtgtcrggtactgtgctagcctggagcagcaaagaaggataaaaagaaccttgttttagaggagctattaagtcagattctgtccccaaactgaacagctacacaa

SEQ ID NO: 14547 - DNA, 201 bp, Homo sapiens
ctacagtggccgaagtaatttacattcccaccaacagtgtataaggatttcctttgctccacagcctctccagcatctgttgttgttttttttttttttttacttttcagtaatagccattctgagtggtgtgagatggtctctcattgtggttttgagttgcatttctctgatgattagtgatgtttgtacatttaaaaa

SEQ ID NO: 14548 - DNA, 201 bp, Homo sapiens
gtcctacatagacatagttttataatgagttcagaaatggctcgacaaaagtgaaacctgtgacaaataccggattatttgtattgtagaccttggtcttrataattttgtttttcttcgagggttgatggcaggtcatgagatttgagagacacacacagtagtcaactgtatggaaaatactgaggaagtgtgttttcg

SEQ ID NO: 14549 - DNA, 201 bp, Homo sapiens
tctacagtggccgaagtaatttacattcccaccaacagtgtataaggatttcctttgctccacagcctctccagcatctgttgttgttttttttttttttttacttttcagtaatagccattctgagtggtgtgagatggtctctcattgtggttttgagttgcatttctctgatgattagtgatgtttgtacatttaaaa

SEQ ID NO: 14550 - DNA, 201 bp, Homo sapiens
gtattttaatttaatgtatataatttctgtccaactccaataaaatatcaaacccttaaagatagggatagtattcatctttgtatttttagcattcagcrtaatgaccagcatataatagacattctgcaaatatttgaatcattattttatacattaagaaatggatgatgagtaaggtgtaacaacttcactaactta

SEQ ID NO: 14551 - DNA, 201 bp, Homo sapiens
tgttcttgatttgaagatccaatttagcaactgcattctggcatttattcccctccttacccatccaccttgttttatgcatagaataaacccataaaatrttctttcttagttcttagtttcctggtgtgtctatccacccattagaataatgggtctgtcttttacatttctgtaaaactgtgtgccattatattactt

SEQ ID NO: 14552 - DNA, 201 bp, Homo sapiens
gagctgggcacagtgtttcacgcctgtaatcccagcactttgggaggctgaggcaggcagatcacctgaggcctggagttcgagaccatcctgaccaataatggtgaaaacccgtctctactaaaaatacaaaaattaggctgtggtgacgtgcacctgtattcccagctactcaggaggcagaagtgagagaattgcttg

SEQ ID NO: 14553 - DNA, 201 bp, Homo sapiens
cggcatataattgtgaccaaaacagtgacagttaccttccaagcatccgtcatgtcttggaaagcagctcgtacctctttggccaatctcaaggtctcaascagctccatgtgtactccaggaataggagcaataagagtggctaaatgcatgatataaaatgatctctattcctcacagcagtcctacaaagtacttagc

SEQ ID NO: 14554 - DNA, 201 bp, Homo sapiens
gattggttgatgccaggaattcaaggttgcagtgagctgtgatcacaccactgcactccagcctggatgacagaacgagaccctgtgtcctaaaaaaaaaacaaaaatgttgggggtggggaataagaaacgaattaaaaggccagggagctgggcacagtgtttcacgcctgtaatcccagcactttgggaggctgaggc

SEQ ID NO: 14555 - DNA, 201 bp, Homo sapiens
gtatatttgaaaactttaattatagggagtgaccctgaggggtgatgaagccatgaatcacagcagtgccaggtctactaatcagccctgtccagaatggmcatgtagaatgtactccacttaccaatggcaagccatctgaagggagcagctttcagtgagcaaaacaaaacagcaccaaacccaagttggctgaagctc

SEQ ID NO: 14556 - DNA, 201 bp, Homo sapiens
aggtcgaggctgcaatgagccataattgtgccactgcactacaacctggacaacagtgcgcgatcttgtctcaaaaaaaaaacagaaaattaaaaaatttwaaaaaaattataattcaactctaagaagcttcttaagaaaacttttaaatacatgtttctcattgaggggaaaaaaattaaataaaatagtttcagaacc

SEQ ID NO: 14557 - DNA, 201 bp, Homo sapiens
gatacatttccttcctttttcattcacagagctatttctccttttcagactccctgagaaatgtttcctcagccggtcatggcccccgctcttctccagcygagctcagcagctctagccagcaccttctccgagagcgcaagtcctcagccccatcacactccagccagccaactctgttcacgtttgaaccccctgtgt

SEQ ID NO: 14558 - DNA, 201 bp, Homo sapiens
gccattcttagcaaagaaatacctcagcatgtggcaactcatggatgtggccagtaagtgctgtgagaagtgaacaaagaatagaaaattaagcactgacrgccgggcgcagtggctcacgcctgtaatcccagcactttgggaggccgaggcgggcggatcacgaggtcaggagattgagaccatcttggctaacacggt

SEQ ID NO: 14559 - DNA, 201 bp, Homo sapiens
agaatagaaaattaagcactgacagccgggcgcagtggctcacgcctgtaatcccagcactttgggaggccgaggcgggcggatcacgaggtcaggagatygagaccatcttggctaacacggtgaaaccccgtctctactaaaaatacaaaaaattagccgggcgcagtggcgggtgccggtagtcccagctactcggga

SEQ ID NO: 14560 - DNA, 201 bp, Homo sapiens
ttgatttgttgcaaccgtgtagtgttgtaccttaccttacactgaaattttctgttgttttttttaatcttaccttttggattgaacattttgtttccttyttctaatttcctttttatccctctgcttatttggaagttacactctaactacttcattagaagttactctaggtattttattatgcatacttattaaaat

SEQ ID NO: 14561 - DNA, 201 bp, Homo sapiens
tgaaacttgtacagagataacaaaatcataaactgcttgagctgaaggggtctaatttctaaacatcaccccttccaccactgtgtcttttttttttttttctttttttttgagatggagtcttgctctttcacccaggctagagtgcagtgacatgatcttggcttactgcaaccaccacttcccaggttccagtgattc

SEQ ID NO: 14562 - DNA, 201 bp, Homo sapiens; identical to SEQ ID NO: 1942

SEQ ID NO: 14563 - DNA, 201 bp, Homo sapiens
ccccatctggccagtgatagaaatgtaagttttaatcaactccgggtattcctggtcaatatgggattttctcagtaaattcaagtttgtcttcttttgtscctgggctgctattttaagtgccccaaggcctagagagctggagacagtttattgaggctggaaggctggagcacagtttgggattgggattgggggagg

SEQ ID NO: 14564 - DNA, 201 bp, Homo sapiens
gagagaatacatatttttaagaggagtattttagtagatgactcataaaacatttattgagcacctactatataccaggcagtgtggtaggtatgggaagkgatacaaatgtgtgtaagagaccaacatcttcccttgaggaatttagagattaattgaagcataagcacacagaattgctgacaaagccattagtgttag

SEQ ID NO: 14565 - DNA, 201 bp, Homo sapiens
ctgaggctggtcagtggcaggcagaggccatgctcttctccccttcagacagctcaggaagatcccgtgcccaccttcttcctccccacctaactggtaaytcacagctactccctctttcccactctgtcccctcagccatctacttcatccgtcacctctgatgagaaggtggactacgttcaggtggacaaggagaag

SEQ ID NO: 14566 - DNA, 201 bp, Homo sapiens
agaaaatacaaaataaataaacgaaatatacaaagattgcaaagtgtgcagtttgtggtcttccctttaccaatgtacctgtgtgtgaaatagaattttcrttacatgctacaattaaaataatatttcaatagacttgatgctgttcttgatttgaagatccaatttagcaactgcattctggcatttattcccctcctt

SEQ ID NO: 14567 - DNA, 201 bp, Homo sapiens
tgcctcagcatggttccccttcacagggtggcagtgagcacagcacgtaaagtcctgtggctgatgtttgtttgcacctagcaaattccttcccctggatragcgacctgacagagatgggtggaggcagagatgaaggcctggacccatccaccagggccaaggaagggcctgggtcctcccagaagccgggaagtaaga

SEQ ID NO: 14568 - DNA, 201 bp, Homo sapiens
agacctaaatccctgcttgctcagaacctcaccctccaatttcccaaagcacttacagagaacctggaatctagtttgaaaaccactcttgtgaaacgaarggcttgtagagcatcggggccagatgggcccttagaaatcattgtgacgtactaggtcccacctgagagaggaggcttggtgatacacacagcacgtatc

SEQ ID NO: 14569 - DNA, 201 bp, Homo sapiens
agtactgtcctgtgcatttcttatgtattagttaaccttcacttttattttctccattttgtggataagaaactaaaggacagggtatttaggaaaattgsaaaagatgtctccattagaaaataaaagaaccacattttgaccccaagcaatcttcctctagtgcctggttggtgtctccatataaaataaactgaattt

SEQ ID NO: 14570 - DNA, 201 bp, Homo sapiens
ctctgtctaaaaaaaaaaaaaatacggagtcataatttattatgcatattatatacatattgagcacttactatatagagtactgtcctgtgcatttcttmtgtattagttaaccttcacttttattttctccattttgtggataagaaactaaaggacagggtatttaggaaaattgcaaaagatgtctccattagaaaa

SEQ ID NO: 14571 - DNA, 201 bp, Homo sapiens
ctgctgtaattcccaagaagcagcagtggctgccgcatacagcctttccccatggtcctgaacctggcttctttgggtggattatgatacatcagcattgyagtatgtctacaataatgtacatttaccaatataatcccatctatttccatcttttgaaaatagttaaaaatttctagtctgtctttttgcccttattcc

SEQ ID NO: 14572 - DNA, 201 bp, Homo sapiens
aggctgaggcacaagaatcgcttgaagccaggaaacagattgcagtgggccaagatcgtgccatgcactccagcctggactctgtctaaaaaaaaaaaaaatacggagtcataatttattatgcatattatatacatattgagcacttactatatagagtactgtcctgtgcatttcttatgtattagttaaccttcactt

SEQ ID NO: 14573 - DNA, 201 bp, Homo sapiens
tttcaaaccctttgtaaaccaagggaacagatgcaaattatctccttattttcatgaacttccatatcaaggttttttgttaactgaatttgtgattggtsagctttgagccagtgagtactattttcttttgttactgcacgtggcgtgtgtagtgttaacataaactgtactctaaagctgcctggtcctgaactactg

SEQ ID NO: 14574 - DNA, 201 bp, Homo sapiens
tgcctcctggtcctgggctctcgagtgggtccagagccctgccgtcgatacatcagccttcagaagggacttccaggcctgggaaagcctccccaggaggyatccttatagctaagcagtctagacagaagggtgcagagctgtgcctcagcatggttccccttcacagggtggcagtgagcacagcacgtaaagtcctgt

SEQ ID NO: 14575 - DNA, 201 bp, Homo sapiens
tgagggcttccgttgtcccctccaccatctgttagaaacagggccctcaccaggcaccaaatctgctggtgccttgatcctggactttccagcctccagcmctgtggactgtaaatttcatgtttataaataacagtctgaggtattttgttttaccagcctgaacagaccaaacagcatgctttggctgttaatctcaga

SEQ ID NO: 14576 - DNA, 201 bp, Homo sapiens
gtccaagggcagagaaacatgggtgtctcagcttcagaaaagaaaatgttttccctctgcctttttgttcttccaggctctcaacaaattggatggtgctyacccacactgggtgagaatggatcttccttactcagtccactgattaaaatgccagtctctcccagaaacaccctcaaagacacacccagaaataatgct

SEQ ID NO: 14577 - DNA, 201 bp, Homo sapiens
cccttctttggagagatgtctattcaagtcctttgtcaatttttagttaagttgtttgtttttgttgttattgtagttctttatatattctagttattaaycccttataatcctgtactagtcagtgttctccagagggacagaactaataatatgtatatatgaaagggagtttatacatatttcataatatgtatatta

SEQ ID NO: 14578 - DNA, 201 bp, Homo sapiens
caaagtgggagaatcacctgagcccaggaggtcgaggctgcaatgagccataattgtgccactgcactacaacctggacaacagtgcgcgatcttgtctcmaaaaaaaaacagaaaattaaaaaatttaaaaaaaattataattcaactctaagaagcttcttaagaaaacttttaaatacatgtttctcattgaggggaa

SEQ ID NO: 14579 - DNA, 201 bp, Homo sapiens
ccaacttcagggaattccaaatcctctgaaggaggaaaaggagacagggagaaacctgaccctattctcttcgttctaagtcttcatccttatttctgccytttttttttttttttttaaataccagacactccccctcaccaccccagccagccagcatagatagtctagtgttacctgccaaaacccaaagactgttag

SEQ ID NO: 14580 - DNA, 201 bp, Homo sapiens
aaatgatgagaacacatggacacaaatcagggaacaacaggcacaggggcctaccagagggtagagggtaggaggagggagaggagcaaaaaaaataactwttgggtactagatttagtacctgggtgatgaaataatctgtacatcaaacccccatgacacaagtttacctacataacaaacatgcacgtgtacccctga

SEQ ID NO: 14581 - DNA, 201 bp, Homo sapiens
gtgttgtcctagaacaaactccaaccttgaccaacttcagggaattccaaatcctctgaaggaggaaaaggagacagggagaaacctgaccctattctctycgttctaagtcttcatccttatttctgccttttttttttttttttttaaataccagacactccccctcaccaccccagccagccagcatagatagtctag

SEQ ID NO: 14582 - DNA, 201 bp, Homo sapiens
tttcccaaaactgaacttttgttaaatcttacatataatcttctccctcctctagtacaatgtttataaaatgagagatactagaggaaatgcagtgtgawctgtgctgcatctcttaattacaggaaccatttctccgcttactgaacacatactgcactccacgctgctgtgggctaggagtaaaaagacatgagcaat

SEQ ID NO: 14583 - DNA, 201 bp, Homo sapiens
agagcatctttgaatgttgctgaagatgaaaaatatcttgggcatggtagtagggaggtgggagggaggtttactgttccttaaatgaggcttatcccttyctgcttccatgcggctgatcaccattgtgatgaggaaagagatgattttgagccagatctgggtttgagacctagatttaccttgggcaaatttcttaaa

SEQ ID NO: 14584 - DNA, 201 bp, Homo sapiens
tccgagagcgcaagtcctcagccccatcacactccagccagccaactctgttcacgtttgaaccccctgtgtcaaaccacatgcagcccaccttgtccacyagcgcacctcaggagtatctctacttgcaccagtgcataagccgaagagcagaaaatgcaaggtaggaggctgccacagccattaggtgggttagtgacc

SEQ ID NO: 14585 - DNA, 201 bp, Homo sapiens
agagggagagaatgctagtgctggattattttctctgctcttactcttttttcttcctctgacaactcactttgggataaggatacatttccttccttttycattcacagagctatttctccttttcagactccctgagaaatgtttcctcagccggtcatggcccccgctcttctccagctgagctcagcagctctagcc

SEQ ID NO: 14586 - DNA, 201 bp, Homo sapiens
tcttttcaaaggtcagcttcctaatcagggctctttgagtaaatacttccgctttcatagtaccgcccacttccctatttctgctggaaatcttacttggycaaggcagggatttcatctgcgttattgatctccagatcctcatcaatctagaacagtgtctggcaaaccgttgatgtttaatacatatcacggattatg

SEQ ID NO: 14587 - DNA, 201 bp, Homo sapiens
ttttattttatttatttattttttaatttagagacagggtctctgtcacccaggctgttgtgcagtggtatgatctcgtctcattgcagcctcaacctccmgggctcaagcgattctcccaactcagcctcctggacagctgggaccacaggtgcatggcaccacatccagctaatttttctgtattttgtagagatggtg

SEQ ID NO: 14588 - DNA, 201 bp, Homo sapiens
tcctgcccctaagaagagcaccggcagcgttgattatctggccctggacttccagccgagctccccaagcccccaccgcaaggtgcctggagtagagttgrgggggcagtaagagctctcagggtcccggaggcagagatcatggaggccagggtgccttcaacactgaacagcagcactcagcctccctcctgctccagt

SEQ ID NO: 14589 - DNA, 201 bp, Homo sapiens
gcctatcggcagttcccagagaaggggcagggcgggcagcgccctcacgggcatagcagtagtagtgaccactctccgaagacactccagagtgcaccacmacactgcagaggtcataggcctggccacggccaccagccagtggcaggcggagcagcagggggatggagacgtcatccaggatcttgcggcgccgcatgg

SEQ ID NO: 14590 - DNA, 201 bp, Homo sapiens
tttggatttctttgattgctactgagtttgaatatattttcatgtattattggctcatattttaaatgacttgttcaaatgcaaggtgctttttgatacastttattcgtgtaattgggaaaactgtgtgacttcaggcattgtaataagggaacttggaataactagagcgggggaatctccagcagtagggagggaaaa

SEQ ID NO: 14591 - DNA, 201 bp, Homo sapiens
ctgtgggtccactccccattgttgtgagttctttggagggtgggcttcctcaccgcatgatctccagacctggagaagaaactggtatttagttcttttcrtctctttcaggacatcctcactcttctctggtaccacctggccctggtccacttgcttattgggcagccgttttgggtggggaactggcaagagggctta

SEQ ID NO: 14592 - DNA, 201 bp, Homo sapiens
cttcgggcttcgctggaatgacgcctttcaagtcccctgggacccacccctcagttccccacttcccagcttagctaactcacctcagcccagggactccktgtattattcatgatttagtctcctgctacaaacccttcttgagcacctgtttatcaagcagtaggagttgtcatcagatgtaaggaagacatgagacct

SEQ ID NO: 14593 - DNA, 201 bp, Homo sapiens
agttccagctcctcaggagtctgaggcaggagaatggcgtgaaccggggaggtggagcttgcagtgagccgagattgcgccactgcattccagcctgggcracagagctagactccatctcaaaaaaaaaaaaaaaaaaaaaaaaatccatgttttttccccacattctgtggattaggattctgcctttatttttttaat

SEQ ID NO: 14594 - DNA, 201 bp, Homo sapiens
attatcattactggctgattaccagactttcttttcctgctccagcaaagccaacaccacttgacctgaggaacaacaccgtcatcgatgaactccccttyaagtcacctatcaccaagtcttggtctagggccaagtaagtgcgtatgtgtgggggtgggagcttggagtcgggccattagggaaaatgagtgatgtggt

SEQ ID NO: 14595 - DNA, 201 bp, Homo sapiens
agtcttggtctagggccaagtaagtgcgtatgtgtgggggtgggagcttggagtcgggccattagggaaaatgagtgatgtggtagctggcctgtgggccsggacagctggattctgatgctaacgctatcattagctgatcatgtctcgatgtcttgtggcttggtttcctcagctgtaaaagagaataattatacctgc

SEQ ID NO: 14596 - DNA, 201 bp, Homo sapiens
gagaaacttgggcatcatctttgactccccgtcacccactatcccacatctaatctgtcaccaaaacccattagtggtatcatctaaatatcttgttataygcttcttcatccccactgccatgacttttaggattattttagtagccatctgttgagcacttactttgtaccaggcactatgcttagaccattgatcttt

SEQ ID NO: 14597 - DNA, 201 bp, Homo sapiens
ctcccacagtgctgggattacagacagacatgagccaccgcgcccagcctgcatggttcctttcttgtttccttttcttagagtagatgaagtgccacttytatctgagctaatcctgctacttatactttgaatcatatcttctcctccctactcaaataattcttatcctgtaacacatcttcaacttctttccctctc

SEQ ID NO: 14598 - DNA, 201 bp, Homo sapiens
tgttatgaagcttttcttctatgttttcttctaagaggtttatagttgtagctcttacatttaggtctttgatccattttgagttagtttttttatctgtkttaaggtaaaggtccaagaactttgttcttgtgggttgacttagttttccagttctatgtgttgcttttttttttttaatctagtttagcaaactttcta

SEQ ID NO: 14599 - DNA, 201 bp, Homo sapiens
gatacccataggaatgcttttggggaagtcttcagcatccagtgaggaatgttagtggggtcttcaaatagctctttctagagagaatgactggtgccttraaagtcaggacctcttattcaagctggatttcttacagcagggagaactgtggtagagccaagtagtccattcagattcattctgatgaccttggtcctt

SEQ ID NO: 14600 - DNA, 201 bp, Homo sapiens
aggttattttaaataaccctgaaatatcaggccttcctcctccatctcttgcttgtcatttttcatttacagctggttctagtcatccacagaacaggccrtgagttcagacatgagctccataaaatcctcgcaaatgtttctgtgttgtcctagaacaaactccaaccttgaccaacttcagggaattccaaatcctct

SEQ ID NO: 14601 - DNA, 201 bp, Homo sapiens
taatgggctcttcaaactagcttatcttgtcatttcttctcttggttatttcaaagcataaatttgggattcgatggtttcagttttagcttaaatctgtmtccttggtgatgaacttaaattagatgctaatattttgaaggaggacatgtttatgcaaaccagagtgagaacttttagtctaagggtcagcaaactttc

SEQ ID NO: 14602 - DNA, 201 bp, Homo sapiens
cagatagtaaatactttaggctttgtcatctgtactttgtagcaactactcagctttgctgttgtagtatatatgcagccataaacaattatgtaaataarttgatacagctgtgttctagtgaaaccacagaaacagaccagatgtaatgtatgggctgtagtttgctgacccctgttctggtgtaataatatgctttgg

SEQ ID NO: 14603 - DNA, 201 bp, Homo sapiens
cctcctgagtagctgggattacaggcgcacactaccatgcccggctaatttttgtatttttagtagaaacggggtttcaccatgttggccaggatgatatkgatctcctgatctcgtgatccacccgccttggccttccaaagtgctcagtgctatctgtacatcgatattaacctctgatggctaaactagcaagataac

SEQ ID NO: 14604 - DNA, 201 bp, Homo sapiens
agccagaacctagagagttaatagaaattgaacagtgaaagtggagtccttttcttctctcctcaactggggagccgccaggctgtttcacttgcaccgcmtgtgttccattatggtataatgatgtaattaccagtaatgctgctgctgcttgagtagtggtgaagaggcagcattaaggaaaagactagccccagttct

SEQ ID NO: 14605 - DNA, 201 bp, Homo sapiens
tttcccagtagcacactgcttctcctgaagccgaagttccccttcagagaattatgtagatctcataattccctaggcaaaactggagctctttgaatccyagcctagccatccacactataccagtttaaggtgcaatcttgtgattattgccgctgatcacgattcttgataagcatccacaactgataagtctgacgc

SEQ ID NO: 14606 - DNA, 201 bp, Homo sapiens
gccggtctgctcgtgaactaaatacagtgtcgaagtttgtattgatggcttctggagaccgagagagttgactctcggggctggggctccgcggcagcccsgagcagcttcagcccgcagggtcggggagagggcgggaaaggggggcgtaggctgtggggccgcgcggacggccccacaaagggcgagcgcctcacgccc

SEQ ID NO: 14607 - DNA, 201 bp, Homo sapiens
atggctaaagatagacttgctatccccaaacagaaatacacacaacccagaaaacctcactaagtgataacaatttcttgtaccctaaataactgtttacmtttggatctcatttggtcattcttctaacccagggaggaaagattccaacagaacttgctgctctagtgtgtttattgaagatcgccttgttctggttct

SEQ ID NO: 14608 - DNA, 201 bp, Homo sapiens
caatgtcattcacaattattttatattccactaagcaggggaataaataccttattgaaagagtgcttgtagacttatgcggacatggatttatagtccgkcactctcttgcatacacaaaaaagaaaagtataaatgaaacattggtaaagaaatttctaaaactacttcataatcaattctagctttcaatcacttttt

SEQ ID NO: 14609 - DNA, 201 bp, Homo sapiens
cgcctagtccccgccgggccgcccgccccgcccctggcctcccgcgagctgcgcaccgccggccgctgccccagctgcccgagcccgcgccctcgtccgcrcgacccggcggggggctccaggccggcagcatgagcggcggcggcgacgtggtgtgcaccggctggctgaggaaatcgcctcccgagaagaagttgaggc

SEQ ID NO: 14610 - DNA, 201 bp, Homo sapiens
gagcaaaaaaaataactattgggtactagatttagtacctgggtgatgaaataatctgtacatcaaacccccatgacacaagtttacctacataacaaacrtgcacgtgtacccctgaacctaaaagtttaaaaagaaaaaatgccaatgaaaacattataaacttatgaaaatcaaaaagggtaccctatatatggaatt

SEQ ID NO: 14611 - DNA, 201 bp, Homo sapiens
ctatatgtacataactacattggaggctctgaaatgataaactcatttaatgtgcttaacacagggtcaaatgtgctcaaacatggaacctttttttttttatctatttaccttttagtttttagtaacatgtttaggagatctgatatagggaaaggaggaagagggagaaacaggcttctagggaaataaaagaagaac

SEQ ID NO: 14612 - DNA, 201 bp, Homo sapiens
tgaccagatgtactacacacaaaaagagccatctctcagtagagagctttgatgaattattcatgtgctcaggagtcaacccctgttaggaaagccatcascccttttgaattctcaaagctgaggacttctcttttccttttatcccatccctcctccatttattcagtagctattctagggcctgcacagccactatca

SEQ ID NO: 14613 - DNA, 201 bp, Homo sapiens
actagagtgtaagcaaaaggtgaggaaaactgaaattgtaggttgaaatttttgtttctgcgagtatacttatttgcatttgcacagaaggtggtgatccytatatttatttctgctgtgcatcaataggggaggtggagataaataatttcattgttttggctctggccagaattcattaggcacagtttgttgtccata

SEQ ID NO: 14614 - DNA, 201 bp, Homo sapiens
tctacaactcagtaagaagagagcaatccaatatttttttaatgggcaaaaaatgtgaatagattcttcaacaaaaaaagatataggaatgtccagtaacyacatgaatagatgatcagtgatctgggaaatgcaaattaaaatctcagtgagattctgctttacctctgctggaagggctaaaataaaaatggctaacag

SEQ ID NO: 14615 - DNA, 201 bp, Homo sapiens
gtcttggtctagggccaagtaagtgcgtatgtgtgggggtgggagcttggagtcgggccattagggaaaatgagtgatgtggtagctggcctgtgggccgsgacagctggattctgatgctaacgctatcattagctgatcatgtctcgatgtcttgtggcttggtttcctcagctgtaaaagagaataattatacctgcc

SEQ ID NO: 14616 - DNA, 201 bp, Homo sapiens
caaaatgcgagaaaatattcaacgcgcatatctaacaaaggatttgtttgtggtccatataaagaacttctacaactcagtaagaagagagcaatccaatwtttttttaatgggcaaaaaatgtgaatagattcttcaacaaaaaaagatataggaatgtccagtaaccacatgaatagatgatcagtgatctgggaaatg

SEQ ID NO: 14617 - DNA, 201 bp, Homo sapiens
cttggagtcgggccattagggaaaatgagtgatgtggtagctggcctgtgggccgggacagctggattctgatgctaacgctatcattagctgatcatgtstcgatgtcttgtggcttggtttcctcagctgtaaaagagaataattatacctgccctatatcagatcttaatctgatggagtgtgcagctctaatggctg

SEQ ID NO: 14618 - DNA, 201 bp, Homo sapiens
tcaaaaaaaaagacaaatcacaaaatgcgagaaaatattcaacgcgcatatctaacaaaggatttgtttgtggtccatataaagaacttctacaactcagkaagaagagagcaatccaatatttttttaatgggcaaaaaatgtgaatagattcttcaacaaaaaaagatataggaatgtccagtaaccacatgaatagat

SEQ ID NO: 14619 - DNA, 201 bp, Homo sapiens
tgcagctctaatggctgaggtctgggtgtgtgagggtcagggcccagctggaggctagaaacatggcagcagccatgcagcttccccagtgttaactcttycttcccacaacagccacaccttcaactccagctcctcccagtactgccgccccatctccacccagagcatcaccagcacagactcaggagacagcgaaga

SEQ ID NO: 14620 - DNA, 201 bp, Homo sapiens
ggaacagccttttccctctaggtggggaactggcagcctgggggaggtggaacagcgtggcgctgagccgtggagttctggctttttttttttttttttttaacccctctccccagaggatgccttgcctggtgaggtcaaagtacaagatggtgccagttactgagatttggccgaaatggtcttggggtagtcgcggga

SEQ ID NO: 14621 - DNA, 201 bp, Homo sapiens
cgggcagctcccgggtgtctggggtcgggagagatcgaggctctccgcggccaggtgttgccaaccgacagtgtttactgagatcgctggaacagcctttyccctctaggtggggaactggcagcctgggggaggtggaacagcgtggcgctgagccgtggagttctggctttttttttttttttttttaacccctctccc

SEQ ID NO: 14622 - DNA, 201 bp, Homo sapiens
gcaaccgtgtagtgttgtaccttaccttacactgaaattttctgttgttttttttaatcttaccttttggattgaacattttgtttcctttttctaatttyctttttatccctctgcttatttggaagttacactctaactacttcattagaagttactctaggtattttattatgcatacttattaaaatgtttaaattt

SEQ ID NO: 14623 - DNA, 201 bp, Homo sapiens
cagcccttgtattaagtgactcatttgtttgtcccccttctttccctttattccgttcgtctctcacaggcgcctcccccgaccccggtgtgacactgcastttggtccccgtggctggcccgggtttgggaccgggcagctcccgggtgtctggggtcgggagagatcgaggctctccgcggccaggtgttgccaaccga

SEQ ID NO: 14624 - DNA, 201 bp, Homo sapiens
aaccagtaaagcagccaacaaacagaacacaggactatcaccttctcattagaataagacttccagaaagttctagaggaggtggtgctctgctagagcasgagcctggatggacaggatcctagagcgtgtcatctgaagaaatgcgggcttgtgcagcctggagatgaagccaccctcttcagatcttggaggagctag

SEQ ID NO: 14625 - DNA, 201 bp, Homo sapiens; identical to SEQ ID NO: 1943

SEQ ID NO: 14626 - DNA, 201 bp, Homo sapiens
ctagataatatgtattcttgctaaaataacttcatttctcaaaatgcaggtcttccactgagctaaaataagtaactattcagaataatatctattgccarcggaaagagttttgaactggcagagtcaagacaaatagagttctttttctctttgaagacaagttggtttcactggacttatttttgtcctccagccttt

SEQ ID NO: 14627 - DNA, 201 bp, Homo sapiens; identical to SEQ ID NO: 1944

SEQ ID NO: 14628 - DNA, 201 bp, Homo sapiens
ccatctggcttattgatacttgttcagggagtgggggttataacccctgctattaactgccatttggagatgggggacggatgaagtctaacattgtttamacattcatatactagagtctgaacaaccttcaaaatatgcttttagtcaccattttacagatgcctaaaccaaagtatagaaagagaaagtgctttgcct

SEQ ID NO: 14629 - DNA, 201 bp, Homo sapiens
ttgatacttgttcagggagtgggggttataacccctgctattaactgccatttggagatgggggacggatgaagtctaacattgtttaaacattcatatamtagagtctgaacaaccttcaaaatatgcttttagtcaccattttacagatgcctaaaccaaagtatagaaagagaaagtgctttgcctcaaggtcacaca

SEQ ID NO: 14630 - DNA, 201 bp, Homo sapiens
accagcataaccctactatcaaaatctggcaaagatgacaggaaataaaattacagagaatatcccccatgaataataaacagaaatcctctttaaaaacmaaggattagcagtcgaatccaactaaatacgtatgtgtgtatatctatatgtgtctgtttgggacaatatatatattttagggaatatgcatgtgtgtat

SEQ ID NO: 14631 - DNA, 201 bp, Homo sapiens
aatatgcttttagtcaccattttacagatgcctaaaccaaagtatagaaagagaaagtgctttgcctcaaggtcacacagctagtaattgtctcaccctcstgccctttcccttctttctcttttaggagtgccagcttctctcagggcaccagagcctcttttctcatgaggagtgacacagctgtacaaaaacttgccc

SEQ ID NO: 14632 - DNA, 201 bp, Homo sapiens
ggtctttgatccattttgagttagtttttttatctgttttaaggtaaaggtccaagaactttgttcttgtgggttgacttagttttccagttctatgtgtkgcttttttttttttaatctagtttagcaaactttctaccaatatttcttcgacttttttttttttttaagagacagggtctcagtctggcacctaggctg

SEQ ID NO: 14633 - DNA, 201 bp, Homo sapiens
acccagagcatcaccagcacagactcaggagacagcgaagagaactatgtccctatggtgagtccttcgggcttcgctggaatgacgcctttcaagtcccstgggacccacccctcagttccccacttcccagcttagctaactcacctcagcccagggactccttgtattattcatgatttagtctcctgctacaaaccc

SEQ ID NO: 14634 - DNA, 201 bp, Homo sapiens
acaaaacctccttgtctccatctcacatgaggccaatgacagttaagagacttaaatagagttgcagagtcattgtgccagagatgagactcagaccctakagtcccagctcctagtttagacctctttgccgtctttcaatccatcgacaatttgagcagtcatactccgttttggaactgagatgataaagacatacat

SEQ ID NO: 14635 - DNA, 201 bp, Homo sapiens
gatcttaatggtgttccataagtcttgcaggttttcttcactcttttcatttgtattccccctttccttctggctgggtaatttcaaactacctttcttcragttcagatattctttcttctaattgatcaagtttgctgttgaagctctctgttgtgttttttatttcattcattgaattcttcagctgcaagatttctg

SEQ ID NO: 14636 - DNA, 201 bp, Homo sapiens
gatgagactcagaccctagagtcccagctcctagtttagacctctttgccgtctttcaatccatcgacaatttgagcagtcatactccgttttggaactgwgatgataaagacatacataaaacatgttcctgcccttcagagcttacatctcattgggaaaataaaaccaacacatataaatcaggacaagtattgttac

SEQ ID NO: 14637 - DNA, 201 bp, Homo sapiens
tcctagtttagacctctttgccgtctttcaatccatcgacaatttgagcagtcatactccgttttggaactgagatgataaagacatacataaaacatgtkcctgcccttcagagcttacatctcattgggaaaataaaaccaacacatataaatcaggacaagtattgttactgtggtgttcagagaagtgatggctggg

SEQ ID NO: 14638 - DNA, 201 bp, Homo sapiens
gacctctttgccgtctttcaatccatcgacaatttgagcagtcatactccgttttggaactgagatgataaagacatacataaaacatgttcctgcccttyagagcttacatctcattgggaaaataaaaccaacacatataaatcaggacaagtattgttactgtggtgttcagagaagtgatggctggggtgagcagga

SEQ ID NO: 14639 - DNA, 201 bp, Homo sapiens
gagaaacttttcattatcaaaaatcatgctataaaaaatgtttgatttggaggcaggggtgaaggcattaggggacacagtttccgaattgcaaaaaaaaacagtcaatttacttgggcttaaaagtatagctataaaaccataacatagttcaacaaatccataccttgcttttgctctagaactgcactgttctgtata

SEQ ID NO: 14640 - DNA, 201 bp, Homo sapiens
tgagcaaaacccagtggccatcacagcccctgagtccaaggaagaacaatctcttgcttaggcttacttttatttatttaagaacatgggtgtctgtcttstcttcggttagaagttagaagggggctacagcagtgtcagggcacttcacccaacctgcaggtggctgctgttgcagctacaaaggccaactgctcagag

SEQ ID NO: 14641 - DNA, 201 bp, Homo sapiens
tataaatcaggacaagtattgttactgtggtgttcagagaagtgatggctggggtgagcaggacaggtgagtggtgtaggagtcaaaggagaggtgcatakatgagggtagagtagtcaaggacagcttctctgcagatgctaacactggagctacatctagaagcccaggaggaatttttgaactgaggagtgatgtgtt

SEQ ID NO: 14642 - DNA, 201 bp, Homo sapiens
cacaaattcttttttccaactttcttgacagtagaccctatccatatacttctttaagccccactgttaagtaaagtgactttcattgtcttttgtctccrttattactaccctaatttagattgccatcttctctcaccattgcagactatcgcaacagcttcttaattgttttcttgtctcttattttttatttttctg

SEQ ID NO: 14643 - DNA, 201 bp, Homo sapiens
tgccccagaattaagaaccagaggttgttaaaaccaaaccagtggatcctaatctgaatctctgtaaatatgactaatgaggtctgaggtgggaccagccytctgcatttacatttcccagagataactttgatgtgtacccccgatctaatccaacctcttctttttgtaaatagagacagtgaggcttgggaagatgaa

SEQ ID NO: 14644 - DNA, 201 bp, Homo sapiens
ggatcctaatctgaatctctgtaaatatgactaatgaggtctgaggtgggaccagccctctgcatttacatttcccagagataactttgatgtgtaccccygatctaatccaacctcttctttttgtaaatagagacagtgaggcttgggaagatgaaatggtatgcccagattcactcagccagtaggcggtagagctag

SEQ ID NO: 14645 - DNA, 201 bp, Homo sapiens
caaccaaaaatgtctaggataaaacctgcaggttcaagaccagaccaggagtgaaagtgagtttgaaatcaacataaggttgaaggaaacaatctcttgakagagaactcgttccaaaaggaaaccaggaatgatgttctagaaggaaaagcagtttcaggaacacatatcaagatgctatatcatatatgtgggatttat

SEQ ID NO: 14646 - DNA, 201 bp, Homo sapiens
ctggacccccatcctcatattttaactttccttccctagtaccattcacctcatagggctcttgtgggagttcttcctctgcacaggtgaaaagaattggstttggagactgtgagatctgattcagatctaggctatgccactttctggctgtgtgaccccagagtttgctattgatgtctctgagcctatttttcttca

SEQ ID NO: 14647 - DNA, 201 bp, Homo sapiens
gttttttcatccttcttgccacctccagattcttatttctactgccaccttccagtcttcacatattccaaccaaaaatgtctaggataaaacctgcaggytcaagaccagaccaggagtgaaagtgagtttgaaatcaacataaggttgaaggaaacaatctcttgagagagaactcgttccaaaaggaaaccaggaatg

SEQ ID NO: 14648 - DNA, 201 bp, Homo sapiens
ctgattttgaccacaagaaacacacatatttggatttttgcgccagggaaaattcttttattttttcagtatgatcagtcaacaaatgtgtattgaatacrtaccatggctggggctgttctaggcactaggggtacataagtgatagaaggtgttccatgtacctatgacattcaagattttctagaccttatgtgtatt

SEQ ID NO: 14649 - DNA, 201 bp, Homo sapiens
taaataaggagactgagactctgagaggtgaagtgacttccccaagtatgcagctaaatagactgagtcacagatatgactccacaggctgagctcaaggmaggggctgcagaggtgaggatgggtcactcctcttttattcatactcacagccaaagcattcaacatagggggcatgaaggatgcatttgatgacaaggc

SEQ ID NO: 14650 - DNA, 201 bp, Homo sapiens
cgggagttcgaggttatagtgagctatgattgcaccatggcactccagcctgagcaacagagcaagaccatgtctctaaaaaagagagctttgactgggcrtggtggctcacgcctgtaatcccagcactttgagaggctgaggcagtggtgatcgagaccatcctggccaacatggtgaaaccccatctctactaaaaat

SEQ ID NO: 14651 - DNA, 201 bp, Homo sapiens
cctcccaggttcaagccattcttctgcctcagcctcccgagtagctgggactacaggtgctcgccaccacgcctggctaattttttttttttttttttttttgtcgttttagtagagacggtttcaccgtattagccaggatggtctcaatctcctgacctcgtgatctgcctgcctcggcctctcaaaatgctgggatta

SEQ ID NO: 14652 - DNA, 201 bp, Homo sapiens
ctcccatggccttgggcactccacctctatagctttgcagggtatagcctctcttctggctgatttcatgggctagcattgaatgtctgcaccttttccasgcacacagtgcaagctgtcagtggatctaccattctggggtctggaggatggtggcccttctctcacagctccactaggcggtgccccagaagggactct

SEQ ID NO: 14653 - DNA, 201 bp, Homo sapiens
ttgggtaaatacagccattctaaatgggagaaattggccaaaacaaaggggctacaggccccatgcaagtccaaaatccagtggggcagtcaaatcttaaagctccaaaatgatctcctttgactccctgtttcacattcaggtcacactgatgcaagaggtaggctcccatggccttgggcactccacctctatagcttt

SEQ ID NO: 14654 - DNA, 201 bp, Homo sapiens
ccagccttagcttttttttttcctgtaattagatgtttaaatttcattttttttttaaatttcaacttgtttttcagatgccagggtacatgtgcaagtgygttacatgggtatattgtctaatgctgaggtttggccttctgttcatcctatcacccaaatagcattgtaccccataggtagttgttcaatccttgtccc

SEQ ID NO: 14655 - DNA, 201 bp, Homo sapiens
ctctccctccctgttaacataatccccagtgtctactgtttccgtctttatgtccatgtgcaccctgtgtttagctccaacttataagtgagaacattagrgtatttggttttctgtttctgcattaattcacttgggataatgatgttcagctgcattcatgttgctgcaaaagacatgatttcatcctttgaccacagc

SEQ ID NO: 14656 - DNA, 201 bp, Homo sapiens
ccatggatgcatccagacagacatagaacccactggcagcacctcaagttgcacatttcccaaaggactattcacattgttttctgtgtaggggtatcccmtggagttgatcaatccagtgtccctgtccctggtttgctcctatagaggcttcatcatatgtggagcctctttcaagcagatactccctcttttcctttc

SEQ ID NO: 14657 - DNA, 201 bp, Homo sapiens
aacattgcacttagccattcagatgataacttggatcagaaattttgagaagtggtgggatgaagaagatccctgaagagaggagtaactgagacaaaggmgaggctagcaatagagagacaagtgagggaattagacctttggtatcatcatgaaaaggtgagttttgggaaacaaagagtatggcgggcaagtacctag

SEQ ID NO: 14658 - DNA, 201 bp, Homo sapiens
agccacaccttcaactccagctcctcccagtactgccgccccatctccacccagagcatcaccagcacagactcaggagacagcgaagagaactatgtccmtatggtgagtccttcgggcttcgctggaatgacgcctttcaagtcccctgggacccacccctcagttccccacttcccagcttagctaactcacctcagc

SEQ ID NO: 14659 - DNA, 201 bp, Homo sapiens
gaaaatgagtgatgtggtagctggcctgtgggccgggacagctggattctgatgctaacgctatcattagctgatcatgtctcgatgtcttgtggcttggkttcctcagctgtaaaagagaataattatacctgccctatatcagatcttaatctgatggagtgtgcagctctaatggctgaggtctgggtgtgtgagggt

SEQ ID NO: 14660 - DNA, 201 bp, Homo sapiens
acactgcagaggtcataggcctggccacggccaccagccagtggcaggcggagcagcagggggatggagacgtcatccaggatcttgcggcgccgcatggkgcgcaggtcgaaagagaagcgcagcagtgtgaggatgaggtagcacggcccttggctcagctccaccaccttctcggcatcctgcagggaggcacacgac

SEQ ID NO: 14661 - DNA, 201 bp, Homo sapiens
ggagtcgggccattagggaaaatgagtgatgtggtagctggcctgtgggccgggacagctggattctgatgctaacgctatcattagctgatcatgtctckatgtcttgtggcttggtttcctcagctgtaaaagagaataattatacctgccctatatcagatcttaatctgatggagtgtgcagctctaatggctgagg

SEQ ID NO: 14662 - DNA, 201 bp, Homo sapiens
cagaggtcataggcctggccacggccaccagccagtggcaggcggagcagcagggggatggagacgtcatccaggatcttgcggcgccgcatggtgcgcasgtcgaaagagaagcgcagcagtgtgaggatgaggtagcacggcccttggctcagctccaccaccttctcggcatcctgcagggaggcacacgactcgcag

SEQ ID NO: 14663 - DNA, 201 bp, Homo sapiens
ccacggccaccagccagtggcaggcggagcagcagggggatggagacgtcatccaggatcttgcggcgccgcatggtgcgcaggtcgaaagagaagcgcascagtgtgaggatgaggtagcacggcccttggctcagctccaccaccttctcggcatcctgcagggaggcacacgactcgcagtagtagcggttttctgct

SEQ ID NO: 14664 - DNA, 201 bp, Homo sapiens
gggggtgggagcttggagtcgggccattagggaaaatgagtgatgtggtagctggcctgtgggccgggacagctggattctgatgctaacgctatcattakctgatcatgtctcgatgtcttgtggcttggtttcctcagctgtaaaagagaataattatacctgccctatatcagatcttaatctgatggagtgtgcagc

SEQ ID NO: 14665 - DNA, 201 bp, Homo sapiens
tgaaggagtcacaagtccactcagattcatggaaagggaacatagacttccaacctcttggtagatggagtatcaaagaatttgtggtcattttaattttwattttatttatttattttttaatttagagacagggtctctgtcacccaggctgttgtgcagtggtatgatctcgtctcattgcagcctcaacctcccggg

SEQ ID NO: 14666 - DNA, 201 bp, Homo sapiens
actttcttttcctgctccagcaaagccaacaccacttgacctgaggaacaacaccgtcatcgatgaactccccttcaagtcacctatcaccaagtcttggkctagggccaagtaagtgcgtatgtgtgggggtgggagcttggagtcgggccattagggaaaatgagtgatgtggtagctggcctgtgggccgggacagct

SEQ ID NO: 14667 - DNA, 201 bp, Homo sapiens
tcatcgatgaactccccttcaagtcacctatcaccaagtcttggtctagggccaagtaagtgcgtatgtgtgggggtgggagcttggagtcgggccattakggaaaatgagtgatgtggtagctggcctgtgggccgggacagctggattctgatgctaacgctatcattagctgatcatgtctcgatgtcttgtggcttg

SEQ ID NO: 14668 - DNA, 201 bp, Homo sapiens
taccaactgtcagcagctacatactcacccctacttgactgtaatgatttgcatccatgtcatctcctgccctactgtgacattcccagaccacccctcaytgggcaggtggcatctctgtatcccttttgcctggcccagatggaaattaggacatcagtaaatgtaaaatgaacaaatccagatgggagcatccaacag

SEQ ID NO: 14669 - DNA, 201 bp, Homo sapiens
agggcccagctggaggctagaaacatggcagcagccatgcagcttccccagtgttaactcttccttcccacaacagccacaccttcaactccagctcctcmcagtactgccgccccatctccacccagagcatcaccagcacagactcaggagacagcgaagagaactatgtccctatggtgagtccttcgggcttcgctg

SEQ ID NO: 14670 - DNA, 201 bp, Homo sapiens
cgcctgtacgcctgtaaccccaacactttgggaggctgaggcgagtggatcacctgaggtcagaagttcgagaccagcctggccaaaatagtgaaaccccrtctctactaaaaatataaaaattagctaagcgtggtggcaggcgcctatagtcccagctactagggaggctgaggcaggagaatcacttgaactcaggag

SEQ ID NO: 14671 - DNA, 201 bp, Homo sapiens
tgctcttgcaaccccatccccaccttgaaatccttcagaggctccccgttccctttagtcctggcctggcctccagtgtcttctctcagccctgccttctratgtgcttgctgcagcctgagcagcttcgagtttctagaacttgccaggttgtgttctacatctttgagccttcaactagaacaccatttcccttctcct

SEQ ID NO: 14672 - DNA, 201 bp, Homo sapiens
cccagccctcagtaaggtaagtaagtcagtcagtccacacgtttacttacaccccacttcagtagattcagtagagggctcttggctccctgtggcatctsacacgtcactggggggcaggctgagtcctggcctccccagaccccgtgagcaaaacccagtggccatcacagcccctgagtccaaggaagaacaatctct

SEQ ID NO: 14673 - DNA, 201 bp, Homo sapiens
ctttcaagtcccctgggacccacccctcagttccccacttcccagcttagctaactcacctcagcccagggactccttgtattattcatgatttagtctcstgctacaaacccttcttgagcacctgtttatcaagcagtaggagttgtcatcagatgtaaggaagacatgagacctgtcccaacgaagtcatggtcttca

SEQ ID NO: 14674 - DNA, 201 bp, Homo sapiens
tatcaagcagtaggagttgtcatcagatgtaaggaagacatgagacctgtcccaacgaagtcatggtcttcaagagcaggggcctgcctctcatgacagtsacatgggtggcatgatctgtgcccttggataggcagtgctggaggtatctcctcagtggtggaggtatctcctcagtggtgagaggcatacgtgcacata

SEQ ID NO: 14675 - DNA, 201 bp, Homo sapiens; identical to SEQ ID NO: 1925

SEQ ID NO: 14676 - DNA, 201 bp, Homo sapiens
tcatctttaatgatcctttttgcatttctatgctgtcagttacaatgtctcctttttcttttttattttattcctttatctattttgagacggagtctcgmtgtgtcacccaggctggtgtgcagctgcgcgattttggctcactgcaacctccacctcctgggttcaagtgattctcatgcctcagcctcccgggtagct

SEQ ID NO: 14677 - DNA, 201 bp, Homo sapiens
aatatggtctcttggctgggcgccatggctcacgcctgtacgcctgtaaccccaacactttgggaggctgaggcgagtggatcacctgaggtcagaagttygagaccagcctggccaaaatagtgaaaccccgtctctactaaaaatataaaaattagctaagcgtggtggcaggcgcctatagtcccagctactagggag

SEQ ID NO: 14678 - DNA, 201 bp, Homo sapiens
tgtcatcagatgtaaggaagacatgagacctgtcccaacgaagtcatggtcttcaagagcaggggcctgcctctcatgacagtgacatgggtggcatgatstgtgcccttggataggcagtgctggaggtatctcctcagtggtggaggtatctcctcagtggtgagaggcatacgtgcacataactcactttggtgaggc

SEQ ID NO: 14679 - DNA, 201 bp, Homo sapiens
attgtgacgtactaggtcccacctgagagaggaggcttggtgatacacacagcacgtatcagtagcagtactggaacctaacacaagtctcccctcttgtktctcttctctttttactgcttgccttattgcccaaaacctaaatttaaaaatgtactaatcaaaactttttctatatatagttcccaaacaggaaaccat

SEQ ID NO: 14680 - DNA, 201 bp, Homo sapiens
gaagacatgagacctgtcccaacgaagtcatggtcttcaagagcaggggcctgcctctcatgacagtgacatgggtggcatgatctgtgcccttggatagrcagtgctggaggtatctcctcagtggtggaggtatctcctcagtggtgagaggcatacgtgcacataactcactttggtgaggccataatagagctatca

SEQ ID NO: 14681 - DNA, 201 bp, Homo sapiens
cagagaacctggaatctagtttgaaaaccactcttgtgaaacgaagggcttgtagagcatcggggccagatgggcccttagaaatcattgtgacgtactakgtcccacctgagagaggaggcttggtgatacacacagcacgtatcagtagcagtactggaacctaacacaagtctcccctcttgtttctcttctcttttt

SEQ ID NO: 14682 - DNA, 201 bp, Homo sapiens
agtgttcttactcccagaggtgtttttctgggtggtgggttagtctgttttctgcagtcactcacagttttttcctcctcgtgacagcaaaacccagtgtstgcatctcccgttcccagtggcacgaacagtcctgcccctaagaagagcaccggcagcgttgattatctggccctggacttccagccgagctccccaagc

SEQ ID NO: 14683 - DNA, 201 bp, Homo sapiens
ccaatttcccaaagcacttacagagaacctggaatctagtttgaaaaccactcttgtgaaacgaagggcttgtagagcatcggggccagatgggcccttakaaatcattgtgacgtactaggtcccacctgagagaggaggcttggtgatacacacagcacgtatcagtagcagtactggaacctaacacaagtctcccct

SEQ ID NO: 14684 - DNA, 201 bp, Homo sapiens; identical to SEQ ID NO: 1931

SEQ ID NO: 14685 - DNA, 201 bp, Homo sapiens
taggaggtcggggctacagtgagccatgtttgcgccactgcactcccgtctgggcaacagagggagaccctgtcgcaaaaaaaaaaaaaaaaaaaaaaaaraaagaaaaagaaaaaagtaagtctctcaagataggggagaatagaccttaggtagtctcttgtccatctattgatctactcttttttttttttgagacag

SEQ ID NO: 14686 - DNA, 201 bp, Homo sapiens; identical to SEQ ID NO: 1933

SEQ ID NO: 14687 - DNA, 201 bp, Homo sapiens
ttttcattatcaaaaatcatgctataaaaaatgtttgatttggaggcaggggtgaaggcattaggggacacagtttccgaattgcaaaaaaaaacagtcartttacttgggcttaaaagtatagctataaaaccataacatagttcaacaaatccataccttgcttttgctctagaactgcactgttctgtatagtagcta

SEQ ID NO: 14688 - DNA, 201 bp, Homo sapiens
cttgctcagaacctcaccctccaatttcccaaagcacttacagagaacctggaatctagtttgaaaaccactcttgtgaaacgaagggcttgtagagcatyggggccagatgggcccttagaaatcattgtgacgtactaggtcccacctgagagaggaggcttggtgatacacacagcacgtatcagtagcagtactgga

SEQ ID NO: 14689 - DNA, 201 bp, Homo sapiens
gtgtttgtatgctgggcaggcttcccaggggtgattgtggaaaggaaggggagtgattctgtagggccctaaaaagaagccaggaagaagaaaaaaaaaaactgtttaaaagaaaatagattgactcaggcatttgtgggcattatctttagtctagacttggagatagaagctcaggccaggagtctagaaacctccatt

SEQ ID NO: 14690 - DNA, 201 bp, Homo sapiens
ataacgggaatcaccaagattagcgacacatacaccaccagcttaggcctccctaaggaggagagtattagagggtgacaaataattgagtgttttgtcartggccttattaaataatatatttcctagcctgtaatccaagctatttgggaggctaagacaggaagatcgcttgagcccaggagttcaagactgcagtga

SEQ ID NO: 14691 - DNA, 201 bp, Homo sapiens
ggcaggagaggctcctgccctgctcatgtctgcctagctacctactctaacaatgtgagaaatgggtccaagaagtacctcagctttttaagaaataggtrtgatgaggggaaaatgtaaccaaaaaccaaatggcttttaattgaattattttcttgtgggattagaggtgttctcatcaagaaaatatattcttgagat

SEQ ID NO: 14692 - DNA, 201 bp, Homo sapiens
cttggagagggctatctgcatgtgcagtggcctgccagcacttaggaggggctgcatgcacagtgtgtttactaaagctgtacacatgcccacttgaggcrttcttttaccagccaagtgttcctagaggaaggccaaataccagttaaactcgaccattttgcctcatagtgtgcgtgcttgagacttgcctatctcctg

SEQ ID NO: 14693 - DNA, 201 bp, Homo sapiens
tctgtcctatagaatgtcacatgtgctaatgagaagaattatactctgcagctgttggatgaagtgttgttaggtccatttgatctaaagcgcagtttaamtctaattgtttccctgttgattttctgtctaggtgatctgtccatgctgagagtgaggtgttgaagtctccaactatgattatattagagtctatctctc

SEQ ID NO: 14694 - DNA, 201 bp, Homo sapiens
ttcatggctagtgaatcattattagcaagaacactcagccaagacagaagggaatagatttcatagaatgagaaacttctagaatacgagatctcaaagcrtccttagagagcatttagttccaaactgctcaaatgacagagtgtctagaggtgaagagagggcaactaatttgttcaagatcatgcagctgactggcca

SEQ ID NO: 14695 - DNA, 201 bp, Homo sapiens
aaatcacttgaatctgggaggcggaggctgcagcgagctgagatcgtgccactgcactccagcctgggcaaaaagagtgagactgtgtctcaaaaaaaaaaagaaaaagaaatttttaaaaaattcctttcacaatggcatcaaaaaataaaatacttaggaatcaatttaacaaaagccatcctagatctctgtacataa

SEQ ID NO: 14696 - DNA, 201 bp, Homo sapiens
gtttaaatctaattgtttccctgttgattttctgtctaggtgatctgtccatgctgagagtgaggtgttgaagtctccaactatgattatattagagtctrtctctccctgtagatcttaatggtgttccataagtcttgcaggttttcttcactcttttcatttgtattccccctttccttctggctgggtaatttcaaa

SEQ ID NO: 14697 - DNA, 201 bp, Homo sapiens
cagcccaagctgtaccttggccccttttagtcacggatggagtgactgggacacagggcaccaagtccccaggctgcatacagcagagggaccctgggccyggcccacaaaaccattttttcctcctaggcctctgggcttgtaatgggaagcgctgctgtgaagacctctgacatggcctggagacattttccccattgt

SEQ ID NO: 14698 - DNA, 201 bp, Homo sapiens
tccctggaatgcagggaaccatattattttagctactggggtacctcattctggggagtcagtgcaccgtttcctaggatgcagccactggcttcagcttwggcactgtggaggcatgactgttctgagcagccaagatactgttttccttgaagagagcatactgcttcagctctggcccaagggagtggggagaggggc

SEQ ID NO: 14699 - DNA, 201 bp, Homo sapiens
tagcagtcgaatccaactaaatacgtatgtgtgtatatctatatgtgtctgtttgggacaatatatatattttagggaatatgcatgtgtgtatacattargggtaagacatcatgacaaagtagtgtttatcccaggagtgtaaggttggtttgacttcaaaaaaaaacaatcaaagtaattcattacattaagagaatg

SEQ ID NO: 14700 - DNA, 201 bp, Homo sapiens
gaactggcagagtcaagacaaatagagttctttttctctttgaagacaagttggtttcactggacttatttttgtcctccagcctttggggcctcattccmgattctagccagtgtctgtcttcttatttcaagaaggctgttaaacctgtaacagatgatacattgatgtgagtcacatgccctgaaaagccataattct

SEQ ID NO: 14701 - DNA, 201 bp, Homo sapiens
attcattatttataatgcaacaagcattaacctaggtgctaaggagagaaaaatgagtaagacacagtttctttcctcaaggaaatcacagtctgttggcrgagataagtagtaatggtgcctaatataggtaacacttgctacctgctccaagaacaaagttaagcaagtgattaagttaagcaatgcttagaggtagag

SEQ ID NO: 14702 - DNA, 201 bp, Homo sapiens
aacatttcttaaaaatgattcaacattgtcttcaaatttttctttcaggttactgacacgtattttgcaagtttcaactttggcactttcttggtcttactagaagatcttagcaaaaagtctcacaactactgaaattcatgtttctccttaaaatggcccttgatttatttgttcagggttgtatttgttcagtcacaa

SEQ ID NO: 14703 - DNA, 201 bp, Homo sapiens; identical to SEQ ID NO: 1945

SEQ ID NO: 14704 - DNA, 201 bp, Homo sapiens
ttgttttagcagagactggtggcattttgcccctgccctagagatttgtggaactttgaacttgagagagatgatttagggtatctggcggaagaaatttytaagcagcaaagcattcaagaggtgacttgggtatcgttaaaggcattcaattttataagggaaagcagagcataaatgttcggaaaatttgccacctga

SEQ ID NO: 14705 - DNA, 201 bp, Homo sapiens
caggtttgctgcaaaggagagcatctaggatagtactttggtacatagcaggcgttcagtaaagtcagctttgtgccccctgcatgtagaccaggcaaggkcctcgtctgctacaatctcactctcctggcattggatcagtggcaaggattcaaagggaggagtaggatagctaggcagagatagccccctgtgggtctg

SEQ ID NO: 14706 - DNA, 201 bp, Homo sapiens
ggccagtaagtgctgtgagaagtgaacaaagaatagaaaattaagcactgacagccgggcgcagtggctcacgcctgtaatcccagcactttgggaggccraggcgggcggatcacgaggtcaggagattgagaccatcttggctaacacggtgaaaccccgtctctactaaaaatacaaaaaattagccgggcgcagtgg

SEQ ID NO: 14707 - DNA, 201 bp, Homo sapiens
gtaaattctaccaagcattcaaagataacaccaatcttacccacagtctttcagaaaacataggaggaggggattctttcacagctcattttatgagaccrgcataaccctactatcaaaatctggcaaagatgacaggaaataaaattacagagaatatcccccatgaataataaacagaaatcctctttaaaaacaaag

SEQ ID NO: 14708 - DNA, 201 bp, Homo sapiens
cagctcacctgtaggtaaaggatgttgtctttggaaatggcttccatcaagtccttgtgcagggtgggctctgtccggactctagaagagcccaactcagmctcgggcccctccctgggccgctgccggtaaaacagcacataggctgtgtccttagggaagaaggaggtgacgttgctgacagattcgaaggaagagaag

SEQ ID NO: 14709 - DNA, 201 bp, Homo sapiens
gcaggtcgaaagagaagcgcagcagtgtgaggatgaggtagcacggcccttggctcagctccaccaccttctcggcatcctgcagggaggcacacgactcrcagtagtagcggttttctgctgtcagcttctcgggggacaggaagtagttaaccaggtccaggacggagcgggagccctcagagccacatgtccgctccc

SEQ ID NO: 14710 - DNA, 201 bp, Homo sapiens
gagaaggggcagggcgggcagcgccctcacgggcatagcagtagtagtgaccactctccgaagacactccagagtgcaccaccacactgcagaggtcatakgcctggccacggccaccagccagtggcaggcggagcagcagggggatggagacgtcatccaggatcttgcggcgccgcatggtgcgcaggtcgaaagaga

SEQ ID NO: 14711 - DNA, 201 bp, Homo sapiens; identical to SEQ ID NO: 1947

SEQ ID NO: 14712 - DNA, 201 bp, Homo sapiens
cagtagtagtgaccactctccgaagacactccagagtgcaccaccacactgcagaggtcataggcctggccacggccaccagccagtggcaggcggagcascagggggatggagacgtcatccaggatcttgcggcgccgcatggtgcgcaggtcgaaagagaagcgcagcagtgtgaggatgaggtagcacggcccttgg

SEQ ID NO: 14713 - DNA, 201 bp, Homo sapiens
ttgccacagcagttttttattctctctctctctctcacaacatttggaactttctgccttgtagaatggatttttatattaatacattactattatttgawgatggagctcacagtaggtgcataataatttgaacaaatccatgttgtagagggataagctagtagaagagatagaactttacgcagctgaggaagtcac

SEQ ID NO: 14714 - DNA, 201 bp, Homo sapiens; identical to SEQ ID NO: 1948

SEQ ID NO: 14715 - DNA, 201 bp, Homo sapiens
gggtgctgaggcaggagaatcgctttgaacccaggaggcggaggttgcagtgagccaagattgcatcactgcactccagcctgggagacagaatgagactycgacacacacacacacacacacacacacacacacacacaccacacacgcgcgcgcgcgcaccaagggagagactgtatggtggcaatagcctctatagcc

SEQ ID NO: 14716 - DNA, 201 bp, Homo sapiens; identical to SEQ ID NO: 1949

SEQ ID NO: 14717 - DNA, 201 bp, Homo sapiens
cttggctaatttctgtatttttagtagaggtggggtttcaccatgttggccaagcaaccaaagaaatttttaaaagaacaacaataaagtcaggatttatwttacttgatttcaagaattcctgtcaaactatggtaatcaagataatgttgtattggtgaaaggacaaaaacctgtagatcactagaagaattagcaagt

SEQ ID NO: 14718 - DNA, 201 bp, Homo sapiens
agagcaggaacaaaaggaagtaaagaacacttggaagagggccaagcgggcaacttgagagatttcagtgcactgtttgacctttgatctggagttttatrtattggcatgcttccagggggttgtgtcccttctctcctgattcttcccttggagagggctatctgcatgtgcagtggcctgccagcacttaggaggggc

SEQ ID NO: 14719 - DNA, 201 bp, Homo sapiens
gcagaagtgagagaattgcttgaactcaggaggcagaggttgcagagacaagatcgcaccactgcactccagcctgggtgacagagggagaccctgtctcmaaaaacaaacaaaaaacaaaaaaaaaagcagactgggcacggtgactcacgcctgtaagcccaacactttgggaggtcgaggcaggtggatcacctaaga

SEQ ID NO: 14720 - DNA, 201 bp, Homo sapiens
actgcagaggtcataggcctggccacggccaccagccagtggcaggcggagcagcagggggatggagacgtcatccaggatcttgcggcgccgcatggtgygcaggtcgaaagagaagcgcagcagtgtgaggatgaggtagcacggcccttggctcagctccaccaccttctcggcatcctgcagggaggcacacgactc

SEQ ID NO: 14721 - DNA, 201 bp, Homo sapiens
tgatgtattcctgagtcacctgttgagacttattctgtctttcggagtgatgtgcatgaacccattattggaggagatcgcggtattggacatctgtctcraagtctctatacactgagaactgcttgtcccaaccataggcctctataggtccaccagtctcttagcaatttctttatatatatctatatatgctggagt

SEQ ID NO: 14722 - DNA, 201 bp, Homo sapiens
gtttttagagcagtttctctgtgattcttctaaggcatcatgttttggttaaaagcaggttgtactaaaaagttagaaaacttgtttttctgctacttacygtgtgtaacattgttacttcaactcaccctgccttagtgggggtccccatggataaactgattatggctttgcaagttctcccttgcctaaaaatgctgt

SEQ ID NO: 14723 - DNA, 201 bp, Homo sapiens
aacgaattaaaaggccagggagctgggcacagtgtttcacgcctgtaatcccagcactttgggaggctgaggcaggcagatcacctgaggcctggagttcragaccatcctgaccaataatggtgaaaacccgtctctactaaaaatacaaaaattaggctgtggtgacgtgcacctgtattcccagctactcaggaggca

SEQ ID NO: 14724 - DNA, 201 bp, Homo sapiens
gaataagaaacgaattaaaaggccagggagctgggcacagtgtttcacgcctgtaatcccagcactttgggaggctgaggcaggcagatcacctgaggccyggagttcgagaccatcctgaccaataatggtgaaaacccgtctctactaaaaatacaaaaattaggctgtggtgacgtgcacctgtattcccagctactc

SEQ ID NO: 14725 - DNA, 201 bp, Homo sapiens
ttattgaggctggaaggctggagcacagtttgggattgggattgggggaggagatgcatgggagacaagggtaaggacgcgtcttattcctctttagatcmccgtattagtagccacagagtagctgcccagtaaatatccacatgatttttttttttttttttttttttttttgagatggagtctcgctctgtcacccag

SEQ ID NO: 14726 - DNA, 201 bp, Homo sapiens
ctacagctattagggagtctttgtcatcccaattttcaaatgaggccttagaaatgttctcattcctgtaatcccagcactttgggaggccgaggcaggcrgatcacgcggtcaagagattgagaccatcctggccaacgtggtgaaacccctgtctctactaaaaatacaaaaattagctgggcatggtggcacgcacct

SEQ ID NO: 14727 - DNA, 201 bp, Homo sapiens
cctagagagctggagacagtttattgaggctggaaggctggagcacagtttgggattgggattgggggaggagatgcatgggagacaagggtaaggacgcrtcttattcctctttagatcaccgtattagtagccacagagtagctgcccagtaaatatccacatgatttttttttttttttttttttttttttgagatgg

SEQ ID NO: 14728 - DNA, 201 bp, Homo sapiens
tcatccaaaaaaaaaaaatggaggtaataatatgtacctcacagggtagactagaggcacataataggtgcttagtaaatggcagctgtgcttaccacagycactgttgtccttttggttctcattaattccccgtataccatctgtacggcatataattgtgaccaaaacagtgacagttaccttccaagcatccgtcat

SEQ ID NO: 14729 - DNA, 201 bp, Homo sapiens
gctctttcctggtgagtgtgggttaacccaagggtcctcaggccggcctggttaggtaaaaggtcacaccttatggaattaaaagcacaaccccaaaagaktgatggcgtctccatcttaggaccctgcccaagttcttgtctcagttcagaaccctgcgttgagtctttggacaagtaagatataagtattctagtctgg

SEQ ID NO: 14730 - DNA, 201 bp, Homo sapiens
tcctccttcctctgtcagcttcttcctgtgagacctacgagtacccacagcgtggtggagagagtgcaggccggtctgctgaatccatgagtgatggagtyggctctttcctggtgagtgtgggttaacccaagggtcctcaggccggcctggttaggtaaaaggtcacaccttatggaattaaaagcacaaccccaaaag

SEQ ID NO: 14731 - DNA, 201 bp, Homo sapiens
agcttacatctcattgggaaaataaaaccaacacatataaatcaggacaagtattgttactgtggtgttcagagaagtgatggctggggtgagcaggacasgtgagtggtgtaggagtcaaaggagaggtgcatagatgagggtagagtagtcaaggacagcttctctgcagatgctaacactggagctacatctagaagc

SEQ ID NO: 14732 - DNA, 201 bp, Homo sapiens; identical to SEQ ID NO: 2006

SEQ ID NO: 14733 - DNA, 201 bp, Homo sapiens; identical to SEQ ID NO: 2007

SEQ ID NO: 14734 - DNA, 201 bp, Homo sapiens; identical to SEQ ID NO: 2008

SEQ ID NO: 14735 - DNA, 201 bp, Homo sapiens; identical to SEQ ID NO: 2009

SEQ ID NO: 14736 - DNA, 201 bp, Homo sapiens; identical to SEQ ID NO: 2010

SEQ ID NO: 14737 - DNA, 201 bp, Homo sapiens
ggcttatgccattctcccacctcagcctccctagcagctgggactacaggtaggtgccaccacgtctagctaatttccgttttgttttttttttttggtgrgggggttgggggcaggtagagatggggtctcactatattgctcaggctagtctcaaactcctggcctcaaatgatcctcccaccccagcctcccaaagtg

SEQ ID NO: 14738 - DNA, 201 bp, Homo sapiens; identical to SEQ ID NO: 2011

SEQ ID NO: 14739 - DNA, 201 bp, Homo sapiens
gcagggctgccccagccatctttactgccccagccctcaacaatattgaggccctgagcccccagcacatggtgcatacagcccctgccccatcccgcccygccccacccagctggccctaacttattttggggtcacagctgagcactgtccctggaggtgaccaaggtacagcccgcaatgggcctgtaaatagcccag

SEQ ID NO: 14740 - DNA, 201 bp, Homo sapiens
tcccaatgtgctgggataacaggcatgagccactgcacccggccaaagggagctttaaaaagcatccagagcaacttccgcaggcagctgcataagctgcrgtaccgccggacgtcagagccaccttggcgttcaccctgggctctgcctatacacttggctggccaccccgagtcaccaaggacaagggtccttccctca

SEQ ID NO: 14741 - DNA, 201 bp, Homo sapiens; identical to SEQ ID NO: 2014

SEQ ID NO: 14742 - DNA, 201 bp, Homo sapiens; identical to SEQ ID NO: 2015

SEQ ID NO: 14743 - DNA, 201 bp, Homo sapiens; identical to SEQ ID NO: 2016

SEQ ID NO: 14744 - DNA, 201 bp, Homo sapiens; identical to SEQ ID NO: 2017

SEQ ID NO: 14745 - DNA, 201 bp, Homo sapiens; identical to SEQ ID NO: 2018

SEQ ID NO: 14746 - DNA, 201 bp, Homo sapiens; identical to SEQ ID NO: 2019

SEQ ID NO: 14747 - DNA, 201 bp, Homo sapiens; identical to SEQ ID NO: 2020

SEQ ID NO: 14748 - DNA, 201 bp, Homo sapiens; identical to SEQ ID NO: 2021

SEQ ID NO: 14749 - DNA, 201 bp, Homo sapiens; identical to SEQ ID NO: 2022

SEQ ID NO: 14750 - DNA, 201 bp, Homo sapiens; identical to SEQ ID NO: 2023

SEQ ID NO: 14751 - DNA, 201 bp, Homo sapiens
ccattctcccacctcagcctccctagcagctgggactacaggtaggtgccaccacgtctagctaatttccgttttgttttttttttttggtgggggggttgggggcaggtagagatggggtctcactatattgctcaggctagtctcaaactcctggcctcaaatgatcctcccaccccagcctcccaaagtgctgggatt

SEQ ID NO: 14752 - DNA, 201 bp, Homo sapiens; identical to SEQ ID NO: 2024

SEQ ID NO: 14753 - DNA, 201 bp, Homo sapiens
cgaaagtcgtaaaaacaggaaaaaatgaggggacatttggtgaggtaccaagatgtgagactgtttatattgtggctcgtttaatttttagaacctcaaaygtgtcggtttctccagtgtcacctttgtttttcctttgtaaacagacaagtggacagaaaagtaggtagatagaacggctgccagtccccgccacccaca

SEQ ID NO: 14754 - DNA, 201 bp, Homo sapiens
tcgtaaaaacaggaaaaaatgaggggacatttggtgaggtaccaagatgtgagactgtttatattgtggctcgtttaatttttagaacctcaaacgtgtcsgtttctccagtgtcacctttgtttttcctttgtaaacagacaagtggacagaaaagtaggtagatagaacggctgccagtccccgccacccacagcccag

SEQ ID NO: 14755 - DNA, 201 bp, Homo sapiens
gcaggagaatctcttgaacccaggaggcggagcttgcagtgacccgagatcatgccattgcactccatcctgggtgacagagtgagactccatctcaaatwaaaaaaaaaaaaaagcaagcagaagggaaaaccatcctttcttcaggtaactcaaattttagaccaaggagtcacatttgtatggaactgaaatgtggct

SEQ ID NO: 14756 - DNA, 201 bp, Homo sapiens
tgggatgtcctgtggtctttcctggacagtaagctctttggtaccatgtcccctcctgtcccctcttgtgtcacccagttgggcctcagcaggcccttggkccccctatggcagtgggtggggggaccgtctgctcccacctgggacctgtgctcagtcccccgcccctccacagcactgcttcatgatgccccagtccct

SEQ ID NO: 14757 - DNA, 201 bp, Homo sapiens
gggatgtcctgtggtctttcctggacagtaagctctttggtaccatgtcccctcctgtcccctcttgtgtcacccagttgggcctcagcaggcccttgggycccctatggcagtgggtggggggaccgtctgctcccacctgggacctgtgctcagtcccccgcccctccacagcactgcttcatgatgccccagtccctg

SEQ ID NO: 14758 - DNA, 201 bp, Homo sapiens
gttccagagcttgctgggcctgctcctggctggcggcctcctgggccgccctgggtgtggcttcaccttgcagagcagcttgcttcaacctgcgggactcyggcttggccatcgggtttccactcgaggacggtgaccaacctgcagctcctctgccggtggcggcactcgagtgtcccctcacaccccctgtggccttgc

SEQ ID NO: 14759 - DNA, 201 bp, Homo sapiens
acctaggccgaggtgagtcacagccctggggagggcgcatggccacggtgttctcaggaagcaaaggggactgtggggtcagggctctttagagcagaccrcaggtaaaacagtaagtagaacttgggggtttcttgagtaatgagccacttgtttttcttgatttaaaaaactgactttaaagaatgctaataaatccgc

SEQ ID NO: 14760 - DNA, 201 bp, Homo sapiens; identical to SEQ ID NO: 2046

SEQ ID NO: 14761 - DNA, 201 bp, Homo sapiens
gctgagcctgcagattgggtttcttgtgcctgtgggatgtcctgtggtctttcctggacagtaagctctttggtaccatgtcccctcctgtcccctcttgygtcacccagttgggcctcagcaggcccttgggccccctatggcagtgggtggggggaccgtctgctcccacctgggacctgtgctcagtcccccgcccct

SEQ ID NO: 14762 - DNA, 201 bp, Homo sapiens
ttttgagacggagtctcactctgtcgcccaggctggagtgcagtggcgcgatctcggctcactgcaagctccgcctcccaggttcacgccattctcctgcytcagcctctggattagctgggactacaggcacccgccaccacgcctggctaattttctgtatttttaatagagacgggttttcactgtgttagccaggat

SEQ ID NO: 14763 - DNA, 201 bp, Homo sapiens
ccagcgtccagacaaagggacagtggattctggtgtccagacaaggggaaggtagtggcgcccaagcaggggtgcttacaaccctgaagcccaagaggggktgttgcagagtgtcagcagccctgttactcccattgccctgctccaggctatagctctggggctggctccgtccccgctgcttccctttgctgcctcctg

SEQ ID NO: 14764 - DNA, 201 bp, Homo sapiens
gccgcagcaagcactggggtgaggctgcacctaacggccatgtctcactaacagctgtctctgcttggaggtgccctgcccatgtttgagctggtggagcwgcagccttcacatctggcctgccccgacgtcctgaacctgtccctaggtgagagctgccaagtccaggtggggtccctcggaggtacgatctgtgccctt

SEQ ID NO: 14765 - DNA, 201 bp, Homo sapiens
aaaaatacaaaaattaggcatgacggtgcatgcctgtagtcccagctactcaggaggctgaggtgggaggatcccttgaggccggaagggggaggttgcartgagctgagatcacaccactgcactccaccttgggtgacagagccagacccttgggtgacagagccagaaggaacgtttgggaatggaatcatcgtgttg

SEQ ID NO: 14766 - DNA, 201 bp, Homo sapiens; identical to SEQ ID NO: 2102

SEQ ID NO: 14767 - DNA, 201 bp, Homo sapiens
caggatggccaggaagggtctcactctgaaggtttaagttttgacgaagacttaaagcagtgtaggaggaagggcaggtagcaagagcctggtgtggctcrggtgcagcgggtggcggtgggagaagcaggagctgaggatagaaaggtgacttaggctcagtgtagtggggccttgccagctcatagtgaggactcggtg

SEQ ID NO: 14768 - DNA, 201 bp, Homo sapiens
atgcctgtagtcccagctactcaggaggctgaggtgggaggatcccttgaggccggaagggggaggttgcaatgagctgagatcacaccactgcactccascttgggtgacagagccagacccttgggtgacagagccagaaggaacgtttgggaatggaatcatcgtgttggtcgatctgcagatgttagtgattgtgag

SEQ ID NO: 14769 - DNA, 201 bp, Homo sapiens
ggttctcaccccacttggaaaactggtggctgtgccccatttcatgggtgaggagactgaggctggaagaagtccaggcctgtgtctgtcctgtagctatygaccaggctctcagactccagaaacaaacctcagtaggaatcagaagtgttggccgggcgcggtctgcctgtagctatcgagcaggctgtcagactccag

SEQ ID NO: 14770 - DNA, 201 bp, Homo sapiens
tcagtagaaatcagaagtgtcggccggttgcggtggctcatgcctgtaatcccagcactttcggaagctgatgtgggcggatcatctgagatgaggagttygagaccagcctgaccaacatgggagaaacccatctctactaaaaatacaaaattagccaggcgtggtggcacacacctgtaatcccagctactcgggagg

SEQ ID NO: 14771 - DNA, 201 bp, Homo sapiens; identical to SEQ ID NO: 2044

SEQ ID NO: 14772 - DNA, 201 bp, Homo sapiens
gcctgcctcaaagttggcaaaacccacagcgtctcagagctgcgttcatgttctagttcctgcctctgtgccagtgagaccagaaaaccaggccactcaamagcctcttgcgtgtgctctctatgaatggaggctggggcaagggcaggacccctgggcctcaggcgagaagaagcagatttaccctcagctttcttcctg

SEQ ID NO: 14773 - DNA, 201 bp, Homo sapiens
caccccaggtgaccacttgaggccactggtggaaaagcagcatgccctggggttcattttcagcctggtcgcgggcggcctcctgtgtgcccctttccctsatggtctggtgccctcggctccctccccacctcctgcccactgcttctcagtgtgatgtgggtgcagtgggtctgaaatgcggcctcctctgtccctttc

SEQ ID NO: 14774 - DNA, 201 bp, Homo sapiens; identical to SEQ ID NO: 2045

SEQ ID NO: 14775 - DNA, 201 bp, Homo sapiens; identical to SEQ ID NO: 2047

SEQ ID NO: 14776 - DNA, 201 bp, Homo sapiens
cgtgtgtctggatgtgagcgtgtgtgggcgcgtgctgagtgtgcatggatgagtgtgagccatggtgagtgtgtccccctcacacctacatttaaacacaygggcggcccctccacccacccctgcaccaccttcgtcacacccacatttaaacacgggcggcccctccacccacccactcctgcaccaccttttgttttc

SEQ ID NO: 14777 - DNA, 201 bp, Homo sapiens
tcagcagcactggatgtcatcaagcgtttgaatttctgcctttctgataattggaaaatgcgttgttttgtttaactttgcattttctggatgacttacgrgggtcagtgtcttcatatgtttgtcagacattccttttgctccgtgactgacttgttcatgtgttttgcccattttgaggaggttgtcgggacatttcac

SEQ ID NO: 14778 - DNA, 201 bp, Homo sapiens; identical to SEQ ID NO: 2026

SEQ ID NO: 14779 - DNA, 201 bp, Homo sapiens
cattttctggatgacttacgggggtcagtgtcttcatatgtttgtcagacattccttttgctccgtgactgacttgttcatgtgttttgcccattttgagraggttgtcgggacatttcactctccagtaaatgtggcccttggcgttactgagtcctaagaggtgtgtgttgccccaggtggagctgatggaggagggag

SEQ ID NO: 14780 - DNA, 201 bp, Homo sapiens
gaagggatggaagctctttaacttttatgaagttattggtaggttggaggagagaaacgtgacgtgttcatcacagtatacgtatcttttttgtttttgtyttcaatttagtaaccagtagattctccaagctgcttttccgtgacgagaaagagaaacagtgaatttgtatcatcgggtcttagtttcttggggtcctaa

SEQ ID NO: 14781 - DNA, 201 bp, Homo sapiens
caccccctgtggccttgctggcatcttttctccgggtgcggccatggcctccagcccccctcttcttctcggtcaggtggaagatggatggcacggccgtrggcttcagcaggcgatgctggtcctccagcctcttggagaagctgtctttggtgaaatgctcactacagagaaatgaatacttagtgggagtccagttat

SEQ ID NO: 14782 - DNA, 201 bp, Homo sapiens; identical to SEQ ID NO: 2035

SEQ ID NO: 14783 - DNA, 201 bp, Homo sapiens
aggtcagggaggtctttgtaccgttctgatgcctcagtccatggctcctcattgtgtcttcctcttcagctggagctgcgagggtgtccaggaggggtgarttctgctcggagggcctgccgagggcattccttcctgtcctccagcatgagagggacagtgtggggcccctagagtacagggaagacctcctcataactg

SEQ ID NO: 14784 - DNA, 201 bp, Homo sapiens; identical to SEQ ID NO: 2037

SEQ ID NO: 14785 - DNA, 201 bp, Homo sapiens
actgggcccacctggatagtccaggaaagtctcatctgaaggttcctcacccaggcccatcccacagcccctggcaatgcttacccaagagtgaaatcctyttgttttgcctgggtttgtctcttggccacagaagggtgctgagacccacagctgctgcccccacagatgggggaccctgcctgccttctactccagcac

SEQ ID NO: 14786 - DNA, 201 bp, Homo sapiens
cgttatgttggattcagtgttagtaaagagactcatgtttggttgggtctctgttgaccttgtactctgtgctgcacctctgcttacagaatacctcccawccatgccggttcgtgactgctcacccgtttcagtgatctgagagggctggccctgaaagagtggttactgctcccgtgcagtttagagcttttcctgcac

SEQ ID NO: 14787 - DNA, 201 bp, Homo sapiens
gggtctctgttgaccttgtactctgtgctgcacctctgcttacagaatacctcccatccatgccggttcgtgactgctcacccgtttcagtgatctgagarggctggccctgaaagagtggttactgctcccgtgcagtttagagcttttcctgcaccttgacttgtccgtttcacagtgaggacaccaagtcacaagaag

SEQ ID NO: 14788 - DNA, 201 bp, Homo sapiens
gctgagtttgcccaactgtaggctaatgtaagtgttctgagcacatttaaggcaggctaggctaagctatgatgttaggtagattacgtgtattcaatgctttttttttttttttttgagacagagtttcactctcccacctgggctggaatgcagtggcgcgatctcaggtcactgcagcctccgcctcctgggtttaag

SEQ ID NO: 14789 - DNA, 201 bp, Homo sapiens
gccgaggcgggaggatcatgaggtcaggagattgagaccatcctggctaacacagtgaaaccccgtctctactaaaaaaaatacaaaaaattagccaggcrtggtggcgggcgcttgtagtcccagctactcaggaggctgaggcaggagaatggcatgagccgggaggcagagcttgcagtgagccgagatcgcgctact

SEQ ID NO: 14790 - DNA, 201 bp, Homo sapiens
tttggtgaaatgctcactacagagaaatgaatacttagtgggagtccagttatccctctgaacagcttttaaccattggattagacgttttgagtcctttrgggggaacctacaggacaaatgacaaaaagtaattagaaataattaaatgtctccccttaaaataatcaactgtaaaagcaaaacaagtatttttgcacg

SEQ ID NO: 14791 - DNA, 201 bp, Homo sapiens
ctgtggctcagttttaacaaatgggctcattgagtgagttccaaattcatgtttcaccttccatgatgtagccaagctgagaactcttaaaaatgcctcaycgcctttttcactcagggccacctttttcccaaggaacttctcaaaactccctcaattccaattttattgaagttctacatgtaggctattgccttgaat

SEQ ID NO: 14792 - DNA, 201 bp, Homo sapiens
ggggtgagttctgctcggagggcctgccgagggcattccttcctgtcctccagcatgagagggacagtgtggggcccctagagtacagggaagacctcctyataactgaagagatgcgagtctgagagtctttattggctcttttgtaggaatcgctgcaggtctctttggtccttggagccagcccgtgaggccgggggc

SEQ ID NO: 14793 - DNA, 201 bp, Homo sapiens
aagactgaagatgacttcaatgattggtgccagcaagtcaaaaaggtttgtagccgccccacacccacagccgagctgagccacccagggagacaggcagyggggcgtgcaggggtcgaaggcctgcgtccaggtctcaggcagcctcactgggccgtggggagctttgtcccgcctggcacagctatgtagctgagcagg

SEQ ID NO: 14794 - DNA, 201 bp, Homo sapiens
tgggccggatgctgtggctcacgcctgtaatcccagcactttgggaggccgaggtgggtggatcacttgaggtcaggagatcgagaccagcctggctaacrcagtgaaaccctgtctctactaaaaatacaaaaattagccgggcatggtggcagatgtctgtaatcccagctactcgggaggatgaggcaggagaatttc

SEQ ID NO: 14795 - DNA, 201 bp, Homo sapiens
tgagaccggagaattgattgagcctgggagtttgaggctgcagtaagctgtgattacaccactgtactccagcctgggtgacaaaatgagtcccggtctcaaaaaaaaaaaagaaaaaaaaacaggagcagagctcttggacaaagccctgctgtggaaagcttgcttcatctggctgcagccgctccacaacgcccgtca

SEQ ID NO: 14796 - DNA, 201 bp, Homo sapiens
gtcccaggctgctcccactgcagcttggttccacatctttcttcagcctcttgcggtcaatgggctctcgggggacagatggcctttctcgggtgtgcttrgaggagaaactgtacgaatgaagtgagccgataaatttgcacgccccagatcctgggggcgtaaagtcatccatagaaatgccactcttatctgtcacgc

SEQ ID NO: 14797 - DNA, 201 bp, Homo sapiens
gtggcttcaccttgcagagcagcttgcttcaacctgcgggactctggcttggccatcgggtttccactcgaggacggtgaccaacctgcagctcctctgcyggtggcggcactcgagtgtcccctcacaccccctgtggccttgctggcatcttttctccgggtgcggccatggcctccagcccccctcttcttctcggtc

SEQ ID NO: 14798 - DNA, 201 bp, Homo sapiens
agaggggcctgggtctcccacagctgagaatcctttaaacagtgcctgtagggccctctattgtggatttggtagttctgcctgcaccgagggagatgctwgcaggtgcttctgaaccctgtgtttgggaattagctgcgcatacaattaaggcttttgggtatagtaaaatttgtgtgcctttgaccctgtggttctgag

SEQ ID NO: 14799 - DNA, 201 bp, Homo sapiens
acccacctcggcctcccaaagtgctgggattacaggcgtgagccactgcgcgcagcctggcgcacacttcttaccagaacctagtcacgaattcctcgtckaactagaattaggtatgtttgttactgtaaacgcagcttggtggcttacagtgattggcactctaacagtcaggtcaggctagagagccagccaccgcag

SEQ ID NO: 14800 - DNA, 201 bp, Homo sapiens
ctgagagtagcaccccatgcttctccagcacctgctcctaaccaggaaattggggtagaccagaaccccagtcttcccagcagctcagtgtttcttgcccyggagcatctgccttcatcacagtgactctgaacacgctgccatggtgacatctggtaaaccttaggatggccatggaaaacgactctttgccctgtttct

SEQ ID NO: 14801 - DNA, 201 bp, Homo sapiens
ggcgcacacttcttaccagaacctagtcacgaattcctcgtcgaactagaattaggtatgtttgttactgtaaacgcagcttggtggcttacagtgattgrcactctaacagtcaggtcaggctagagagccagccaccgcagacagaggagtggacgcgtgaacgttgagttgagaccaaaggggccacctggtgggata

SEQ ID NO: 14802 - DNA, 201 bp, Homo sapiens
catggccaaacgctccccgcttggcagcatccgccagctgtaactggaggaacaggaccaggtcgggtttgggaaggcccacgtctggctgtttacaccartctagggaaaaattctgccaagaaagaacccaacagttaaagcttagtgtagtctaggtttttgtttcgaaagtcgtaaaaacaggaaaaaatgagggga

SEQ ID NO: 14803 - DNA, 201 bp, Homo sapiens
tttaactttatttttgtcctttactttttaagtctaaagtaagtgcttgaatcgggtgggttttcatttttttgctttctcacccctcaggttggcccctracttggcctctcaccctcgtgtcagctgttagacactgactcagtggctcagaatatgaaaggctcaggaagtagcatgctggccccacctccctgtccc

SEQ ID NO: 14804 - DNA, 201 bp, Homo sapiens
gactcagtggctcagaatatgaaaggctcaggaagtagcatgctggccccacctccctgtccccataccttagcagagcagctgcccagcagggcctcctyctctttcctaagagtttactccatccatggtgggtgtcttggtaggcccgagatacgagagggagtgctgctgttacaagaatttacagttgttctcttc

SEQ ID NO: 14805 - DNA, 201 bp, Homo sapiens
ctctttcctaagagtttactccatccatggtgggtgtcttggtaggcccgagatacgagagggagtgctgctgttacaagaatttacagttgttctcttcrgcacagaaatgctgtaaatggcctctttcgatactagtttatgaaattataagtgtctgatgattgtgcatctttggtttcaacagctactctgacctac

SEQ ID NO: 14806 - DNA, 201 bp, Homo sapiens; identical to SEQ ID NO: 2031

SEQ ID NO: 14807 - DNA, 201 bp, Homo sapiens
ggtgtatttgaacttaatggaacacctcttattcccttcactctgaagttggcttccttgcctataaagtttggtgataaacctaagaaatacacctgctrtgcattttactgcgtccgtgatgaaaatccctcaacttcacagccgctcaggcctcgtgaccctgctttcagagggagcctttttccttttcttccttat

SEQ ID NO: 14808 - DNA, 201 bp, Homo sapiens
ggggagggccggagtgcgtttctctggacggaggagcagagcagcttggggcacggtgtgggagccctccttagggacctcatgggtcacgttcgccgtgrctgcgccactcctgttcactgccaagcaccgtgattgctccttggatttgctcccctggggtttcctggtctccttgatggtttatacagtgagcaatct

SEQ ID NO: 14809 - DNA, 201 bp, Homo sapiens; identical to SEQ ID NO: 2036

SEQ ID NO: 14810 - DNA, 201 bp, Homo sapiens
agtaaaacagagtaagatggcatgcagggctaatcattagcccagcaggtaagcaccatggctctgcagccagctgcctccttagaaagtggggtgttgcsccatggaagtggtggcatgctcttctggtagcattgttgaaatgaaaacaggttcagtccttgatcactaggctttttgtacccgggtacctctggggac

SEQ ID NO: 14811 - DNA, 201 bp, Homo sapiens; identical to SEQ ID NO: 2038

SEQ ID NO: 14812 - DNA, 201 bp, Homo sapiens
agtaaatgtggcccttggcgttactgagtcctaagaggtgtgtgttgccccaggtggagctgatggaggagggagtcggtgcctgtggtgtgggactgacyggctgcctcctgccagtgggcttgtggcctgtggggccatctggccatgagcacttctctctctgtctgccacgacaggggggacaggccccacctcgga

SEQ ID NO: 14813 - DNA, 201 bp, Homo sapiens
cgaggcgggtgggtcacgaggtcaggagatcaagaccatcctggccagcatggtgaaaccccatctctactaaaaacacaaaaattagctaggcttggtgrcatgtgcctgtagtcccagctactcgggaggctgaagcaggagaatcgcttgaacccgggaggtggaggttgcagtgagccgagatcacgccattgcact

SEQ ID NO: 14814 - DNA, 201 bp, Homo sapiens
tgtggctcagttttaacaaatgggctcattgagtgagttccaaattcatgtttcaccttccatgatgtagccaagctgagaactcttaaaaatgcctcacygcctttttcactcagggccacctttttcccaaggaacttctcaaaactccctcaattccaattttattgaagttctacatgtaggctattgccttgaatc

SEQ ID NO: 14815 - DNA, 201 bp, Homo sapiens
aggtaacaaagcaccagtcagcaggaaactcaccaccgggaagcctttctatcaaaacataacttcaaaatcagtaaagtgggccgggcatggtggctcaygcctataatcccaacttcaaaatcaataaagcgggccgggcgcggtggctcacgcctataatcccaacttcaaaaccaataaagtgggccgggcgcggtg

SEQ ID NO: 14816 - DNA, 201 bp, Homo sapiens
tggccaggactcctctcttttttctttttttttgagacagtctagctcagtagcctgggctggagtgcagtggtgcaatcttgggctcactgcttcctccrcctcctgggtcccggttcaagcagttctcctgcctcagcctccccagtacctggaattacaggcacccgccaccatgcccagctaattttttcaattttt

SEQ ID NO: 14817 - DNA, 201 bp, Homo sapiens
ggtcttgaactcctgacctcgtgatccacctgccttcgcctcccagagtgctgggattacaggcgtgagccaccgcgcctggccaggactcctctctttcttttttttttttttattttttttccgagacagagtctagctctgtagtccaggctggagtgcagtggtgcaatcttgggctcactgctacctccgcctccc

SEQ ID NO: 14818 - DNA, 201 bp, Homo sapiens
ctgatgtggagaattgctagaacccaggagatggaggctgcagtgagctgagatcgcaccactgcgctccagcctctgcaacagagttagaccctatctgaaaaaaaaaaaaaaaaaaaaagaagaagaagaatgctaataaatgttttaaattactgaaactgttttctgtacagatttgttttgataacttggcgtata

SEQ ID NO: 14819 - DNA, 201 bp, Homo sapiens
gtttcattctagaggaggagtcacatgatagactgtgttcaacaggcttgctctggcatctcttttgagaatgtactgcagaggggcaagggcagaggcarcgagaccagctaagagactgttgaacaagccagcaaggagatgccagtggattagctcagggtgggtaagaggttgacttctgcatgtgttttggaggtt

SEQ ID NO: 14820 - DNA, 201 bp, Homo sapiens
tgatgtggagaattgctagaacccaggagatggaggctgcagtgagctgagatcgcaccactgcgctccagcctctgcaacagagttagaccctatctgaaaaaaaaaaaaaaaaaaaaagaagaagaagaatgctaataaatgttttaaattactgaaactgttttctgtacagatttgttttgataacttggcgtatat

SEQ ID NO: 14821 - DNA, 201 bp, Homo sapiens
agcacttaaatagccacactgcccattccttgaggacagagctggtgtcttgtgcttgcatttctagtgcatcacttgtgtctggcatgtggttggtaataaaaaaaaaacagaacttgaattaataataacctacacattcccctactatcaaagctttcagtttgtagagtttaacataaatccagtatgttagcataa

SEQ ID NO: 14822 - DNA, 201 bp, Homo sapiens
ggctggcgtcgctgtgctcgctctgcacggcttccgtggctggctttggggtgacgtcggcaggaggggcagaggggctctgggaaggcttctgcggtgtygcggtaagtgatgagctgggagggctctgggccaggcccttgtcgggtcccaggctgctcccactgcagcttggttccacatctttcttcagcctcttgc

SEQ ID NO: 14823 - DNA, 201 bp, Homo sapiens
acccaggagatggaggctgcagtgagctgagatcgcaccactgcgctccagcctctgcaacagagttagaccctatctgaaaaaaaaaaaaaaaaaaaaagaagaagaagaatgctaataaatgttttaaattactgaaactgttttctgtacagatttgttttgataacttggcgtatatgtatttgaaatcctggagaa

SEQ ID NO: 14824 - DNA, 201 bp, Homo sapiens
acatgtaggctattgccttgaatccaattttccataagaaagagctcatttaggccgggcgcggtggctcatgcctgtaatcccagcaccttgggaggccraggtgggtggatcatgaggtcaggagttcaagaccagcctggccaacatggtgaaaccccgtctctactaaaaatacagaaactagctgggcatggtggc

SEQ ID NO: 14825 - DNA, 201 bp, Homo sapiens
gagaagctgtctttggtgaaatgctcactacagagaaatgaatacttagtgggagtccagttatccctctgaacagcttttaaccattggattagacgttktgagtcctttagggggaacctacaggacaaatgacaaaaagtaattagaaataattaaatgtctccccttaaaataatcaactgtaaaagcaaaacaagt

SEQ ID NO: 14826 - DNA, 201 bp, Homo sapiens
cactgaaggagtaggagaaaattcccctgagttggtgagagttgagtctttagagctaaagacccccaaatttttttatcagaagtacttaaacatacatrttcctgataatatttccaaattgcagaagtaaagggaaacttctctaaacatccaaataatagtatcactactaagctgctttgaagaaaggcagtctca

SEQ ID NO: 14827 - DNA, 201 bp, Homo sapiens
tgtaatcccagcactttgggatgccgaggcgggtgggtcacgaggtcaggagatcaagaccatcctggccagcatggtgaaaccccatctctactaaaaayacaaaaattagctaggcttggtgacatgtgcctgtagtcccagctactcgggaggctgaagcaggagaatcgcttgaacccgggaggtggaggttgcagt

SEQ ID NO: 14828 - DNA, 201 bp, Homo sapiens
agtgggtcctgccctgtgactgtgggtgtgccaggtcaccacacaggtgtgtgctgggtcacagacacgccccttccctgcctctccattctgtttcttcrtcgtctggccatcctcgggggcattgtgacacagcggagggagtgaggcaggactttataagggagagtgaggctggcttctgcagcattgagagctttg

SEQ ID NO: 14829 - DNA, 201 bp, Homo sapiens
cctgggaatttctatgaaactaatgcggaataaaatgaaaaaaggacaaaaccctgctgcctggaaatgtgaaacctcaaaaaagtcaagtgtagagaccstaactatgtatctgaacctgatgtgtacagaactcagaagaaaacctgtgtatcttcagtactagtatatgggttctttacaaagtgaaaattaatgaaa

SEQ ID NO: 14830 - DNA, 201 bp, Homo sapiens
ctgaagcaggagaatcgcttgaacccgggaggtggaggttgcagtgagccgagatcacgccattgcactccatcctgggtgagagagcgagactctgtttaaaaaaaaaaaaaaaaaaaaagattctgaaaaaggtttggatgccatctgtatctttagtgtgaaagtgaaaacttgtttctcatatttatggtagagctg

SEQ ID NO: 14831 - DNA, 201 bp, Homo sapiens
atatatgtataaatatatatatacgtgtgtgtgtgtgtgtgtgtatgtatatatttttccccccccccgtcgtccaggctggagtgcagtggcgtgatctyggctcactgcaacggggttttgccatgttggccaggctggtcttgaacccttgacctcaggtgatccacccaccttggcctcctaaagtgctgggattac

SEQ ID NO: 14832 - DNA, 201 bp, Homo sapiens
agagtgttcctgagagccacacagcctcatcaccacaaaagaggtgacgccacgactcaccagggtccgtcttggccccttgctgtccagggaacaacccrtgccgctgatttgtgttcctggttgagggtccggtgctgtgtgtatatagttgtgatgtctttctagtctttaattgagaaggttctgcctctttgttgt

SEQ ID NO: 14833 - DNA, 201 bp, Homo sapiens
agctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcgcgatctcggctcactgcaagctccgcctcccaggtt

SEQ ID NO: 14834 - DNA, 201 bp, Homo sapiens
gctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcgcgatctcggctcactgcaagctccgcctcccaggttc

SEQ ID NO: 14835 - DNA, 201 bp, Homo sapiens
ggccgggcgcggtggctcacgcctataatcccagcacttcgggaggccaaggtgggtagatcacatgaggtcaggagttaaagaccagcctggtcaacatygtaaaaccccatgtctactaaaaaaaaagttagctgggcatggtggcacgccctcgtaatcccagctgctcgggaagctgaggcacgagaattgcttgaa

SEQ ID NO: 14836 - DNA, 201 bp, Homo sapiens
tggcaagattatgaaaaaattttcttacgcttttctatattttccaagtttgaatttcactgtaagcacctggctttgtaccgccctttttctgttacacrgtcatcatttgcttgcttgttgtgggagcacttttgcacaggtctgcttggttagtgaaagcatgtctccctttctaggaaggttgtgcaggaccagcgt

SEQ ID NO: 14837 - DNA, 201 bp, Homo sapiens
ggcgtgaggcacgtccatcagtaggcacgtgctgctttcgttctgcaagtgtcaaggcgagtgtcgaggatgaaagcatgaggcgcttgcagggggtcctyggaaccaggtgccactcctcggcctgacggggagccccgccccctcccgggtctccactgtgccccaggcatgcccaccccactcccccacagccctctt

SEQ ID NO: 14838 - DNA, 201 bp, Homo sapiens
ggccgtggggagctttgtcccgcctggcacagctatgtagctgagcagggtggggcgtcctggattgcccatctggcaacacagttaacaaccctggggayggatgttgcgtgttgactttagaatgggatttccagtgtcctcatccgtctcctgttgagatgggggtggtgatggggtgctgagctacgccggccgagt

SEQ ID NO: 14839 - DNA, 201 bp, Homo sapiens
tctcgtgggcgaatcaaggcacagcaacgcagtggagcctgaggggagccgggcactggtgcaggggaccatgcacagggcaccctcggagctccgttccyggccacaggagccaaggcaggctggaatgtccagcacctgcatgctgggggcctctgctgcgccactggcagtgggaatggaagcccccacctcttagcc

SEQ ID NO: 14840 - DNA, 201 bp, Homo sapiens
taacatctcgtgggcgaatcaaggcacagcaacgcagtggagcctgaggggagccgggcactggtgcaggggaccatgcacagggcaccctcggagctccrttcctggccacaggagccaaggcaggctggaatgtccagcacctgcatgctgggggcctctgctgcgccactggcagtgggaatggaagcccccacctct

SEQ ID NO: 14841 - DNA, 201 bp, Homo sapiens
gtatctttagtgtgaaagtgaaaacttgtttctcatatttatggtagagctgacctgtaattttttttccaatagattggaggtggacacaaaggaagagrcagccagacagctacttcagcgtcctcaacgcattcatcgacaggaaggacagttactactccattcaccagataggtgggaggctgcagaatgtgccag

SEQ ID NO: 14842 - DNA, 201 bp, Homo sapiens
ttcccctcagagcttttctggtgtcgtgggatgtggagcaggaggctgtaaacctgtaaacactgacctctgaccatctgtgcgctgctgtcacatcaccyccgtgtcatcccacatcacccccgtcccacccaggcccagaccctgggccttgcccttcctgctgtccatgcggcttgcagtgcctggtgctcggcacag

SEQ ID NO: 14843 - DNA, 201 bp, Homo sapiens
ttttaagggcattccatgagcaggtaccacaccccaggtgaccacttgaggccactggtggaaaagcagcatgccctggggttcattttcagcctggtcgmgggcggcctcctgtgtgcccctttccctgatggtctggtgccctcggctccctccccacctcctgcccactgcttctcagtgtgatgtgggtgcagtggg

SEQ ID NO: 14844 - DNA, 201 bp, Homo sapiens
acaggtttgtccgctggctgtggccggctggcccctttctcttggccgcagcaagcactggggtgaggctgcacctaacggccatgtctcactaacagctrtctctgcttggaggtgccctgcccatgtttgagctggtggagcagcagccttcacatctggcctgccccgacgtcctgaacctgtccctaggtgagagct

SEQ ID NO: 14845 - DNA, 201 bp, Homo sapiens
catctgcataaaacatattggccactgctctgccttgaaccgccctggctcttcactgctgactcaggcggggctctacccgacctccctggcatgacacsttgtgctcctgggacacaccagcctcagggcctttgcatgtgtggtgcctggcacttggaccctgttcccccgacacctgcctgggttgcgccccatgtc

SEQ ID NO: 14846 - DNA, 201 bp, Homo sapiens
ctgcaccatctcgagcaaaggcacgtcgtgaaggcagagctcttttcagctttctggaagaaaggtctgctgcaaccctgaaggaacctgggcgtggcaayatttacatctaggaggaaaactgtggctcagttttaacaaatgggctcattgagtgagttccaaattcatgtttcaccttccatgatgtagccaagctga

SEQ ID NO: 14847 - DNA, 201 bp, Homo sapiens
gtgctgggattacaggcgtgagccaccgtgcctggccaggactcctctcttttttctttttttttgagacagtctagctcagtagcctgggctggagtgcrgtggtgcaatcttgggctcactgcttcctccgcctcctgggtcccggttcaagcagttctcctgcctcagcctccccagtacctggaattacaggcaccc

SEQ ID NO: 14848 - DNA, 201 bp, Homo sapiens
caaagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtggccaggcgcagtggctcacgcctgtaatcccagc

SEQ ID NO: 14849 - DNA, 201 bp, Homo sapiens
aaagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtggccaggcgcagtggctcacgcctgtaatcccagca

SEQ ID NO: 14850 - DNA, 201 bp, Homo sapiens
gtcagtctggcagtgaggacaaatgactccaatgaaagaaaagtaaataccagagcaagcacagtcagaaacagagtggggaggagaatcacaatagctgraactcaactctctgagaggcagtgcagccaaatagaggcagctgagagcagagtatgtggattagaacttttcgggagagttggccactgaaggagtagg

SEQ ID NO: 14851 - DNA, 201 bp, Homo sapiens
cccttcagagtcctctgtccagcagctccccagcccccaccacacccttccactcacacttctcttgctgctgcctggagtggccccaccaagtcagcgcygtttctctggaagcaccaggccactcgccatgctcgctgtttctcctggtcccctgcctgctccccaccagcccccgcccctgttgctggatgatcctcc

SEQ ID NO: 14852 - DNA, 201 bp, Homo sapiens
aagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtggccaggcgcagtggctcacgcctgtaatcccagcac

SEQ ID NO: 14853 - DNA, 201 bp, Homo sapiens
tgaagcctctccttctgcatctgcctgttctgtatcccactcaaggccctcaggcatcccacgttccacattcctgaaatggccctgtctcccctcacccwcagcctgctcctcagcatggcagtcactgtctccacccagcttttctgtcaggttccctggggtcctgcacaagtccgtctctgccacatcccacgtcac

SEQ ID NO: 14854 - DNA, 201 bp, Homo sapiens
catgagccgggaggcagagcttgcagtgagccgagatcgcgctactgcactccagcctggtgggcgacagagtgagactccgtctcaaaaaaaaaaaaaaraaaagaaaagaaattagaccggtggtgttttcatcctttttccttgagaataagttttctggattttagtctatatattgaataaagcctacaggtcaaa

SEQ ID NO: 14855 - DNA, 201 bp, Homo sapiens
tgccccctcatgcctcccccgatcttgttggggcatccttccgtctggaggctgggtcgggtgctgtccaggccttcctgtgacgtgtctcctggcaccaygtgccaccagaggtcagggctgggggcgggtgtgtgttgctaatgtgtatctgttccctgcagcgcaaatgggagttggcgaaggcaagtccataggcca

SEQ ID NO: 14856 - DNA, 201 bp, Homo sapiens
ctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcgcgatctcggctcactgcaagctccgcctcccaggttca

SEQ ID NO: 14857 - DNA, 201 bp, Homo sapiens
tgtgagccactgcacccggcgagtggatattttttccgaagtttgactccttttctatcaggagctacatgaattaccttataaatcacatgatgtggcaygggaagatgatgaaattatgacaggggctatgaaataagacaagggaacctctccatggcgaattgctgaggcagctggtgtcaggcctaagtggatctc

SEQ ID NO: 14858 - DNA, 201 bp, Homo sapiens
tgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcgcgatctcggctcactgcaagctccgcctcccaggttcac

SEQ ID NO: 14859 - DNA, 201 bp, Homo sapiens
gaagatgatgaaattatgacaggggctatgaaataagacaagggaacctctccatggcgaattgctgaggcagctggtgtcaggcctaagtggatctcatwcatctgagagtcagtgaaggaacaagtgtggtggctcacacttgtagtcccagcactttgggaggctgaggtgggtggatcactggagcccaagagtttg

SEQ ID NO: 14860 - DNA, 201 bp, Homo sapiens
tggggaacatgggctggagctctgtggctcacactttttgtttgtttgtttgtttttgagacggagtctcactctgtcgcccaggctggagtgcagtggcrcgatctcggctcactgcaagctccgcctcccaggttcacgccattctcctgcctcagcctctggattagctgggactacaggcacccgccaccacgcctg

SEQ ID NO: 14861 - DNA, 201 bp, Homo sapiens
ggacggatgttgcgtgttgactttagaatgggatttccagtgtcctcatccgtctcctgttgagatgggggtggtgatggggtgctgagctacgccggcckagtgcgtgtggcccacccccctctgccgtggtggtcagactgtgctgtgtgttgatcaccacactgggttctcgtgtagcctttagtgtggagctgcctc

SEQ ID NO: 14862 - DNA, 201 bp, Homo sapiens
ggatgtcctcatggacagcttcgatgcttttggaagcatccaccatctgttcccaccggggtttcaggagaaaaagaggctcatcagcacgttccaggctrgtcacgggagcccacgcctgtaatcccagcactttgggaggcccacgagggaggactgcttgtacccaggagttcaagaccagcctgggctacacaggga

SEQ ID NO: 14863 - DNA, 201 bp, Homo sapiens
atctcatacatctgagagtcagtgaaggaacaagtgtggtggctcacacttgtagtcccagcactttgggaggctgaggtgggtggatcactggagcccargagtttgagaccagcctgcttaacatagggaaaccccacctctacaaaaaatacaaaaattaggcatgacggtgcatgcctgtagtcccagctactcagg

SEQ ID NO: 14864 - DNA, 201 bp, Homo sapiens
tatttcttttttctctgggtggcaagattatgaaaaaattttcttacgcttttctatattttccaagtttgaatttcactgtaagcacctggctttgtacygccctttttctgttacacagtcatcatttgcttgcttgttgtgggagcacttttgcacaggtctgcttggttagtgaaagcatgtctccctttctaggaa

SEQ ID NO: 14865 - DNA, 201 bp, Homo sapiens; identical to SEQ ID NO: 2027

SEQ ID NO: 14866 - DNA, 201 bp, Homo sapiens
gcactttggggaggccaaggcaggtagatcacttgagcccaggagtttaagacaagcctggctggcaacatagcgaaatcctgtctccacaaaaaaattasccaggcacagtgaaggcctgtaggcctagctactcaggaggctgaagtaggaggatcacctgagcccaggaggtcaaggctgcagtgagccacgatcgtg

SEQ ID NO: 14867 - DNA, 201 bp, Homo sapiens; identical to SEQ ID NO: 2028

SEQ ID NO: 14868 - DNA, 201 bp, Homo sapiens; identical to SEQ ID NO: 2029

SEQ ID NO: 14869 - DNA, 201 bp, Homo sapiens; identical to SEQ ID NO: 2030

SEQ ID NO: 14870 - DNA, 201 bp, Homo sapiens
tccgctggctgtggccggctggcccctttctcttggccgcagcaagcactggggtgaggctgcacctaacggccatgtctcactaacagctgtctctgctyggaggtgccctgcccatgtttgagctggtggagcagcagccttcacatctggcctgccccgacgtcctgaacctgtccctaggtgagagctgccaagtcc

SEQ ID NO: 14871 - DNA, 201 bp, Homo sapiens; identical to SEQ ID NO: 2033

SEQ ID NO: 14872 - DNA, 201 bp, Homo sapiens; identical to SEQ ID NO: 2099

SEQ ID NO: 14873 - DNA, 201 bp, Homo sapiens
gtaagtggctcagagtttccatggacaagaaagttgaaatcacgggcaacatacacacttcctcgcctgagtccccacgggagcctcggcgagtgttgtcrgtcgccccatgccgtgcaggtgctccgtggggcctgtgcgccaagccagatgcacggtggcctcgctctcctatcccggcggtcataccaagagaggaga

SEQ ID NO: 14874 - DNA, 201 bp, Homo sapiens
cagtcatcatttgcttgcttgttgtgggagcacttttgcacaggtctgcttggttagtgaaagcatgtctccctttctaggaaggttgtgcaggaccagcrttccctgtgcaggcgccactgcgtttcctgcagattccgaccggcactgcaacggattccctgccggagctgaggtcaccaacaggccgtcgccatggag

SEQ ID NO: 14875 - DNA, 201 bp, Homo sapiens
cctggggaacagagtgaaacccggtcttctcccctcaaaaaaaatcaaccaactcagatgatccttgaggacattatactgaatgaaatagggcaggtgcmaaaaaacaaacactgcatgataccactcacatgaggtactcagagtaatcaaattcatagagacaggagaatgcgggttcccagagcctagggagaggag

SEQ ID NO: 14876 - DNA, 201 bp, Homo sapiens
ttagtgaaagcatgtctccctttctaggaaggttgtgcaggaccagcgttccctgtgcaggcgccactgcgtttcctgcagattccgaccggcactgcaayggattccctgccggagctgaggtcaccaacaggccgtcgccatggagacccctggtacttctcattcccctgcgcctggggctcacggacatcaacgagg

SEQ ID NO: 14877 - DNA, 201 bp, Homo sapiens
cgtggcggccacctgagcacacaggcatttggtgctgaatgctgtttgggaatgacgaggaaaactttcggatttttgcgttttttttttcagcatgttgsgataagtactgtgttcacgtggttgggaatctgaagggtataagagccggaactgtgtccttgcaccctcacgtccctcccccaggcaccacctcctgtg

SEQ ID NO: 14878 - DNA, 201 bp, Homo sapiens
gaaaagctgcgtgaccagcatcatctgcaggcacagccagtcgggctggggcgagaccctcggccctgctctggaggaggagctcaagggactgaagctcygcgggccgtggccacaagcgacagtgctggcgcccgacgtgccagaagccctggctgccgcctggaaagaggccacgtgggcagcggtgggcacgggcga

SEQ ID NO: 14879 - DNA, 201 bp, Homo sapiens
gtcactgtcacctgtcactgtccatctttttgatgcttgacggttccacctttggccggtggccacctcagtctggtggtgtcttttgccgtgttctggcrtttttcgtttatgttttgagccctcccttatgttctgggttaagcagatgctgcaggcacctctgaacattccctgcctggccctggaatcagcctggct

SEQ ID NO: 14880 - DNA, 201 bp, Homo sapiens
ttcactgtaagcacctggctttgtaccgccctttttctgttacacagtcatcatttgcttgcttgttgtgggagcacttttgcacaggtctgcttggttastgaaagcatgtctccctttctaggaaggttgtgcaggaccagcgttccctgtgcaggcgccactgcgtttcctgcagattccgaccggcactgcaacgga

SEQ ID NO: 14881 - DNA, 201 bp, Homo sapiens; identical to SEQ ID NO: 2106

SEQ ID NO: 14882 - DNA, 201 bp, Homo sapiens; identical to SEQ ID NO: 2107

SEQ ID NO: 14883 - DNA, 201 bp, Homo sapiens; identical to SEQ ID NO: 2108

SEQ ID NO: 14884 - DNA, 201 bp, Homo sapiens
ttaaatttattagaactaacacatactagaactggctctttgaagcaataacatatatgttttaaaaaaatcaaagttaaaatccctcccttggctaagcrctgtggctcccgcctgtaatcctagcactttgggaggtggaggcaggcagattgcttgagtccaggagtttgagaccagccgcctaggtaacatggtaaa

SEQ ID NO: 14885 - DNA, 201 bp, Homo sapiens
ttgggcttgggttgagcctgtggctgagagtagcctctgggtggcagtgtcctctgctctcccatccggggcctgcagtgggacactatgtcagatccccrgagatggtgtcttttttcctttgtaattaatgaataatccagtggtgacactgagcatgtcctggtgagctgtgtgactcctgcctgataatggtggttt

SEQ ID NO: 14886 - DNA, 201 bp, Homo sapiens
caaagaatagtagggacttctgaagattcaggagtggctttagagaggtagcagggacatcatgatgtttttcagctctttaaaaagataggagtgggccrgatgctgtggctcacgcctgtaatcccagcactttgggaggccgaggtgggtggatcacttgaggtcaggagatcgagaccagcctggctaacacagtga

SEQ ID NO: 14887 - DNA, 201 bp, Homo sapiens
actgtccatctttttgatgcttgacggttccacctttggccggtggccacctcagtctggtggtgtcttttgccgtgttctggcgtttttcgtttatgttwtgagccctcccttatgttctgggttaagcagatgctgcaggcacctctgaacattccctgcctggccctggaatcagcctggctcctctgagtggggagt

SEQ ID NO: 14888 - DNA, 201 bp, Homo sapiens
agaaacctcgatctagacgccgggcatgctccatgctcccggagtgtcttctcccatcaccgcaccctccggttgatgtgtcctccggaccattgactcaygggtgtgtgtaggcagaaggggtggaagcgaggaaaggcgttgctgaggaggcccggagggagcgggttctggctgtgctggcactagccaggctggcag

SEQ ID NO: 14889 - DNA, 201 bp, Homo sapiens
ggctccctccccacctcctgcccactgcttctcagtgtgatgtgggtgcagtgggtctgaaatgcggcctcctctgtccctttcctctgccggctcggccrcccacctgcccacctgcctcatcctcccaggtgaggagctcatctacctggacccccacaccacgcagccagccgtggagcccactgatggctgcttcat

SEQ ID NO: 14890 - DNA, 201 bp, Homo sapiens
ggaagcccccacctcttagccgactgcagatgggggtgtcgtgttctgctcatcgtcatttcgttttaggggtttttctgtaagactgaagatgacttcartgattggtgccagcaagtcaaaaaggtttgtagccgccccacacccacagccgagctgagccacccagggagacaggcagtggggcgtgcaggggtcgaa

SEQ ID NO: 14891 - DNA, 201 bp, Homo sapiens
gcgcccgctcctggaaagccccgttctcatagcgctcatggccaaacgctccccgcttggcagcatccgccagctgtaactggaggaacaggaccaggtcrggtttgggaaggcccacgtctggctgtttacaccagtctagggaaaaattctgccaagaaagaacccaacagttaaagcttagtgtagtctaggtttttg

SEQ ID NO: 14892 - DNA, 201 bp, Homo sapiens
caaagtcgtgtctttcatgagctggtggaaacaccggagcgcccgctcctggaaagccccgttctcatagcgctcatggccaaacgctccccgcttggcakcatccgccagctgtaactggaggaacaggaccaggtcgggtttgggaaggcccacgtctggctgtttacaccagtctagggaaaaattctgccaagaaag

SEQ ID NO: 14893 - DNA, 201 bp, Homo sapiens; identical to SEQ ID NO: 2114

SEQ ID NO: 14894 - DNA, 201 bp, Homo sapiens
tcttcttttattgcaaatttacatttctaatcttataaccaaaataaatgccactgggtagaggaaccatattaatttggatcagccaccaaaaatagaarctcatacagcaaaagatatggtaatataaaatagactaacattgaggtactttgttgattgatcaccattttgcaatagcagatggatatctagtccttg

SEQ ID NO: 14895 - DNA, 201 bp, Homo sapiens; identical to SEQ ID NO: 2109

SEQ ID NO: 14896 - DNA, 201 bp, Homo sapiens; identical to SEQ ID NO: 2110

SEQ ID NO: 14897 - DNA, 201 bp, Homo sapiens; identical to SEQ ID NO: 2111

SEQ ID NO: 14898 - DNA, 201 bp, Homo sapiens; identical to SEQ ID NO: 2113

SEQ ID NO: 14899 - DNA, 201 bp, Homo sapiens; identical to SEQ ID NO: 2112

SEQ ID NO: 14900 - DNA, 201 bp, Homo sapiens
cattctgttggttgtctgtttattctgttgactatttttttatgtgcaaaagtttagtttaattagatctcatttgtccatttttattgttgcatttgcckttagccttagtcataaattctttgcctaggccaatatctagaagagttcttcttagattttcttctagcgattgcatagtttcaggtcttatatttacat

SEQ ID NO: 14901 - DNA, 201 bp, Homo sapiens; identical to SEQ ID NO: 2115

SEQ ID NO: 14902 - DNA, 201 bp, Homo sapiens; identical to SEQ ID NO: 2116

SEQ ID NO: 14903 - DNA, 201 bp, Homo sapiens
ggaacatgccaccacacccagctaatttttaaaaacattttgtagagggggtctccctatgttgcccagcctggtctcaaactcctgggctcaagcgatcmtcccacctcagcctcccaaactgctgagattataggtgtgagccaacatgcctggccaggagttgccattgttgttgttgttattgctattgttttatag

SEQ ID NO: 14904 - DNA, 201 bp, Homo sapiens
gcattttcaaagaactgaaacaaatttagttgggatagaacatcaaacacaatagcagaataataggaagaaaccaagagttgcaatgcagagggaaacarggccaggttgagggctcccagctttattcagggaaccttagaattgccgaagacttttaaatgtgaagtgacaggattacatatgttttaggaagctcaa

SEQ ID NO: 14905 - DNA, 201 bp, Homo sapiens
ggcaaacatacgggcaagtcgtggactgcctcccggagttcagccaggacacgttcatggttcttgccaattacatcttcttcaaaggtgaggcttgctcwgacagaattattgccactgcctctgcaagtaaatgctcttacagcagagagccagctaataggttctttgctaaccacttggggaaatctatgaataaga

SEQ ID NO: 14906 - DNA, 201 bp, Homo sapiens
acttcaagaattttgagagaagaatcccaaatattcctgccagttagacaagaaaatgaaacaatacaacccaaagcacaatgacaatgatgctgcagcamatttactagaagctgtcctgtgaaaagggtgcttaggagctctggtctggaatctgagtcttgctcctgctctcaccaggcggcttgtcctaaccctgca

SEQ ID NO: 14907 - DNA, 201 bp, Homo sapiens
tacttacaaagtgcttagaagaattcctagaagatagtaagtgttcagtaaatgctagctaataatgttattattagttctgtaattagtatggtgagtayaaaaaatatggagaatagcaaaaagattaatcatgagataaaaaaggaatgtccacgttttatgttctgtctcttagcaatatatttttggcatcttaga

SEQ ID NO: 14908 - DNA, 201 bp, Homo sapiens
ctgcagatggattacaagggagatgccgtggccttctttgtcctccctagcaagggcaagatgaggcaactggaacaggccttgtcagccagaacactgakaaagtggagccactcactccagaaaaggtgggcatctgtgtcaatctcctgggccctgaggcaggggatgcacacattcaaagatgagggagagattgtg

SEQ ID NO: 14909 - DNA, 201 bp, Homo sapiens
tttggcatcttagaatgattttagcagcgttccctggtgctcatagtctgggaagagagaaggaaggctgcagtgtaactggaattcaagaaagagattgrgcaatgccccacgggagggcaggaaaggtgctgaggagtttctgagcagagagagatcactttcagctgggactgagggacagcttcaaggaggcggtgg

SEQ ID NO: 14910 - DNA, 201 bp, Homo sapiens
cctactatatgtaaagcagataaagggttgctaccttcactgaagcctcggaggaaagtgtccagaatcctaatcatccacagccttgtcttcttcagtgyccctcatggcagccctgtggggcacattgtgaaggtgggatttgtggtatgagcaatagagaatcatgacattatttatggagaaaagtgacatgttcac

SEQ ID NO: 14911 - DNA, 201 bp, Homo sapiens; identical to SEQ ID NO: 2122

SEQ ID NO: 14912 - DNA, 201 bp, Homo sapiens
cggcaatggtcccgcttccatactctgagtcctgagagcagcacaatgagcaatgggccacggttgcactacagcaaaggcagctcgtgtcctttgagtcmgacccaccgtccctccttccctcgttgcctgacaggctgtgctggcacctctatgtcacccccattaccgagggcatctctggcagcctcagtagagccc

SEQ ID NO: 14913 - DNA, 201 bp, Homo sapiens
agctaataatgttattattagttctgtaattagtatggtgagtataaaaaatatggagaatagcaaaaagattaatcatgagataaaaaaggaatgtccamgttttatgttctgtctcttagcaatatatttttggcatcttagaatgattttagcagcgttccctggtgctcatagtctgggaagagagaaggaaggctg

SEQ ID NO: 14914 - DNA, 201 bp, Homo sapiens
tgctcagacatggctccagcctcctgcagagtaggcaagaagatgtcctacagtagcacaaaggagatagtaggtgtgaagaagtgactaatgacacttgytgttcacaactagttttttccagaaactatgaggaaccccaagtagtcagcagtgggtgacggctgtcagcatccctccgacagccttgcttccagtggc

SEQ ID NO: 14915 - DNA, 201 bp, Homo sapiens
tggaactcctgatctcaggtgatccacctgcctcgaaagtgctaggattacaggcgtgagccaccgcgcccagccaccaccccagttctgaggctggtgtwaatgcttctccatctcagggcagcacaccaagtgtctactgagcccatacattgggcacttttccgtgctggtgggggaagggggaaggaggacaggaag

SEQ ID NO: 14916 - DNA, 201 bp, Homo sapiens
tgaaattgctatcaggtcatttagtctgaagtctccttggggccaaagccatgtcagctgaggcttgaaggggaagcagacagatgtgactagaactgcarctcatcagcaactgactgccagtgctcagggcacctgaaggagcacagcaaaaaggacagccttttgctccaggtttccactttttgagagatatgaaca

SEQ ID NO: 14917 - DNA, 201 bp, Homo sapiens
aaccaacccaaatacccatcaatcaatgagtggataaaaaaactgtggtgtatatatatatatgatggaatactactcagccataaaaaggaacgaattarttgcattcacatcagcctgggtggaccttgagactattattctaagtgaagtaactcaggaatggaaaaccaaacatcgtatgttctcactcataagtgg

SEQ ID NO: 14918 - DNA, 201 bp, Homo sapiens
cttggcaggcaacccacaaggctgtgctggatgtcagtgaagagggcactgaggccacagcagctaccaccaccaagttcatagtccgatcgaaggatggyccctcttacttcactgtctccttcaataggaccttcctgatgatgattacaaataaagccacagacggtattctctttctagggaaagtggaaaatccca

SEQ ID NO: 14919 - DNA, 201 bp, Homo sapiens
tacccatcaatcaatgagtggataaaaaaactgtggtgtatatatatatatgatggaatactactcagccataaaaaggaacgaattaattgcattcacakcagcctgggtggaccttgagactattattctaagtgaagtaactcaggaatggaaaaccaaacatcgtatgttctcactcataagtggagctaagctatg

SEQ ID NO: 14920 - DNA, 201 bp, Homo sapiens
tctttctagggaaagtggaaaatcccactaaatcctaggtgggaaatggcctgttaactgatggcacattgctaatgcacaagaaataacaaaccacatcmctctttctgttctgagggtgcatttgaccccagtggagctggattcgctggcagggatgccacttccaaggctcaatcaccaaaccatcaacagggaccc

SEQ ID NO: 14921 - DNA, 201 bp, Homo sapiens
ggtatgggtagtggcatggtccgccatagtgaacagtgtcatgggaagactggttgcttctcacgctgggaaatgcctctctcccatggctcaggctgccracagacagagcaggagtggcacatattaacaagagagcaccatttctctgtctgtttctctctccagtctgttggatttgcacttgccaaggttttcaat

SEQ ID NO: 14922 - DNA, 201 bp, Homo sapiens; identical to SEQ ID NO: 2133

SEQ ID NO: 14923 - DNA, 201 bp, Homo sapiens
ggttgttgtctagaggcagtttggttgagaaggattaattcagtgtttgcaagcaatctgagctgctcagtcagtcatcccagctctgcaaattagtatgwttaaataaattcacaaagactcagtttgatcatccctgatatgggaataatacttatttcttattaatttttatgacaatttaaagagataatgtctaac

SEQ ID NO: 14924 - DNA, 201 bp, Homo sapiens
cacagacaagtcaaccatgctatttggggtaagttgcacagactctctgtggcctgtttactcatttgcaagtaaaacagcaataataagatctacatcawgggaatattgtgaggctcagagattatgtgagagagctctgctaactggcctatctgtcctcattctgctgctgatggcgtgggggtgttaaagggtctc

SEQ ID NO: 14925 - DNA, 201 bp, Homo sapiens
agtttggttgagaaggattaattcagtgtttgcaagcaatctgagctgctcagtcagtcatcccagctctgcaaattagtatgtttaaataaattcacaawgactcagtttgatcatccctgatatgggaataatacttatttcttattaatttttatgacaatttaaagagataatgtctaacacatggaaggtgcttag

SEQ ID NO: 14926 - DNA, 201 bp, Homo sapiens
aatttaaagagataatgtctaacacatggaaggtgcttagtagatggaaaaataccttttggcttgttagaagctaagttcctctgaaatggaacaaaatygtaggctgttagtgctcaaacactggtgacttgtcctagagactgagccaggcctaaattctggtctcctggctctgtaaccattccacattttttgcca

SEQ ID NO: 14927 - DNA, 201 bp, Homo sapiens
cagagttgctctcttgaaaagagttctcatggccttatgggttttgtgtcctaagccaagtggaagcaccctttcagtcgctaccagacccagaagcaggmaagtttctttgtggatgagaggacttctctccaggtccccatgatgcaccaaaaggaaatgcacagattcctctatgaccaggatttggcttgcaccgtc

SEQ ID NO: 14928 - DNA, 201 bp, Homo sapiens
gtgcagtggcacaatcttggctcactgcaacctcttctgcttcccaggttcaagggattatccagcctcagcatcccaagtagctgaaattacaggcaccygccaccctgtcaggctaatttttatatttttagtagagacggggtttcaacatgttgtccaggctggtctagaactcctggcctcaagtgatccacctgc

SEQ ID NO: 14929 - DNA, 201 bp, Homo sapiens
gaagtgactaatgacacttgttgttcacaactagttttttccagaaactatgaggaaccccaagtagtcagcagtgggtgacggctgtcagcatccctccracagccttgcttccagtggcactttacagtgaaagcaagcttaggtggcaacctggtgcccactcagacttgcattggcaagcagatacaaaaacagccg

SEQ ID NO: 14930 - DNA, 201 bp, Homo sapiens
caggtcttgatcaactccagctgcaaaagcccaacatccatctcgattaggctcaccatcttgtcctttactaactgtgtgatcttggcaattttctcacmttttttgggcctctactgtaaaactaagaacatgatacctgcctcattgggttgctcagtagattcattgagtttctacccatagagaatgtagaactta

SEQ ID NO: 14931 - DNA, 201 bp, Homo sapiens
tccccatttcagtttgctgtctttgcctcactaattgtactttgacataaagacttcttttctctctttgtgctagccaagtgggaaaagccctttcaccytgaatatacaagaaagaacttcccattcctggtgggcgagcaggtcactgtgcatgtccccatgatgcaccagaaagagcagttcgcttttggggtggat

SEQ ID NO: 14932 - DNA, 201 bp, Homo sapiens
gttgcactacagcaaaggcagctcgtgtcctttgagtcagacccaccgtccctccttccctcgttgcctgacaggctgtgctggcacctctatgtcacccycattaccgagggcatctctggcagcctcagtagagcccttgctcccatcagatccaaaggctcctcttctgggggccccggtgccccacacacctcggat

SEQ ID NO: 14933 - DNA, 201 bp, Homo sapiens
cttggaaaaaataaaaaaagaagaccatgagcaagattaaccaagaagagagaaaatccaaataagctcaattagaaatgaaatgaaagattttaaaaccracaccacagaaatacaaaagatcattcaaggctactattaacacctttatgtgcataaactagaaaagctagaggagatggataatttcctggaaagatc

SEQ ID NO: 14934 - DNA, 201 bp, Homo sapiens
aatcccagtgctttgggaggccaaggtgagaggattacttgaggccaggagtttgagactagcttgggcaacatagcaagaccctgcctctatgcaaaatdaaaaaaaacatatatagctggacatgttgatgcatgcctatagtcccaactacctgggaggatgaggaaagaggatcacctgagcccaggaatttgaggt

SEQ ID NO: 14935 - DNA, 201 bp, Homo sapiens
gctatgattgtgccactgcactccagtctgggcaacaaagctagatcctatctctaataaaaaattattattatcattatattgttaaagggtgcttctaytttaattaaaacatgtttaaaaaattaaatattaagaacattgtaaacattaaagttcctgttttatgtgatctctaaactatttcccatctcacttgct

SEQ ID NO: 14936 - DNA, 201 bp, Homo sapiens
tcagagcagaactgaatgaaattgaaacaacaacaacaaaatagcaaaagataaatgaaacaaaaagctggttcttggaaaaaataaaaaaagaagaccaygagcaagattaaccaagaagagagaaaatccaaataagctcaattagaaatgaaatgaaagattttaaaaccgacaccacagaaatacaaaagatcattc

SEQ ID NO: 14937 - DNA, 201 bp, Homo sapiens
accggctgacgagggctaatgcgtgggctgtgaaggtctccccgggtgccgtggaccagtttcccatctcctcgcggctggctgccttcctgactccgatracgtcatgtgtgcacacacagccctccgggtgctcagccccttccctgcgggtttgtaacggcaatggtcccgcttccatactctgagtcctgagagcag

SEQ ID NO: 14938 - DNA, 201 bp, Homo sapiens
attttgtgtttgggcagagattaaaacaccaaataagaggcacgggccaaggggagaggccaggatttaagagattattcctgttgtccatgaagctccayggctctagtcagttgctaatttcagccccatagtccctggctcctttggggtgagtcttctccttgcccccatcacagaagggagtgccatagactcttc

SEQ ID NO: 14939 - DNA, 201 bp, Homo sapiens
ctcacataaatgtaaggtaaaggggtggaaatagacattctatgcaaatagacactaaaagcaaacagaagtggctatacttatatcagacaaaacaaacyttaaagcaacagcagttaaaaaagataaagagggacattatataatgataaaaggccttgtccaacacaaaaatattacagtcttaaatatatatgcacc

SEQ ID NO: 14940 - DNA, 201 bp, Homo sapiens
gtcagccagaacactgagaaagtggagccactcactccagaaaaggtgggcatctgtgtcaatctcctgggccctgaggcaggggatgcacacattcaaaratgagggagagattgtgctaacagctgttggataatcacttctgcacagtgagcaccaactgcatgcaggacagagagcctggggctgtctatacatgtt

SEQ ID NO: 14941 - DNA, 201 bp, Homo sapiens
aaacccccagctgaaccttgtaacaattccaactgaacaggaagtctcctggccagaactcaagggagggcctgaatctggtgtgcagactccacaggccrataggcgtgaaagccctacttgttctcataagtgggaggctggtagcctggggcaagttctcagcccttcctgcccactgcctataaacaaacttggtgc

SEQ ID NO: 14942 - DNA, 201 bp, Homo sapiens
gaaacccccagctgaaccttgtaacaattccaactgaacaggaagtctcctggccagaactcaagggagggcctgaatctggtgtgcagactccacaggcyaataggcgtgaaagccctacttgttctcataagtgggaggctggtagcctggggcaagttctcagcccttcctgcccactgcctataaacaaacttggtg

SEQ ID NO: 14943 - DNA, 201 bp, Homo sapiens
acccacaaaccctctgaaggaaggaggttgctcctgcagaacccaagagacagtccaaatattgtgagtgcccaagctgtgaaagtgggaaaggtggattktctgtcactgaacacacaccctcactggggcacctgaaggtctagatcatgggagaaggatctgaccttatctggagctgagtcaatttagagagccaag

SEQ ID NO: 14944 - DNA, 201 bp, Homo sapiens
gagactagcttgggcaacatagcaagaccctgcctctatgcaaaatgaaaaaaaacatatatagctggacatgttgatgcatgcctatagtcccaactacmtgggaggatgaggaaagaggatcacctgagcccaggaatttgaggttacagtgagctatgattgtgccactgcactccagtctgggcaacaaagctagat

SEQ ID NO: 14945 - DNA, 201 bp, Homo sapiens; identical to SEQ ID NO: 2118

SEQ ID NO: 14946 - DNA, 201 bp, Homo sapiens
gagagagctctgctaactggcctatctgtcctcattctgctgctgatggcgtgggggtgttaaagggtctctgattcagggcctggaccctcagtttaccmcctcaatggttcttacttctcttgcagacatattttgttccaaaatggcatcttacctttatggagtactctttgctgttggcctctgtgctccaatcta

SEQ ID NO: 14947 - DNA, 201 bp, Homo sapiens
ggaagtctcctggccagaactcaagggagggcctgaatctggtgtgcagactccacaggccaataggcgtgaaagccctacttgttctcataagtgggagkctggtagcctggggcaagttctcagcccttcctgcccactgcctataaacaaacttggtgctgtttggggggacatggtgggagtgagactggtcttttg

SEQ ID NO: 14948 - DNA, 201 bp, Homo sapiens
cgctcaccatgtgctgggtcccgtgctgcacaatttgtgccttatcacactcagtcctctgaacaactctgtaaggtaactatctctgttttacaaaggcraaacagagaagtccagagaggttacttgtccaccacgaatgtcagggttagattcaagcccagccctgttggggtttgaaattgctatcaggtcatttag

SEQ ID NO: 14949 - DNA, 201 bp, Homo sapiens
ctttcccctctggctgagcacagacctcccctggccttgcattggattcatacaccttccttctctaaaatgaccacttactgttgtatctcagggtcaaygcacagggttggagctcctctgtaaagttgtgttaaaggaaatgaaatctttctgatgaaactgaacaggtgagggtgctgtaggcagggctggggagac

SEQ ID NO: 14950 - DNA, 201 bp, Homo sapiens
gccataaaaaggaacgaattaattgcattcacatcagcctgggtggaccttgagactattattctaagtgaagtaactcaggaatggaaaaccaaacatcrtatgttctcactcataagtggagctaagctatgaggatgggaagacatgagaatgatacaatggacttcggggactcgagagaaagagtgggagcggggt

SEQ ID NO: 14951 - DNA, 201 bp, Homo sapiens
gatgaagggcaagggggattatgaaggcactgtgcttgtgaaaaggatgatggggggaaggacatccaggtcatgggggggaaattataaaatttgtgagragagaaaagccttcagacggatgtgacctattggagcacacacctgctttgctttcccctctggctgagcacagacctcccctggccttgcattggattc

SEQ ID NO: 14952 - DNA, 201 bp, Homo sapiens
acctgcctcgaaagtgctaggattacaggcgtgagccaccgcgcccagccaccaccccagttctgaggctggtgtaaatgcttctccatctcagggcagcmcaccaagtgtctactgagcccatacattgggcacttttccgtgctggtgggggaagggggaaggaggacaggaagcaggtgtgtagagcaatgaggaaca

SEQ ID NO: 14953 - DNA, 201 bp, Homo sapiens
gggcagatactttgaaaaaaaagagcccttcctgtttgctgtgcattgtcttcataccagttcccagaattgacctgacaaatattgaccaggttgctgtsatcttcaaacaccattttcctgtgggtagaggtgatgcagtgctgaagacctgggcccctgctcagtgcctttgctctgtaagtactttgcctgtgccca

SEQ ID NO: 14954 - DNA, 201 bp, Homo sapiens; identical to SEQ ID NO: 2121

SEQ ID NO: 14955 - DNA, 201 bp, Homo sapiens
gggcatctctggcagcctcagtagagcccttgctcccatcagatccaaaggctcctcttctgggggccccggtgccccacacacctcggatgtgccagggrcctcatgtaggctttctcatgctattttataaggaaagaaacaaaacagaaaggagttatgctggagagctggcagaagtcccaggggaacctaaccccc

SEQ ID NO: 14956 - DNA, 201 bp, Homo sapiens
ggcatccaggaggggcatttgtagcagagtatgctatgcctgagcaaggggtaggtgagtgggaagagaagggagggaggtggaccctgggctgttgctaytggtgttgactgcagaggctgcagataaattcactggccagcagtggggccgaagagaggggaagcagtcaactctcaaggccacatgtcatagggttcc

SEQ ID NO: 14957 - DNA, 201 bp, Homo sapiens
tccgccatagtgaacagtgtcatgggaagactggttgcttctcacgctgggaaatgcctctctcccatggctcaggctgccgacagacagagcaggagtgrcacatattaacaagagagcaccatttctctgtctgtttctctctccagtctgttggatttgcacttgccaaggttttcaatttctggaacatataacctg

SEQ ID NO: 14958 - DNA, 201 bp, Homo sapiens
ggcgtggaggccgcgtctaataggccacctctgctgatgggaatgcggattctttaggaggcacaacccagcgtcagtgggggccccctgagagccacctrccccactgccagcctccacagaaaggggcacagacccctggtgcttgtggcatcctggcgcctggcagcacccgcttcccctccatgtggctgatgtcct

SEQ ID NO: 14959 - DNA, 201 bp, Homo sapiens
ccattaaccccagtcagtgcccttttccacaaattctcccaggtaactagcttcatgggatgttgctgggttaccatatttccattccttggggctcccargaatggaaatacgccaacccaggttaggcacctctattgcagaattacaataacacattcaataaaactaaaatatgaattcatctgtcaacagagtcct

SEQ ID NO: 14960 - DNA, 201 bp, Homo sapiens
acccaagcccaaaagaaacaagacttggggcgtggaggccgcgtctaataggccacctctgctgatgggaatgcggattctttaggaggcacaacccagcrtcagtgggggccccctgagagccacctgccccactgccagcctccacagaaaggggcacagacccctggtgcttgtggcatcctggcgcctggcagcacc

SEQ ID NO: 14961 - DNA, 201 bp, Homo sapiens
gacttcaggtgggtctcccctactcaacccaagcccaaaagaaacaagacttggggcgtggaggccgcgtctaataggccacctctgctgatgggaatgcrgattctttaggaggcacaacccagcgtcagtgggggccccctgagagccacctgccccactgccagcctccacagaaaggggcacagacccctggtgctt

SEQ ID NO: 14962 - DNA, 201 bp, Homo sapiens
ttgtgaaaagcagagacttacctgaagtcacatggaggccagtaccatcgatgactcaggacatttactagccaactccccgacttcaggtgggtctcccytactcaacccaagcccaaaagaaacaagacttggggcgtggaggccgcgtctaataggccacctctgctgatgggaatgcggattctttaggaggcacaa

SEQ ID NO: 14963 - DNA, 201 bp, Homo sapiens
aagagagggccttttgagaccacctcttcctgaagtcttgtgaaaagcagagacttacctgaagtcacatggaggccagtaccatcgatgactcaggacayttactagccaactccccgacttcaggtgggtctcccctactcaacccaagcccaaaagaaacaagacttggggcgtggaggccgcgtctaataggccacc

SEQ ID NO: 14964 - DNA, 201 bp, Homo sapiens
actcagaagagagggccttttgagaccacctcttcctgaagtcttgtgaaaagcagagacttacctgaagtcacatggaggccagtaccatcgatgactcrggacatttactagccaactccccgacttcaggtgggtctcccctactcaacccaagcccaaaagaaacaagacttggggcgtggaggccgcgtctaatag

SEQ ID NO: 14965 - DNA, 201 bp, Homo sapiens
accctgtttgcactgcagttccccctccagctcaggctgcattcccagccctaaaacaaggggtcttcctgctcctgtaccactttgatccctggaagtgraataaaggctcttctggcacattttgtaacttaaaataaagcacaagagatatcacattagtttgcaagggctatcttaataaatactacatgccaggca

SEQ ID NO: 14966 - DNA, 201 bp, Homo sapiens
tccctactccacaggtggatagaggtgttcatccccagattttccatttctgcctcctacaatctggaaaccatcctcccgaagatgggcatccaaaatgyctttgacaaaaatgctgatttttctggaattgcaaagagagactccctgcaggtttctaaagtgagttgaatgaaaatatttgcaaaacagtccaagctg

SEQ ID NO: 14967 - DNA, 201 bp, Homo sapiens
gccctaaaacaaggggtcttcctgctcctgtaccactttgatccctggaagtggaataaaggctcttctggcacattttgtaacttaaaataaagcacaaragatatcacattagtttgcaagggctatcttaataaatactacatgccaggcagcttaaacaacagaaatttttgactcacagttctggaggttagaagt

SEQ ID NO: 14968 - DNA, 201 bp, Homo sapiens
aagaggaattaagaaatgaattgggcatcattaccccaggcttgatagaaagggaaaaaaactgccattgagtactttcggcatgcctggagctttgtacwttgactgtcatataatcccgaaatggccccacacccaggaggtgggcaatatcatttgcattttgcaaagggagacactgagtttcagacagctgctttt

SEQ ID NO: 14969 - DNA, 201 bp, Homo sapiens
cagcctctgcttgtgacaagaggcatcccagatatcagaggctggacagagacatggagacagagttgctctctctcatcgctcctctaggctccatcagycctgctactttgctccccactcctgggctgtcttcatccacacatccagatggccgatcctcacatcgccactccagctaatgaacgactggaaaggggg

SEQ ID NO: 14970 - DNA, 201 bp, Homo sapiens
tgtttatataccaatttttgtctcttcccttctgtgaggctgctaaaatctctgctcttctagcaggtggcttttgcatgattatttgctgtctcattccrcacacgcatcacttatgaggcagaaaattaccttgaagggaaatttcatgcaggacattgtatctgcttcatcatgattatcttttatctagaaacttga

SEQ ID NO: 14971 - DNA, 201 bp, Homo sapiens
agggtgcatttgaccccagtggagctggattcgctggcagggatgccacttccaaggctcaatcaccaaaccatcaacagggaccccagtcacaagccaamacccattaaccccagtcagtgcccttttccacaaattctcccaggtaactagcttcatgggatgttgctgggttaccatatttccattccttggggctcc

SEQ ID NO: 14972 - DNA, 201 bp, Homo sapiens
attcttaaaaaataagtccatgaagcagaaacatcaaaaagcatgggatttggaatttgagacctgactttgaagcccacacagaacacagacaagtcaaycatgctatttggggtaagttgcacagactctctgtggcctgtttactcatttgcaagtaaaacagcaataataagatctacatcatgggaatattgtgag

SEQ ID NO: 14973 - DNA, 201 bp, Homo sapiens
cacttgctttgtatgatctctcttaatttacacaataaccttacggggcatatgcagttattattaccttttatagatcgggaacctgaagcacgcagcaycttaataattttgcaaccataagtggcagaactgagactcactccggtcttcctgctctgtgtttgtaaccatctcaatcccggtgtaaggaccaatggg

SEQ ID NO: 14974 - DNA, 201 bp, Homo sapiens
gcctcaagtgatccacctgccttggcctcccaaagtgctgggattacaggcatgagccaccgcacccagccccttccaatctttttattcatacacagatyatattttatttgaagcatcaacaaaatactggaatggtttggtgtggtagtgaaggcttggactgggggataggatccaagttctgagtgtggccccatc

SEQ ID NO: 14975 - DNA, 201 bp, Homo sapiens
tctttttattcatacacagattatattttatttgaagcatcaacaaaatactggaatggtttggtgtggtagtgaaggcttggactgggggataggatccmagttctgagtgtggccccatccgtccacttaatgagcaagtgacttaacctcacagagcctcagtttcccatctacaaagtagggatgactgtgcctctc

SEQ ID NO: 14976 - DNA, 201 bp, Homo sapiens
taaggattaaattaaataagacaaagcaagtgtttctcaacaagggcactaccggtatttgggcaggaccactcttcattgaatgtgactattctgggtgyttcaagagctttcgggagcccagctgttccccaactaaactccagcagcatccctccaccaggcattgagctgatccaaaatgtcacctctatctccttt

SEQ ID NO: 14977 - DNA, 201 bp, Homo sapiens
agacagtgaaaaataatcatggctgggtgcagcagctcagacctacaatcccagtgctttgggaggccaaggtgagaggattacttgaggccaggagtttragactagcttgggcaacatagcaagaccctgcctctatgcaaaatgaaaaaaaacatatatagctggacatgttgatgcatgcctatagtcccaactacc

SEQ ID NO: 14978 - DNA, 201 bp, Homo sapiens
ccaggaatttgaggttacagtgagctatgattgtgccactgcactccagtctgggcaacaaagctagatcctatctctaataaaaaattattattatcatyatattgttaaagggtgcttctattttaattaaaacatgtttaaaaaattaaatattaagaacattgtaaacattaaagttcctgttttatgtgatctcta

SEQ ID NO: 14979 - DNA, 201 bp, Homo sapiens
gtgtccagaatcctaatcatccacagccttgtcttcttcagtgcccctcatggcagccctgtggggcacattgtgaaggtgggatttgtggtatgagcaayagagaatcatgacattatttatggagaaaagtgacatgttcaccctcttgttttcagagaatgggtccagcttggctttggctactgggaacagggatcc

SEQ ID NO: 14980 - DNA, 201 bp, Homo sapiens
aggaaagagaaggaaagaaaactggtatggtttgagcccttactaagttaccttcagtttatgttgttctatttaactaattctatttttaattgaaatayaattcacatgtcataaaattcaccattttattgctttttagtatattcacaagtttgggcaactactccgctgtgtaatatcagagcatttttttgtcac

SEQ ID NO: 14981 - DNA, 201 bp, Homo sapiens
gaacttcagactctgccatgtttcactccattcagatgtgaggcaggttagcttgccaaggggaactgcacttcctggcacaccattcgtgtatgtattcwttcacagttgttaaacatccactgtgttttgggctctctgtcagacccctgccccactagactctattccaccccccagccaactggcgcgggtcttgct

SEQ ID NO: 14982 - DNA, 201 bp, Homo sapiens
ctcctgggccctgaggcaggggatgcacacattcaaagatgagggagagattgtgctaacagctgttggataatcacttctgcacagtgagcaccaactgyatgcaggacagagagcctggggctgtctatacatgttcacacttgaagttcactatcacctgatgaggagtcttagtaccactcattacacagatgagga

SEQ ID NO: 14983 - DNA, 201 bp, Homo sapiens
ggagagagaaggggtggccacaggaggacaggagttcagggtggggagaagcaaagtggggagtgtggtggattttaagagctgactgaatgagctttggmcacggttttcccccaagagagcaatgacctgggggccctcagacatagatcccagactcagaagagagggccttttgagaccacctcttcctgaagtctt

SEQ ID NO: 14984 - DNA, 201 bp, Homo sapiens
aaacaacaaaaacaaacaaacaaacaaaaaacaaaaacagaagagctgacactcaaagagtaaaaacaactaacctaagccacagggccttcctgtgctgrcttagaacaaggaccaatggccagttatgaagggctcccgcaacgctgcctgaagcaaggtttgttttatacacaatgctcttccctcaggctctccatt

SEQ ID NO: 14985 - DNA, 201 bp, Homo sapiens
atgctggagagctggcagaagtcccaggggaacctaaccccctggccctcacgctcccactttatttcacaaacagaacaagctgccactgcactccagcytgggcaacagagcaaggccctgtctcaaaacaacaaaaacaaacaaacaaacaaaaaacaaaaacagaagagctgacactcaaagagtaaaaacaactaa

SEQ ID NO: 14986 - DNA, 201 bp, Homo sapiens
tcttttctctctttgtgctagccaagtgggaaaagccctttcaccctgaatatacaagaaagaacttcccattcctggtgggcgagcaggtcactgtgcawgtccccatgatgcaccagaaagagcagttcgcttttggggtggatacagagctgaactgctttgtgctgcagatggattacaagggagatgccgtggcct

SEQ ID NO: 14987 - DNA, 201 bp, Homo sapiens
ctgagaaagtggagccactcactccagaaaaggtgggcatctgtgtcaatctcctgggccctgaggcaggggatgcacacattcaaagatgagggagagawtgtgctaacagctgttggataatcacttctgcacagtgagcaccaactgcatgcaggacagagagcctggggctgtctatacatgttcacacttgaagtt

SEQ ID NO: 14988 - DNA, 201 bp, Homo sapiens
gcaggtttctaaagtgagttgaatgaaaatatttgcaaaacagtccaagctggaagcacctgcagaattaatcacacgctcttatttcgttgataaggaarcagaggcctgaaaggtgaagtcagggtcttctgcggccagaagaaccgaatcttgcggcctatggccaccatccctctggcatgcagcattgttatccct

SEQ ID NO: 14989 - DNA, 201 bp, Homo sapiens; identical to SEQ ID NO: 2132

SEQ ID NO: 14990 - DNA, 201 bp, Homo sapiens
acacctcctatagtacctgcataataagcgtacatgttcaacccaatggaccaaatgcataaattacacattcaaagaacctagagattatctaaaggcaygcgtgtggtcagtgataatccatttggtaatagaagtcgagtaaatttcagaagtgccagaagagagaagggagagagtgatgaagtcacaacaggagag

SEQ ID NO: 14991 - DNA, 201 bp, Homo sapiens
catccaaaatgcctttgacaaaaatgctgatttttctggaattgcaaagagagactccctgcaggtttctaaagtgagttgaatgaaaatatttgcaaaamagtccaagctggaagcacctgcagaattaatcacacgctcttatttcgttgataaggaagcagaggcctgaaaggtgaagtcagggtcttctgcggccag

SEQ ID NO: 14992 - DNA, 201 bp, Homo sapiens; identical to SEQ ID NO: 2134

SEQ ID NO: 14993 - DNA, 201 bp, Homo sapiens
cttcaccagctaataccttcttgggggtgcatcttcttttatggggtactctgagatgaaatctggtacttagttctacttactgcttgctgcataacaasccaccccaaaaccgaatgacttaagacaatcacttccttggttctatgggttaactgggctcagctgggcagttttcatgtgttggagtaggtggcagct

SEQ ID NO: 14994 - DNA, 201 bp, Homo sapiens
agaagtgatcctggggccactgaaggggacctttgtcattggttttcagaaaatgttgagaggccccactggaatatgatgaacataatggacattttctygaggaaagtgtatctgtgagcctatgaaaaataatgcctgtagtcacaggagctcaagcctccctgaagcttagaaatccaggaactccaggttaagaat

SEQ ID NO: 14995 - DNA, 201 bp, Homo sapiens
cctccacccttcatctacccatccagcaaactatccacccatttatccatccatcagttcatccatctatccatccatccatccatccatccatccatgcrtccattcatccacctagctagccatctagctagccaaccacctatccactaatctattcatctatctatctctctatcggttcatccatccatccattca

SEQ ID NO: 14996 - DNA, 201 bp, Homo sapiens
gctggggaggtgagtcagggcccaataaataaagctcttgaatgtcaggggcttgagcattttttctgagctcaatggggagccattgaggaattcgaggygaggtgagtgatacaccagatcagcatctggaaaggtcaccctgtctgcagggtggaggagcgcttggagatgggagtgagtgagagacaatggaaggtg

SEQ ID NO: 14997 - DNA, 201 bp, Homo sapiens
tggaattgcaaagagagactccctgcaggtttctaaagtgagttgaatgaaaatatttgcaaaacagtccaagctggaagcacctgcagaattaatcacaygctcttatttcgttgataaggaagcagaggcctgaaaggtgaagtcagggtcttctgcggccagaagaaccgaatcttgcggcctatggccaccatccct

SEQ ID NO: 14998 - DNA, 201 bp, Homo sapiens
taacttagaaagaaaattccactttagtcaaacaggcaaatacaaaactacacaacagaaatcgccaatcacataagtggaaatggagagaaatgaacagktttgcaaaagaattactcattcagtaaaagggttctttataaagttccatctaagttaaattatatctggtataataaaatgtgattcatttacatattt

SEQ ID NO: 14999 - DNA, 201 bp, Homo sapiens
tttctggaattgcaaagagagactccctgcaggtttctaaagtgagttgaatgaaaatatttgcaaaacagtccaagctggaagcacctgcagaattaatmacacgctcttatttcgttgataaggaagcagaggcctgaaaggtgaagtcagggtcttctgcggccagaagaaccgaatcttgcggcctatggccaccat

SEQ ID NO: 15000 - DNA, 201 bp, Homo sapiens
gggccaaagccatgtcagctgaggcttgaaggggaagcagacagatgtgactagaactgcagctcatcagcaactgactgccagtgctcagggcacctgamggagcacagcaaaaaggacagccttttgctccaggtttccactttttgagagatatgaacacattagtaaaatgcctgtgtctgggaacaggcagccagg

SEQ ID NO: 15001 - DNA, 201 bp, Homo sapiens
acttctcttgcagacatattttgttccaaaatggcatcttacctttatggagtactctttgctgttggcctctgtgctccaatctactgtgtgtccccggycaatgcccccagtgcatacccccgcccttcctccacaaagagcacccctgcctcacaggtgtattccctcaacaccgactttgccttccgcctataccgc

SEQ ID NO: 15002 - DNA, 201 bp, Homo sapiens; identical to SEQ ID NO: 2129

SEQ ID NO: 15003 - DNA, 201 bp, Homo sapiens
cccaggcgaggatcaacagccatgtgaaaaagaagacccaagggaaggttgtagacataatccaaggccttgaccttctgacggccatggttctggtgaaycacattttctttaaaggtaaggatttgagaagttgatttttatttatttattttatgatgatgatgatgatttttgcttagtgaaatacacaagccagac

SEQ ID NO: 15004 - DNA, 201 bp, Homo sapiens
ccactagaagtaattccccatttcagtttgctgtctttgcctcactaattgtactttgacataaagacttcttttctctctttgtgctagccaagtgggaraagccctttcaccctgaatatacaagaaagaacttcccattcctggtgggcgagcaggtcactgtgcatgtccccatgatgcaccagaaagagcagttcg

SEQ ID NO: 15005 - DNA, 201 bp, Homo sapiens
acaaatataagaaaaaatgctcaacattactaatgatcagggaaatgcaaatcaaaaccacagtgtgatatcaccttactcctgcaagaatggccataatmaaaaaataatagacgttggcgtggatgtggtgaaaagggaacatttctgcactgctggtgggaatgtaaactagtacaacccctatggaaaacggtgtgc

SEQ ID NO: 15006 - DNA, 201 bp, Homo sapiens
ggccatagtcaacacccactgcaatgtattgagtaaacccaatgccaggcatttgaaccttgaatcctttcaaggtagacatcaccattccagggcaaaarcactcagtttagtttactcagttaagtaaaagtgtctccactagggccactgatgtttgtttttcccttggcaggcaacccacaaggctgtgctggatgt

SEQ ID NO: 15007 - DNA, 201 bp, Homo sapiens
gcatttgaaccttgaatcctttcaaggtagacatcaccattccagggcaaaagcactcagtttagtttactcagttaagtaaaagtgtctccactagggcyactgatgtttgtttttcccttggcaggcaacccacaaggctgtgctggatgtcagtgaagagggcactgaggccacagcagctaccaccaccaagttcat

SEQ ID NO: 15008 - DNA, 201 bp, Homo sapiens
atgtgcccaccccaagatagccctattgtttagggtctgggacccatcagtgtctggcatcatgcttggcattaggtgctcagcaggagctcagtgaatgrataaatgagcttttggtgtcctctaagtgtaaactccacaaaaacagcacttttggtctgtttactgctacatctccagcacctaaaggaaagcttggca

SEQ ID NO: 15009 - DNA, 201 bp, Homo sapiens; identical to SEQ ID NO: 2136

SEQ ID NO: 15010 - DNA, 201 bp, Homo sapiens
acctggtctgtgtcttaagagaccaggctgcagcagcagtggcccaggcagtggctggggcagacctctgtgaggatgaggaggtgtggaggttcctatgwcagagctagatgaaggcctgctggctgcttggcgtttgctctcctatctgcaatctgcagacttgtccccttcctaaccgtagaggcctcccctgtaatc

SEQ ID NO: 15011 - DNA, 201 bp, Homo sapiens; identical to SEQ ID NO: 2137

SEQ ID NO: 15012 - DNA, 201 bp, Homo sapiens
agagtggctggtgaccttgatgaggacagcctgagtggggacacagaggccagaacagaacagagtggactgaggagcaaagggaggtaccaagcagggcrgtctgtggggttcctggatgcagctggattggtttgctgctcaaagaaaatcccagctcagacctactctaggacagaagaggccttcatgaaagatgcc

SEQ ID NO: 15013 - DNA, 201 bp, Homo sapiens
ctttgtggctgctgcccctggggccactgccaccactgctgctcctgctgcagctccagccaaggctgaagccaagaagagttggaggagttggatgagamtatgggatttggcctatttgactaatcaccaaaaggcaaccaactcagccagctttatttgcaaaacaaagaaatgaaggcttacttctttcaaaaaaaa

SEQ ID NO: 15014 - DNA, 201 bp, Homo sapiens; identical to SEQ ID NO: 2139

SEQ ID NO: 15015 - DNA, 201 bp, Homo sapiens
ggagttacagcagcgaaccagatacacagaatccctgcctcccagagctcacatgaggaggaagacagacaaaaagcaactcagcaaatgcataaataagmaattgaagaaaatgaaacaaaatgaccagggaagaggggtgctctttagctcgggtaatgtggaaaggccgatctgaggtgagagcaacagaaatgatgg

SEQ ID NO: 15016 - DNA, 201 bp, Homo sapiens
tttaaaccctgcatggcaacccctgacacactgccaggctgcccagggaatacagggcaacctggaagtccaactacttccttcagatcatccaatttttyaatcattatctgaaatgtttcattgtagaagcagcaatgtgggctccaagtagatgcagcagatccacatgtccctctgagggaaagccatggtgccaat

SEQ ID NO: 15017 - DNA, 201 bp, Homo sapiens; identical to SEQ ID NO: 2141

SEQ ID NO: 15018 - DNA, 201 bp, Homo sapiens
aggtaagaagaccaggggctcagttttgaacctgtcaattttgagacgcatacagaataaccaagcagagatacaaagtaagcacttacatctatgagtcrggagcgcgggaaaaattcaggaatggagatctacacttgggagccatcatcgtaggggtagcattctagctttggggtgtatagatcatccagtgacaga

SEQ ID NO: 15019 - DNA, 201 bp, Homo sapiens; identical to SEQ ID NO: 2142

SEQ ID NO: 15020 - DNA, 201 bp, Homo sapiens; identical to SEQ ID NO: 2143

SEQ ID NO: 15021 - DNA, 201 bp, Homo sapiens
gctcccagcctgattataatcttcatgcctgagtcagatgaagagcaacccaactgcttggcaaaagatacgtactagcttcatgttggtctgagcggggrcattgcattctgggcagtttgtgctgaactggagcacctggaacacaacatgaggacaaagggtgagccctcccagatgggatgttcaggctaaagacac

SEQ ID NO: 15022 - DNA, 201 bp, Homo sapiens
cctagtccctctccacagcgttttcggccacccaggcacggaaaggcttctgggactacttcagccagaccagcggggacaaaggcagggtggagcagatmcatcagcagaagatggctcgcgagcccgcgtgagtgcccaggggaaggggtgtaggcgaagggaggagacagctgggccatgccatgatgacctgcctct

SEQ ID NO: 15023 - DNA, 201 bp, Homo sapiens
ggagagcccaggccctgattacctagtccctctccacagcgttttcggccacccaggcacggaaaggcttctgggactacttcagccagaccagcggggamaaaggcagggtggagcagatccatcagcagaagatggctcgcgagcccgcgtgagtgcccaggggaaggggtgtaggcgaagggaggagacagctgggcc

SEQ ID NO: 15024 - DNA, 201 bp, Homo sapiens
tcaacgtgggggtgtgggtggaggctggccagagggccctgtccaccctgggggaggagagcccaggccctgattacctagtccctctccacagcgttttsggccacccaggcacggaaaggcttctgggactacttcagccagaccagcggggacaaaggcagggtggagcagatccatcagcagaagatggctcgcgag

SEQ ID NO: 15025 - DNA, 201 bp, Homo sapiens
gcaagcatggctgccgtgctcacctgggctctggctcttctttcaggtgggtctccgaccctgacttcaacgtgggggtgtgggtggaggctggccagagkgccctgtccaccctgggggaggagagcccaggccctgattacctagtccctctccacagcgttttcggccacccaggcacggaaaggcttctgggactac

SEQ ID NO: 15026 - DNA, 201 bp, Homo sapiens; identical to SEQ ID NO: 2147

SEQ ID NO: 15027 - DNA, 201 bp, Homo sapiens; identical to SEQ ID NO: 2148

SEQ ID NO: 15028 - DNA, 201 bp, Homo sapiens; identical to SEQ ID NO: 2149

SEQ ID NO: 15029 - DNA, 201 bp, Homo sapiens; identical to SEQ ID NO: 2150

SEQ ID NO: 15030 - DNA, 201 bp, Homo sapiens; identical to SEQ ID NO: 2151

SEQ ID NO: 15031 - DNA, 201 bp, Homo sapiens; identical to SEQ ID NO: 2152

SEQ ID NO: 15032 - DNA, 201 bp, Homo sapiens; identical to SEQ ID NO: 2153

SEQ ID NO: 15033 - DNA, 201 bp, Homo sapiens; identical to SEQ ID NO: 2154

SEQ ID NO: 15034 - DNA, 201 bp, Homo sapiens; identical to SEQ ID NO: 2155
  misc_feature (1)...(201): n = A,T,C or G, or insertion/deletion polymorphism (see Tables 1-2)

SEQ ID NO: 15035 - DNA, 201 bp, Homo sapiens; identical to SEQ ID NO: 2156

SEQ ID NO: 15036 - DNA, 201 bp, Homo sapiens; identical to SEQ ID NO: 2157

SEQ ID NO: 15037 - DNA, 201 bp, Homo sapiens
ttgcccctgcagaggccccctgggcaagtcccctgcgccatgtcccttcgtctccttcttcccctaaccaggcctccctccacctgtcttctcagagcagrtaatggcaagcatggctgccgtgctcacctgggctctggctcttctttcaggtgggtctccgaccctgacttcaacgtgggggtgtgggtggaggctggc

SEQ ID NO: 15038 - DNA, 201 bp, Homo sapiens
gctgcctggatcctgtgctctacttgctcactggggacaaatatcgacgtcagctccgtcagctctgtggtggtggcaagccccagccccgcacggctgcytcttccctggcactagtgtccctgcctgaggatagcagctgcaggtgggcggccaccccccaggacagtagctgctctactcctagggcagatagattgt

SEQ ID NO: 15039 - DNA, 201 bp, Homo sapiens
gcagtttggttggtcgtagccggctgcctcgtgcccaacctgttctttgtcacaaccagcaacaaagggaccaccgtcctgtgccatgacaccactcggcytgaagagtttgaccactatgtgcacttcagctcggcggtcatggggctgctctttggcgtgccctgcctggtcactcttgtttgctatggactcatggct

SEQ ID NO: 15040 - DNA, 201 bp, Homo sapiens
cgctggggccgccctcgcctcgcaggccttctctgcctggcagtttggttggtcgtagccggctgcctcgtgcccaacctgttctttgtcacaaccagcamcaaagggaccaccgtcctgtgccatgacaccactcggcctgaagagtttgaccactatgtgcacttcagctcggcggtcatggggctgctctttggcgtg

SEQ ID NO: 15041 - DNA, 201 bp, Homo sapiens
cctgggcatctgccacccacttcgggcactacgctggggccgccctcgcctcgcaggccttctctgcctggcagtttggttggtcgtagccggctgcctcrtgcccaacctgttctttgtcacaaccagcaacaaagggaccaccgtcctgtgccatgacaccactcggcctgaagagtttgaccactatgtgcacttcag

SEQ ID NO: 15042 - DNA, 201 bp, Homo sapiens
ctataatacatgggtggaagaaatatttttaggtccttacccaccctcattctgtacacccggatgatatccccaaccagaccttccagttagaaaatgakgatcagatgtctgcatgaggaaggagtgggttattcagtaaaaggttgtagcagacagaattgcttaccaactcaatagtcatctccctcttcctccttg

SEQ ID NO: 15043 - DNA, 201 bp, Homo sapiens
atggccagtacagagtcctccctgttgagatccctaggcctcagcccaggtcctggcagcagtgaggtggagctggactgttggtttgatgaggatttcargttcatcctgctgcctgtgagctatgcagttgtctttgtgctgggcttgggccttaacgccccaaccctatggctcttcatcttccgcctccgaccctgg

SEQ ID NO: 15044 - DNA, 201 bp, Homo sapiens
cagctcggcggtcatggggctgctctttggcgtgccctgcctggtcactcttgtttgctatggactcatggctcgtcgcctgtatcagcccttgccaggckctgcacagtcgtcttctcgcctccgctctctccgcaccatagctgtggtgctgactgtctttgctgtctgcttcgtgcctttccacatcacccgcaccat

SEQ ID NO: 15045 - DNA, 201 bp, Homo sapiens
aacgtggtctataaagtgactcggcccctggccagtgccaacagctgcctggatcctgtgctctacttgctcactggggacaaatatcgacgtcagctccrtcagctctgtggtggtggcaagccccagccccgcacggctgcctcttccctggcactagtgtccctgcctgaggatagcagctgcaggtgggcggccacc

SEQ ID NO: 15046 - DNA, 201 bp, Homo sapiens
ttggcgtgccctgcctggtcactcttgtttgctatggactcatggctcgtcgcctgtatcagcccttgccaggctctgcacagtcgtcttctcgcctccgmtctctccgcaccatagctgtggtgctgactgtctttgctgtctgcttcgtgcctttccacatcacccgcaccatttactacctggccaggctgttggaag

SEQ ID NO: 15047 - DNA, 201 bp, Homo sapiens
cgtcagctccgtcagctctgtggtggtggcaagccccagccccgcacggctgcctcttccctggcactagtgtccctgcctgaggatagcagctgcaggtrggcggccaccccccaggacagtagctgctctactcctagggcagatagattgtaacacgggaagccgggaagtgagagaaaaggggatgagtgcagggca

SEQ ID NO: 15048 - DNA, 201 bp, Homo sapiens
ctctgtggtggtggcaagccccagccccgcacggctgcctcttccctggcactagtgtccctgcctgaggatagcagctgcaggtgggcggccaccccccrggacagtagctgctctactcctagggcagatagattgtaacacgggaagccgggaagtgagagaaaaggggatgagtgcagggcagaggtgagggaaccc

SEQ ID NO: 15049 - DNA, 201 bp, Homo sapiens
cctggtcactcttgtttgctatggactcatggctcgtcgcctgtatcagcccttgccaggctctgcacagtcgtcttctcgcctccgctctctccgcaccrtagctgtggtgctgactgtctttgctgtctgcttcgtgcctttccacatcacccgcaccatttactacctggccaggctgttggaagctgactgccgagt

SEQ ID NO: 15050 - DNA, 201 bp, Homo sapiens; identical to SEQ ID NO: 2187

SEQ ID NO: 15051 - DNA, 201 bp, Homo sapiens
caacctggaggcacagctgctccaggtgcgcgcggacgcagagcgccagaacgtggaccaccagcggctgctgaatgtcaaggcccgcctggagctggagrttgagacctaccgccgcctgctggacggggaggcccaagggtgagcagacaacggaggctgtaaacaccttcaggggctgaccaagagtgggcagcagaa

SEQ ID NO: 15052 - DNA, 201 bp, Homo sapiens
gggaatacaggcaacagactaatttggagaagaaaaattccttatgacaagcagactctactccacccagctttctttttcatataacaaatatttaatgraaatgattattcgattatttctgtatcaatgaattttcattatacataaatcattcacttgttgagctggccaaaaacctggggggaggatccaattttg

SEQ ID NO: 15053 - DNA, 201 bp, Homo sapiens; identical to SEQ ID NO: 2195

SEQ ID NO: 15054 - DNA, 201 bp, Homo sapiens; identical to SEQ ID NO: 2184

SEQ ID NO: 15055 - DNA, 201 bp, Homo sapiens; identical to SEQ ID NO: 2185

SEQ ID NO: 15056 - DNA, 201 bp, Homo sapiens
taatatctggatatgcaggtggacaggaggcagcagtaaactacggggaatctaggctacaggtctggaattcctcaggagtcagtctgtactctacaagrcaaaacaagtgctaaccattgagactaactccaatgagataaaggccagcgaaagaagcattctcaggagaaagggctcccagggaaggtggagcagcag

SEQ ID NO: 15057 - DNA, 201 bp, Homo sapiens; identical to SEQ ID NO: 2186

SEQ ID NO: 15058 - DNA, 201 bp, Homo sapiens
catagtagccacctgaaccacctactctaacaagctttccaaaagtgatcagagtctgcactagttggaagaactcaggcctacaaattgggaaatctaayttctcagaccagatcttccattaaaagccaggttgtttcactttttgaggtcatctcctttgttttcttacagtgatggtttggaggaaagtttatttgt

SEQ ID NO: 15059 - DNA, 201 bp, Homo sapiens
tttttttttttctcccagacccaaaaattacaatttcaaatttagaaatctggagtcaggacaagtatggagaatacattgtctccctgttaaaatggccrtttgttttagatttctgtgtgatgtgtgtggtatgtgtgtgtgtgatgtgtgtgtggtggtagtggtgatggtggttcctgctaaggctcaacaaatttg

SEQ ID NO: 15060 - DNA, 201 bp, Homo sapiens; identical to SEQ ID NO: 2188

SEQ ID NO: 15061 - DNA, 201 bp, Homo sapiens
atacaggcaacagactaatttggagaagaaaaattccttatgacaagcagactctactccacccagctttctttttcatataacaaatatttaatggaaaygattattcgattatttctgtatcaatgaattttcattatacataaatcattcacttgttgagctggccaaaaacctggggggaggatccaattttgagtg

SEQ ID NO: 15062 - DNA, 201 bp, Homo sapiens
actgctttgcacttggttttcaggtatgagaatgaactggccctgcgccagggcgtagaggccgacatcaatggcctgcgccgggtgctggacgagctgaycctgaccaggaccgacctggagatgcagatcgagagcctgaacgaggagctggcctacatgaagaagaaccacgaggatgtgagtcagacagggcagcct

SEQ ID NO: 15063 - DNA, 201 bp, Homo sapiens
aggacaagtatggagaatacattgtctccctgttaaaatggccatttgttttagatttctgtgtgatgtgtgtggtatgtgtgtgtgtgatgtgtgtgtgktggtagtggtgatggtggttcctgctaaggctcaacaaatttgaggcactttctgattttgtcattttcattataaggcaatgacaataggaatgctaac

SEQ ID NO: 15064 - DNA, 201 bp, Homo sapiens
tggttttcaggtatgagaatgaactggccctgcgccagggcgtagaggccgacatcaatggcctgcgccgggtgctggacgagctgaccctgaccaggacygacctggagatgcagatcgagagcctgaacgaggagctggcctacatgaagaagaaccacgaggatgtgagtcagacagggcagcctcactcagctactt

SEQ ID NO: 15065 - DNA, 201 bp, Homo sapiens
tatggagaatacattgtctccctgttaaaatggccatttgttttagatttctgtgtgatgtgtgtggtatgtgtgtgtgtgatgtgtgtgtggtggtagtrgtgatggtggttcctgctaaggctcaacaaatttgaggcactttctgattttgtcattttcattataaggcaatgacaataggaatgctaacagtcctaa

SEQ ID NO: 15066 - DNA, 201 bp, Homo sapiens
acttctcaatattattttatacagatattgtcttagaaaaatgaaactgtcttaaactctaaataaaacagcatttaatatcaccattttcacctttgtgycaaaaatatatttgtataatactagtcttttagggcttcaatcttgtgtgtgtccctctcttttgccagatcatttcagccagcattggaaatgcccagc

SEQ ID NO: 15067 - DNA, 201 bp, Homo sapiens
tagctttctggcttgctggcacaacttcctctccagttgtggccaccttccccaggccatggatctctccaacaacaccatgtcactctcagtgcgcaccyccggactgtcccggcggctctcctcgcagagtgtgataggcagacccaggggcatgtctgcttccagtgttggaagtggttatgggggaagtgcctttgg

SEQ ID NO: 15068 - DNA, 201 bp, Homo sapiens
atttagaaatctggagtcaggacaagtatggagaatacattgtctccctgttaaaatggccatttgttttagatttctgtgtgatgtgtgtggtatgtgtstgtgtgatgtgtgtgtggtggtagtggtgatggtggttcctgctaaggctcaacaaatttgaggcactttctgattttgtcattttcattataaggcaat

SEQ ID NO: 15069 - DNA, 201 bp, Homo sapiens; identical to SEQ ID NO: 2193

SEQ ID NO: 15070 - DNA, 201 bp, Homo sapiens
cactccactttatcatttactaagaaatgattgtatttccattatctttctgtaggaaatctgcatttctttacttctcaatattattttatacagatatygtcttagaaaaatgaaactgtcttaaactctaaataaaacagcatttaatatcaccattttcacctttgtgtcaaaaatatatttgtataatactagtct

SEQ ID NO: 15071 - DNA, 201 bp, Homo sapiens
ctggcacaacttcctctccagttgtggccaccttccccaggccatggatctctccaacaacaccatgtcactctcagtgcgcacccccggactgtcccggyggctctcctcgcagagtgtgataggcagacccaggggcatgtctgcttccagtgttggaagtggttatgggggaagtgcctttggctttggagccagctg

SEQ ID NO: 15072 - DNA, 201 bp, Homo sapiens; identical to SEQ ID NO: 2194

SEQ ID NO: 15073 - DNA, 201 bp, Homo sapiens
gaggggtggcgtgacctgtggatactgaggaagcgtcggtgacaggaagaggggtggtgtgacctgtggatgctgaggaagggctagtgacaggaagaggsgtggtgtcacctgtggatgctgaggaaaggctggtgacaggaagagaggtggcgtgacctgtggatactgaggaagcgtcggtgacatgaagaggggtgg

SEQ ID NO: 15074 - DNA, 201 bp, Homo sapiens
gatgaagctgatatgtcctgattagaggtccttgaagaagctgcagttgattgtccctctagtgtcgctgttgttgagcctgttgaggtgactggggcagsagttttacttccagttattaatgtgtcctctgtggttcctggagtgaaccaaaataggcaagcagagagctaaatcatgaatgaactcctattcacaatt

SEQ ID NO: 15075 - DNA, 201 bp, Homo sapiens
gtttgctttgccacatcctccccgtcgctttgactactgcggcagcctcctcactgcccctgctgactcgggttccgcacccctgctctcagcctccaccrcacccctgctctcagcctccaccgcacccctgtgggttgatcctcagctctgagggccaggagggagggttgctgctgctgtctccttagctcgaattgc

SEQ ID NO: 15076 - DNA, 201 bp, Homo sapiens
aaaaccaaacactgcatgttttcactcataagttggagttgaacaatgagaacacatggacacagagaggggaacaacacacactggcgcctgtcagggaygggacaaggggaggaagagcgtcaggataaatagctaatacatgcaggtgatgggttgataggtgcagtaaaccaccatggcacatatatacctgtgtaa

SEQ ID NO: 15077 - DNA, 201 bp, Homo sapiens
ggagacattgttcagttttgtagccggcagcttaaattcaaaatgcattttaaacatgttttcccctttctcttgggtttccaaatacaaccttgaggcarctgcaaaggccgttttcctcagcctaaaaatagacttcacgcccctcccttttctcacgatctgtacacactccctccctcttctcaccgtctgtacaca

SEQ ID NO: 15078 - DNA, 201 bp, Homo sapiens
tcaagatgaggaaagacactaactcaagatacccttggaataactgatctcttgtgatctccagagcctgaaacgagacttggcatacagcagtgacttcrtacacatctgtggaatacatcccaggccctgtggcctttgttgccttcagccgaggctggagagagggtgacgttgcctgtttctttatctttatctttt

SEQ ID NO: 15079 - DNA, 201 bp, Homo sapiens
gatgcacctcccctactctctggccattcgaaatgcagctctcagcacaccctgtacttttccacactgcatttaccacatgtgcagttgagaacatttcygtaattatttgatgtctgtctgcaccaagattttagtgccaagagactgggccacgtctgtttcactcttcactgtgtgcatccagtgctgtgtcctaga

SEQ ID NO: 15080 - DNA, 201 bp, Homo sapiens
ggcggggcggcatctctacagagagtcgatgtctgtcctctgtggtccctaaacacatacacggggagtggagctgcgggcaacccaggccagtgcccttyctccaagcagggccgccattgcaaggcctcacgtgcaacacaaatgcccagttcctgagacttcttcagaatctccaggaaaagggtgaaaaggcattta

SEQ ID NO: 15081 - DNA, 201 bp, Homo sapiens
ctgacatataaaccaatggaacagaatagataccttggaaataagaccacacatctacaaccatctgatctttgacaaacctgacaaaagcaggcaatggkgaaaggattctctattcaataaatggtgctgggaaaactggttagccatatgcagaaaactgaaactggaccccttccttacaccttatacaaaaattaa

SEQ ID NO: 15082 - DNA, 201 bp, Homo sapiens
ggtcatgcccggtcagatgtgtgggtgccatctcccagccacgaccatctcctctcctggcccagctccacttggtccccttagcgacgcaaaggactcagcgctccacgacatgcctagcttcttcgggtcgtcatggagacgcccttgcacaccaacagtccttcactccttctccgggtcacgcccccgtgcttttcc

SEQ ID NO: 15083 - DNA, 201 bp, Homo sapiens
agccacgaccatctcctctcctggcccagctccacttggtccccttagcgacgcaaaggactcagcgctccacgacatgcctagcttcttcgggtcgtcayggagacgcccttgcacaccaacagtccttcactccttctccgggtcacgcccccgtgcttttccacgcccaccccaggtcttgcccctctgcgctcctct

SEQ ID NO: 15084 - DNA, 201 bp, Homo sapiens
ccgttcaccactgctttttacacaggggaccggggccctggggagacacggggcagggcctggtcacaggggccagaacagttcacggcaaagacttggcmctggggctcctaaatccaagctgcctccccggcgccccaagccccagcctcgctctgggagtcatgattcccgtggagactccttcaaccacatctgcag

SEQ ID NO: 15085 - DNA, 201 bp, Homo sapiens
acttggtcctgaagccagagggacagcctggaaagtgtggggaagaggacgggggcccccgagggaacatctcccacaggcctggcatccctcccctcccrgctctgtacacggaggagcccaaggccaatgccggggctacgagccccaggcaaggccgtgacccaaatggaggcttttaaacccgagctcagaggtaag

SEQ ID NO: 15086 - DNA, 201 bp, Homo sapiens
aaaagtatgagagtacagaaatgtgattttgggtatggaagggatgaaacaagcctatggttatttgcagataacataattgtttacatagaaacttcccraacatatacattattagcaaagttctatatccataatcaaaattttaaaaataattgcattccagctgggtgtggtgattcatgcctgaatcccagtgct

SEQ ID NO: 15087 - DNA, 201 bp, Homo sapiens
aatcctaagcaaaaagaacaaagtgggaggctacctgacttcaaactatactacaaggctacagtaaccaaaacagcatggtactggtaccaaaactgacrtataaaccaatggaacagaatagataccttggaaataagaccacacatctacaaccatctgatctttgacaaacctgacaaaagcaggcaatggtgaaag

SEQ ID NO: 15088 - DNA, 201 bp, Homo sapiens
aagctttcttccttccttctgttcatgctaacaacagtcccccagacatccagcccagaaagctgtgggtcctctggatttctttctcttccttgtccccygtgtcctagtcagtactcgttgatcttcctcccaagtgttcaccccatcgcgtcctcttgtttgctttgccacatcctccccgtcgctttgactactgcg

SEQ ID NO: 15089 - DNA, 201 bp, Homo sapiens
tgaggaaaggctggtgacaggaagagaggtggcgtgacctgtggatactgaggaagcgtcggtgacatgaagaggggtggtgtcacctgtggatgctgagktagtgtcggtgacaggaagaggggtggtgtcacctgtggatactgaggaagcgtcggtgacaagaagagaggtggcgtgacctgtggacactgaggaagc

SEQ ID NO: 15090 - DNA, 201 bp, Homo sapiens
tcgctttgactactgcggcagcctcctcactgcccctgctgactcgggttccgcacccctgctctcagcctccaccacacccctgctctcagcctccaccrcacccctgtgggttgatcctcagctctgagggccaggagggagggttgctgctgctgtctccttagctcgaattgctttggaaaatggcctgccctgcct

SEQ ID NO: 15091 - DNA, 201 bp, Homo sapiens
gaggaaaggctggtgacaggaagagaggtggcgtgacctgtggatactgaggaagcgtcggtgacatgaagaggggtggtgtcacctgtggatgctgagtwagtgtcggtgacaggaagaggggtggtgtcacctgtggatactgaggaagcgtcggtgacaagaagagaggtggcgtgacctgtggacactgaggaagcg

SEQ ID NO: 15092 - DNA, 201 bp, Homo sapiens
agattagcattcgttacgacaaaactacagttattgcatttgtctttcaccatcatttaaacaatacctctgaagccactcctgcaatagattgattattyagctgtttaggaaaacaatttgcagataactcaatctactaagcttgagtaggttatttgtaggtaagaaatcctgtgttcaagtatgacctatctttac

SEQ ID NO: 15093 - DNA, 201 bp, Homo sapiens; identical to SEQ ID NO: 2205

SEQ ID NO: 15094 - DNA, 201 bp, Homo sapiens; identical to SEQ ID NO: 2207

SEQ ID NO: 15095 - DNA, 201 bp, Homo sapiens; identical to SEQ ID NO: 2208

SEQ ID NO: 15096 - DNA, 201 bp, Homo sapiens; identical to SEQ ID NO: 2197

SEQ ID NO: 15097 - DNA, 201 bp, Homo sapiens
gaatctccaggaaaagggtgaaaaggcatttaaacctctatgaagtagggccaggcacagtagctcacgcctataatcccagcactttgggagccgaggcragcggatcacctgaggtcaggagttcgagaccagcctggccaacatggtgaaaccccatctctactaaaaatacaaacattagccgctgtggtgttgggc

SEQ ID NO: 15098 - DNA, 201 bp, Homo sapiens; identical to SEQ ID NO: 2206

SEQ ID NO: 15099 - DNA, 201 bp, Homo sapiens
ccgtctctactaaaaatacaaaaaaattagccgggcgtggtggcgggcgcctgtagtcccagctactcgggaggctgaggcaggagaatggcgtgaacccggggaggcggagcttgcagtgagccgagattgcaccactgcactcctgcctgggtgacagagtgagactccgtctcaaaaaaaaaattaaaaattaaaaaa

SEQ ID NO: 15100 - DNA, 201 bp, Homo sapiens
ccttaatacatcttactttatgcccgttctgtgtgttgctagtatgtatgtgtgacactgtgtgtgtgtgtgtgtgtgtgtgtgtgtgtgtgtgtgtgtgwgagacactgtgtgtgtgtgtccctgcccttatagaacattggacatagcctttaaacatttttttttccagatggagtttcacttcttgttgcccaggct

SEQ ID NO: 15101 - DNA, 201 bp, Homo sapiens
taaagccctgatgactatcttcgtgtctaatgttttgtttacattatttcagctcatctccttaacataaatttctatcagtggaattgctggtttatgcygttataaaatttttcatgttattaatacagactgccaaatttctttgcagaaagcttatgccaatttacagacctgttggcagtgtgcaagagtgtgcct

SEQ ID NO: 15102 - DNA, 201 bp, Homo sapiens
gcgggtggatcatttgaggtcaggagttcaagaccagcctggccaacatgatgaaaccccatctctactaaaaatacaaaaattacccaggcatggtggcrtgcacctgtaatcccagctactcaggaggctgaggcaggagaatctctcaaacctgggaggtggaggttgcagtgagccgagatcgcgccactgcactcc

SEQ ID NO: 15103 - DNA, 201 bp, Homo sapiens
tgggggacagagagaaactctgtctcaaaaaacaaacaaacaaacccaaaaaaccaacaacaacagcaacaataaaaaaaccgtctatgaagaaatcgtckatgaggtgccaacagactcagttattttgactcaatttctcagaacatgctggggcgggaactcagcctagcagtaagaaagacgtatatttaaggtaaa

SEQ ID NO: 15104 - DNA, 201 bp, Homo sapiens
gggcatggtagctcatgcctaaaatcccagcacggacaggcagaggcgggaggattccttgaggccaggagtttgagaccagcctgggcaatagctcaagrccccttctctgaaaaaaaaaaaaaaaaaaaaagtggttctcaaaaggcagagggtgcatcagcattttaacacatgtccagagtgattctgatgcaggtg

SEQ ID NO: 15105 - DNA, 201 bp, Homo sapiens
taaaaaatactcatagccttgttcttgctgctcaagtgttggccagaatgaactgaccttggctctcaccaggatgcaagtcaggcccttcagattccgtsagattgtcagacaactgaaacttgttctcactctggccaaacgcataaacttggggagcagagagctgggagatttgcgcctaaagagttgatattggag

SEQ ID NO: 15106 - DNA, 201 bp, Homo sapiens
caaacgcataaacttggggagcagagagctgggagatttgcgcctaaagagttgatattggagagaaacaggtctctcctctctcttctctccccgtgacmctccattttctacttcactgaaagaaccaaagccgtgcccttcatctccttcaatgcccagagccttctccgcaccctccccggggccccggggctccct

SEQ ID NO: 15107 - DNA, 201 bp, Homo sapiens; identical to SEQ ID NO: 2200

SEQ ID NO: 15108 - DNA, 201 bp, Homo sapiens
gggctagtgacaggaagaggcgtggtgtcacctgtggatgctgaggaaaggctggtgacaggaagagaggtggcgtgacctgtggatactgaggaagcgtyggtgacatgaagaggggtggtgtcacctgtggatgctgagttagtgtcggtgacaggaagaggggtggtgtcacctgtggatactgaggaagcgtcggtg

SEQ ID NO: 15109 - DNA, 201 bp, Homo sapiens
tccctgggctgccaagggcgtcgctgatgctggacctctgagtttcagcccctgctcttccctgtgcaccttgctggtcgttggccaaaatttggctgatkttcctggcaggacctcttgtccagggatcctttccttttgagtgtcctggagcacagtggggtttcccagaggggcagaggggtctgtggagagttttgg

SEQ ID NO: 15110 - DNA, 201 bp, Homo sapiens
ccaggacggccaggcttccttctgagtcattcctgcctggggcgaccagtagacaccaaatttccatctgtccttgtctagcccacctctgtctgctgtgycttatcctttaacccttgagagccagggctgttccttaaggaaaccctcattgcggcagctcctttgtggaaaccctgtgtttttcctctggcctgggct

SEQ ID NO: 15111 - DNA, 201 bp, Homo sapiens
ctgtgccaatctggtaaaaaacccaaggggtaaatgcatatactcttgccctggtcacagactaccaagaagctaatattattgaccataaccactttttwaaaaaaaattatttcccaggcagaggccaggcatggtggctcatgtctgtaatcccagcattttgggaggccaaggtgggaggatcactcgaggccagga

SEQ ID NO: 15112 - DNA, 201 bp, Homo sapiens
agccaatggtcttctccagctcccgcctgtcttccttgtgaggaggaaggtgaggttagactagaatggtgaattaactgtgttaaactccatgggaagargcaaacagtacccctgctataagccgggttaactctctcaacttgaattatagcattatctttcttaaaaataaattaaatttctacttttctttttcgt

SEQ ID NO: 15113 - DNA, 201 bp, Homo sapiens
ctatgttgcctaggctggtgtcgaactcccggcctcaagcgatcctcctgcttcagactctcaaagtactgggattaaaggtgtgagccaccgctcccacyctttttttcaacctcagtgctcctagatagttggcaagatgatactcagagagacaaagtctcagggaagaattcagcttcaagtccactttctggaatt

SEQ ID NO: 15114 - DNA, 201 bp, Homo sapiens; identical to SEQ ID NO: 2204

SEQ ID NO: 15115 - DNA, 201 bp, Homo sapiens; identical to SEQ ID NO: 2203

SEQ ID NO: 15116 - DNA, 201 bp, Homo sapiens
tttttttaaagtaaagatttttgtagttctttataaaagtggcacagctccatttcagcaatatggaagaagagataagcctctaatagcaaaaccagccratgccagataaatacaggttataaatgtaataaatgttttctaatgcagaggtgagatgagaagaaagaaagggaaacactcaggagtgaagaagttaac

SEQ ID NO: 15117 - DNA, 201 bp, Homo sapiens
tgctgactgaaaggctgaaaaaggaaaggaagcaagaccctcggtcacgacactgaactgagtttccctgcaaaaagctggaaccgccagcaaaaaaggtrgactagaaagaccaggaagaaaaaagaaaaaggaagcagaatgaaggatatagtaacagaccagaactcactatagaaacaattaaaaatggaataaatg

SEQ ID NO: 15118 - DNA, 201 bp, Homo sapiens
agcagaatgaaggatatagtaacagaccagaactcactatagaaacaattaaaaatggaataaatgaagccaaagattagttctttgaaaataaaacaaayacctggcaagagaaagaaagtgggggggggtgtgggaggagggagagagagagacagaaaagacacagatatcaagattattagaaacaaaaaagggtac

SEQ ID NO: 15119 - DNA, 201 bp, Homo sapiens; identical to SEQ ID NO: 2198

SEQ ID NO: 15120 - DNA, 201 bp, Homo sapiens; identical to SEQ ID NO: 2202

SEQ ID NO: 15121 - DNA, 201 bp, Homo sapiens
atcactcgaggccaggagtttgagaccagcctgggcaagatagcgagaccctgtgtcttaaaaaataaaaataataataataataataaaaatagatattwaataaagaaaaatatttcccaggcagaatgtttaaatattggctttttttgtttaaaatatttcacagcacctgcactagccacataccatcttcgtgaa

SEQ ID NO: 15122 - DNA, 201 bp, Homo sapiens
gtgaaggctgttgacaccttaaggtgacaagatcactgtgagaagacacacgtgtgtcattgagtaaaacggatagtttttaagacattctctcagaggargagtctccatccagggacgaggagggcactggcgttggcactgaggtagagacgttccccacatctgagtccttgaaggctctgtcaagcctctgccatc

SEQ ID NO: 15123 - DNA, 201 bp, Homo sapiens
cagacgctgaaccgctggccccaccgcctttggcagggagctaatgctatttgtgtatcagcccagaatcaactgtgaccagggttgtgtccactgggtayttccctagaattcaagatgaggaaagacactaactcaagatacccttggaataactgatctcttgtgatctccagagcctgaaacgagacttggcataca

SEQ ID NO: 15124 - DNA, 201 bp, Homo sapiens
agcccagaatcaactgtgaccagggttgtgtccactgggtatttccctagaattcaagatgaggaaagacactaactcaagatacccttggaataactgayctcttgtgatctccagagcctgaaacgagacttggcatacagcagtgacttcatacacatctgtggaatacatcccaggccctgtggcctttgttgcctt

SEQ ID NO: 15125 - DNA, 201 bp, Homo sapiens
gaccagggttgtgtccactgggtatttccctagaattcaagatgaggaaagacactaactcaagatacccttggaataactgatctcttgtgatctccagmgcctgaaacgagacttggcatacagcagtgacttcatacacatctgtggaatacatcccaggccctgtggcctttgttgccttcagccgaggctggagag

SEQ ID NO: 15126 - DNA, 201 bp, Homo sapiens
ttcatacacatctgtggaatacatcccaggccctgtggcctttgttgccttcagccgaggctggagagagggtgacgttgcctgtttctttatctttatcttttttttttttttgagatggagtctcgctctgtcgcccaggcaggagtgcagtggtgcgatctcagctcactgtaacctccacctcccaggttcaagtcc

SEQ ID NO: 15127 - DNA, 201 bp, Homo sapiens
agctgcgggcaacccaggccagtgccctttctccaagcagggccgccattgcaaggcctcacgtgcaacacaaatgcccagttcctgagacttcttcagartctccaggaaaagggtgaaaaggcatttaaacctctatgaagtagggccaggcacagtagctcacgcctataatcccagcactttgggagccgaggcaag

SEQ ID NO: 15128 - DNA, 201 bp, Homo sapiens
tcatacacatctgtggaatacatcccaggccctgtggcctttgttgccttcagccgaggctggagagagggtgacgttgcctgtttctttatctttatcttttttttttttttgagatggagtctcgctctgtcgcccaggcaggagtgcagtggtgcgatctcagctcactgtaacctccacctcccaggttcaagtccc

SEQ ID NO: 15129 - DNA, 201 bp, Homo sapiens
ttacaggcgctcgccaccacgcccggcaaaattttttatttttagtggagacagggttggccaagctggtcttgaactcctgacctcaggtgatccacccrcctgggcctccaaaagtgctgggattacagcgtgagccaccgcgcccggccctttatgccttttctactttacaccagatgctgtctcgtttcatcctca

SEQ ID NO: 15130 - DNA, 201 bp, Homo sapiens
gcgcccggccctttatgccttttctactttacaccagatgctgtctcgtttcatcctcatgacaaccctacatagtagccccttccccctgggctcagttygccgatgaagagcctaagactccagagccaaaaggcgttgcctgtgttccctgggctgccaagggcgtcgctgatgctggacctctgagtttcagcccct

SEQ ID NO: 15131 - DNA, 201 bp, Homo sapiens
aaccattgtggaagacagtgtggcgattcctcaaggatctagaaccagaaataccatttgacccagcaatcccattactgggtatatgcccaaaggaatakaaatcattctgttataaagatacatgcacacgtatgtttactgcagcactatttacaatagtaaagacatgaaaccaacccaaatgtccatcagtgatag

SEQ ID NO: 15132 - DNA, 201 bp, Homo sapiens
acatttatagttgaaagatcaaaacccataatcttgctaccagacaatgcttccttccaggatgtttttatgctttaaaaaatatatagtttaggccaggmgtggtggctcacacctgtaatcccagcgctttgtgaggctgaggtgggcggatcatgaggtcaggagatcgagaccatcctggctaacagggcgaacccc

SEQ ID NO: 15133 - DNA, 201 bp, Homo sapiens
ggccaggagtggtggctcacacctgtaatcccagcgctttgtgaggctgaggtgggcggatcatgaggtcaggagatcgagaccatcctggctaacagggygaacccccgtctctactaaaaatacaaaaaaattagccgggcgtggtggcgggcgcctgtagtcccagctactcgggaggctgaggcaggagaatggcgt

SEQ ID NO: 15134 - DNA, 201 bp, Homo sapiens
tttattctaaaaaatactcatagccttgttcttgctgctcaagtgttggccagaatgaactgaccttggctctcaccaggatgcaagtcaggcccttcagrttccgtgagattgtcagacaactgaaacttgttctcactctggccaaacgcataaacttggggagcagagagctgggagatttgcgcctaaagagttgat

SEQ ID NO: 15135 - DNA, 201 bp, Homo sapiens
caacagcaaaaacgattttctccagtcctcacgcgtctcatcagttcggccccatccattcattcattcatgaatctgacagatgtgtattgcgccccccsctccacgtgctctccctggccggcggccccgtgccaccacccagcctcaccctcattgaagctgacgggtcctgctccaccgtccacgctcccgggccct

SEQ ID NO: 15136 - DNA, 201 bp, Homo sapiens
agggaaattgagatttgaagagaccgagtgatattatatgccttggaagtagcagggccgggggctcggggtaagagccattgctcggaagctgcgagctkttcagctctgggactgccaccgagtggatggagagctgaggcaaagatggagaaatggtcactgacctgccccaagttcttggactgccacatgcagagg

SEQ ID NO: 15137 - DNA, 201 bp, Homo sapiens
aaagtgctgggattacagcgtgagccaccgcgcccggccctttatgccttttctactttacaccagatgctgtctcgtttcatcctcatgacaaccctacrtagtagccccttccccctgggctcagttcgccgatgaagagcctaagactccagagccaaaaggcgttgcctgtgttccctgggctgccaagggcgtcgc

SEQ ID NO: 15138 - DNA, 201 bp, Homo sapiens
gggaaattgagatttgaagagaccgagtgatattatatgccttggaagtagcagggccgggggctcggggtaagagccattgctcggaagctgcgagcttytcagctctgggactgccaccgagtggatggagagctgaggcaaagatggagaaatggtcactgacctgccccaagttcttggactgccacatgcagaggg

SEQ ID NO: 15139 - DNA, 201 bp, Homo sapiens
atcagcccagaatcaactgtgaccagggttgtgtccactgggtatttccctagaattcaagatgaggaaagacactaactcaagatacccttggaataacwgatctcttgtgatctccagagcctgaaacgagacttggcatacagcagtgacttcatacacatctgtggaatacatcccaggccctgtggcctttgttgc

SEQ ID NO: 15140 - DNA, 201 bp, Homo sapiens; identical to SEQ ID NO: 2199

SEQ ID NO: 15141 - DNA, 201 bp, Homo sapiens
gtggtggcagtttcctttgccctcagcctagtcctgaaacatcccgaggtggaagggtccgcttcaccagcatggcttctcttgcagcctttaaacggcaytcgccttctgactcactcccaggaagctcctcaaatatgcgcccaagaaatattttccctcggcgactgttcttagcctgctgagaggcagggcaggagc

SEQ ID NO: 15142 - DNA, 201 bp, Homo sapiens; identical to SEQ ID NO: 2209

SEQ ID NO: 15143 - DNA, 201 bp, Homo sapiens; identical to SEQ ID NO: 2210

SEQ ID NO: 15144 - DNA, 201 bp, Homo sapiens
atttacataattttgctacaactttaaaaatgtgcctttaatagagattgcttcaatatgttatagcactttccaagagtgtattgttggcaaatgaattmaaatagatttaagagttcaagatatggtaaactatacaatggtatgaggattttaccagaaactgctattctccatgtttgctcttcatctttaacagaa

SEQ ID NO: 15145 - DNA, 201 bp, Homo sapiens; identical to SEQ ID NO: 2212

SEQ ID NO: 15146 - DNA, 201 bp, Homo sapiens
tattttgctattgcaaaagaatatcaccattttatccagctacacacttaacaaatatatcactttaatatctttgtacatactttgtgcagatttgaacyctaccaccagctggaagaaatatcaatgaatcagaaacctgaactgcaattgttcagcattagtaagattaagtgatgtaccagtgaaacagattattat

SEQ ID NO: 15147 - DNA, 201 bp, Homo sapiens
ccctggaccagaattcaagggctccagccctggtataaatagcattggtgaccttgaacaggttaacctgctatttagactttagtttccttgtgtataayacaggaataatatctatatttcatcaatcatcctttcaccaaagagtactagtgcatttgttatgacactaggagatagatatttaaaaactgatgggac

SEQ ID NO: 15148 - DNA, 201 bp, Homo sapiens; identical to SEQ ID NO: 2214

SEQ ID NO: 15149 - DNA, 201 bp, Homo sapiens; identical to SEQ ID NO: 2215

SEQ ID NO: 15150 - DNA, 201 bp, Homo sapiens
accctttaatgagtacacttcatacaatgactaaagagactggcaatattttattttcctgttcctgatggtctcaatcaaaactatttaaagaccttcaraggtaactgagttattttgctattgcaaaagaatatcaccattttatccagctacacacttaacaaatatatcactttaatatctttgtacatactttgt

SEQ ID NO: 15151 - DNA, 201 bp, Homo sapiens
atcggtaaagaaaaattgccactctgattatgccttctgacttggaaaaagaattatagactttccagtgtagagagtactttagatctagactaatagtycttaatgtttatctttgagtcacagaactctctgagactctgacaaaggctacagattctttccccaacataatttgtttacttacataaagctcccatc

SEQ ID NO: 15152 - DNA, 201 bp, Homo sapiens
atgaactggtagataaaaagtttttatgaagctgtaatgtgtttctaatgtttcaataagaacttatcattaattttccctttttctcttgccaacacagrtagattgttagaacactttttaaaaatagaaacaatgcccatggcaaagaaaattcaaacgtcttcttaatagcacattccgcctgcctacaagcttcat

SEQ ID NO: 15153 - DNA, 201 bp, Homo sapiens
gtcacatctgctccagaacagaaatcggtaaagaaaaattgccactctgattatgccttctgacttggaaaaagaattatagactttccagtgtagagagkactttagatctagactaatagttcttaatgtttatctttgagtcacagaactctctgagactctgacaaaggctacagattctttccccaacataatttg

SEQ ID NO: 15154 - DNA, 201 bp, Homo sapiens
acttagctgatgtgtgactacgggaaagcattcaacttctttaaagctcattccttcatctgtaaaagttataagacagtaggatctgtccaatggatcaygtctcttgtgaatattaaaagagatgatgaacgtacattatgagcacaatgcctagctcttagcatgtgctcaattaatggtattactattatttttgtc

SEQ ID NO: 15155 - DNA, 201 bp, Homo sapiens
ccaaagaacataaatagctatatttgtaaatttaaaactaataaatggttatttggcatcaaacactaatatcttgacacttacactatgaactggtagayaaaaagtttttatgaagctgtaatgtgtttctaatgtttcaataagaacttatcattaattttccctttttctcttgccaacacaggtagattgttagaa

SEQ ID NO: 15156 - DNA, 201 bp, Homo sapiens
ctttcaccaaagagtactagtgcatttgttatgacactaggagatagatatttaaaaactgatgggacatagactctttcctcaaggcacttacatttgtrtgcttctccatggtgtatagtaagagtcagagggctttcacagatggacgaagagatgctattatggcaatctcatatatcttagtctgcagtgtttgta

SEQ ID NO: 15157 - DNA, 201 bp, Homo sapiens
cctttttctcttgccaacacaggtagattgttagaacactttttaaaaatagaaacaatgcccatggcaaagaaaattcaaacgtcttcttaatagcacaytccgcctgcctacaagcttcatttgctgcttttgctttctgcactaatggaaagtgaccatacctgactggtaatgggatacagatatatacctagtatc

SEQ ID NO: 15158 - DNA, 201 bp, Homo sapiens
gttcaagatatggtaaactatacaatggtatgaggattttaccagaaactgctattctccatgtttgctcttcatctttaacagaaaaaaaagaaacaatyatgacctgataccctcccttttcatttaagttttaaaaatatgttttcattaatattgtctccagtggataaaactagacatggtgtagccagtcaaaga

SEQ ID NO: 15159 - DNA, 201 bp, Homo sapiens
acactgtcatttgcagtcaaaacaatgttagcatgataaagatgtgttacaatgactcctgattataatacttctttattgagttaaaatgctttgatttstaatgacagagcagtgatagctctgaggtgattatggtgaagggatttaacagttggaagccctgagtaccacctgtcatcacatgatggacttcattgg

SEQ ID NO: 15160 - DNA, 201 bp, Homo sapiens; identical to SEQ ID NO: 2220

SEQ ID NO: 15161 - DNA, 201 bp, Homo sapiens
aaactctgctaagtgctaaattcttgcatttattgttccacagatatcagcagtgacatatttagaagaagatatgcaacacccgcttcagccttggcagragaaagtcttgagaagcgtttaacaaatgaatcatggcagcctccaatagaaaaagaagacaatggcttacaccctcacaggcaaagacattttattaca

SEQ ID NO: 15162 - DNA, 201 bp, Homo sapiens; identical to SEQ ID NO: 2213

SEQ ID NO: 15163 - DNA, 201 bp, Homo sapiens; identical to SEQ ID NO: 2216

SEQ ID NO: 15164 - DNA, 201 bp, Homo sapiens
ctgtttggttggggtaataaaactctgctaagtgctaaattcttgcatttattgttccacagatatcagcagtgacatatttagaagaagatatgcaacamccgcttcagccttggcaggagaaagtcttgagaagcgtttaacaaatgaatcatggcagcctccaatagaaaaagaagacaatggcttacaccctcacag

SEQ ID NO: 15165 - DNA, 201 bp, Homo sapiens; identical to SEQ ID NO: 2218

SEQ ID NO: 15166 - DNA, 201 bp, Homo sapiens; identical to SEQ ID NO: 2219

SEQ ID NO: 15167 - DNA, 201 bp, Homo sapiens
ataaacagaatcccttctgttgatttaagaatatttaataaatatttctgcctcctttgtctcagagttgtggacactggggatagaatgttgaacaggamtaaaaggatgtgttgcctcacagtgctcagttgtagcagaggaggacagtctgcgaacaagcatatgaatgaataaacagaataatacacctcataaggg

SEQ ID NO: 15168 - DNA, 201 bp, Homo sapiens
cagcttaagaggtaaccctttaatgagtacacttcatacaatgactaaagagactggcaatattttattttcctgttcctgatggtctcaatcaaaactayttaaagaccttcaaaggtaactgagttattttgctattgcaaaagaatatcaccattttatccagctacacacttaacaaatatatcactttaatatctt

SEQ ID NO: 15169 - DNA, 201 bp, Homo sapiens
aagttcaaaagctatggaatcttgagcctggagaagtccagcctcaaactctgcaacaccatataataagaacagaaggtgagtttgtcttgttttagaaratcccactccgtttaattctttttgaaggagggagcctccctcctttaatttcctcaacaggaaatactataaaaatcactatagcactagtctattcct

SEQ ID NO: 15170 - DNA, 201 bp, Homo sapiens; identical to SEQ ID NO: 2221

SEQ ID NO: 15171 - DNA, 201 bp, Homo sapiens
agaaccacagcaatggggccatcctctaaagtttattttagcttatttatccccccttcctgtcatcttctgtgaatcttcacaacccagtggagtaaackgcaggtgtgaactgttgagacacaggctcccacaatggagcattactgagggttgggaagtaatccagtcaaatcaagctgaaagacaaaagtgtgagat

SEQ ID NO: 15172 - DNA, 201 bp, Homo sapiens
ttctacagtttatagtgagatgtttcacatcaattaaaaaaaaagatgagagaatgggttacttgaagagtttgtttccttataatcaactctaaagagamtaaggtcatgcaacagatttctttttctttctttcttacagggagactatgtgatgcaaattgctttattggtgaagggaattaaaattataaaaagctg

SEQ ID NO: 15173 - DNA, 201 bp, Homo sapiens
gctatcccatttctaaatctaaataaatcaaaatgttttttcaactttgggggtttcagaaaacccacaacacattttttgcgcagattttccttccaaamactagaatattgcgaggaaaattcaatccatatgtttcagactcacgtacagttgtatcaaaatcttgtgttgcaattgacatttgatgttcatgaagtt

SEQ ID NO: 15174 - DNA, 201 bp, Homo sapiens
ctcattttcccttaaaatgagccatgattgaaaaaagaaacaattttacattctcaaggttggaaatagagaagatatgcattggcgataatattgatttwaaaaaaaatctgctgaaaggctattattagacatagattatagttacagtgaaaactgggagctgcttttaatcccctagggggcagaaagttatgtagg

SEQ ID NO: 15175 - DNA, 201 bp, Homo sapiens
cctgacaaacacattcattcaaactctttagcacgtgaaatatatatatgaaatacatatggtactcattttcccttaaaatgagccatgattgaaaaaakaaacaattttacattctcaaggttggaaatagagaagatatgcattggcgataatattgatttaaaaaaaaatctgctgaaaggctattattagacatag

SEQ ID NO: 15176 - DNA, 201 bp, Homo sapiens
cactcattcaggcccttgtgccttgcagtgctgaactgaatttggtacttaattaagtttccaggggtgcaaaatggctatcccatttctaaatctaaatraatcaaaatgttttttcaactttgggggtttcagaaaacccacaacacattttttgcgcagattttccttccaaacactagaatattgcgaggaaaattc

SEQ ID NO: 15177 - DNA, 201 bp, Homo sapiens
cccttttctgtgagtacatatcaaggttgtcttcctttacagtgtaccattcagtaatactgttttgtagcaactcaataaagctgatagtttttctgggwaattacccacagcccccctgcaggacaaattagcattcatgacctgaataatgcttactagaaagagttcaatggaatttacttaatcagaatcattgct

SEQ ID NO: 15178 - DNA, 201 bp, Homo sapiens
aaatctaaataaatcaaaatgttttttcaactttgggggtttcagaaaacccacaacacattttttgcgcagattttccttccaaacactagaatattgcraggaaaattcaatccatatgtttcagactcacgtacagttgtatcaaaatcttgtgttgcaattgacatttgatgttcatgaagttttctgaatgcttct

SEQ ID NO: 15179 - DNA, 201 bp, Homo sapiens
tgcaactgaaaaggaggattcactcattcaggcccttgtgccttgcagtgctgaactgaatttggtacttaattaagtttccaggggtgcaaaatggctaycccatttctaaatctaaataaatcaaaatgttttttcaactttgggggtttcagaaaacccacaacacattttttgcgcagattttccttccaaacacta

SEQ ID NO: 15180 - DNA, 201 bp, Homo sapiens
ttgggggtttcagaaaacccacaacacattttttgcgcagattttccttccaaacactagaatattgcgaggaaaattcaatccatatgtttcagactcasgtacagttgtatcaaaatcttgtgttgcaattgacatttgatgttcatgaagttttctgaatgcttcttatttgcctttaactcaagaacataaagttga

SEQ ID NO: 15181 - DNA, 201 bp, Homo sapiens
tgggcttaaagaagtgcaaaatcagagctgtgtcggagcagggacaatataattgtggtatggattcccatatgggactaaattatctagattttagtaaygtcagcagttctgtgtagttgctggaatgcggccaatgtgccatatttgcttcatttttaagatggttctgattctacacaatgttaaatatgcagaaag

SEQ ID NO: 15182 - DNA, 201 bp, Homo sapiens
tagactgaactaacattcatgttaataattattacttacagagctagctgtgttaggagtgataatgataatgtgaaaactgaatataataataatatttmtcaggtgcatatcctctagtttaaagcaaatttgacaggaacatgcaggtacctcagtggcccaattttgagaaatagagggaattttttcatcgtaagg

SEQ ID NO: 15183 - DNA, 201 bp, Homo sapiens
gatagtttttctgggtaattacccacagcccccctgcaggacaaattagcattcatgacctgaataatgcttactagaaagagttcaatggaatttacttwatcagaatcattgctttctcttggctaatttttttttttacctagtccccaacgcttgctaatagcaaatatctttcaagccaatgtttggtatctgata

SEQ ID NO: 15184 - DNA, 201 bp, Homo sapiens
tgggttacttgaagagtttgtttccttataatcaactctaaagagactaaggtcatgcaacagatttctttttctttctttcttacagggagactatgtgatgcaaattgctttattggtgaagggaattaaaattataaaaagctgggcttaaagaagtgcaaaatcagagctgtgtcggagcagggacaatataattgt

SEQ ID NO: 15185 - DNA, 201 bp, Homo sapiens
accaatgtgactttatttttctaagcaaaatgccatttattatcatttctatctaggctataaaatcttcccagtagggggaaaaaatacccttttctgtragtacatatcaaggttgtcttcctttacagtgtaccattcagtaatactgttttgtagcaactcaataaagctgatagtttttctgggtaattacccaca

SEQ ID NO: 15186 - DNA, 201 bp, Homo sapiens
gacagctctatagacaacaaccaagatcagagaaccacagcaatggggccatcctctaaagtttattttagcttatttatccccccttcctgtcatcttcygtgaatcttcacaacccagtggagtaaacggcaggtgtgaactgttgagacacaggctcccacaatggagcattactgagggttgggaagtaatccagtc

SEQ ID NO: 15187 - DNA, 201 bp, Homo sapiens
ctcaataaagctgatagtttttctgggtaattacccacagcccccctgcaggacaaattagcattcatgacctgaataatgcttactagaaagagttcaayggaatttacttaatcagaatcattgctttctcttggctaatttttttttttacctagtccccaacgcttgctaatagcaaatatctttcaagccaatgtt

SEQ ID NO: 15188 - DNA, 201 bp, Homo sapiens
gacaaattagcattcatgacctgaataatgcttactagaaagagttcaatggaatttacttaatcagaatcattgctttctcttggctaatttttttttttacctagtccccaacgcttgctaatagcaaatatctttcaagccaatgtttggtatctgatagagaaaaatgcatgaatctttaaatgttctaatgtattt

SEQ ID NO: 15189 - DNA, 201 bp, Homo sapiens
atgattgtatatctaatttaactttgtattttacctagcatagtatccagcaatagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaa

SEQ ID NO: 15190 - DNA, 201 bp, Homo sapiens
gcaggtaaatagcagcactggaattcagcccagtctgaggctgattccaaagccatctaataggtagatagataggtggatgggtagataaacagacagakggattgattgatggatagaaggacacagatagaaacagtgaatactctttgcctaccactgccaccacacagaggtccagcatgctgtgctttaagccag

SEQ ID NO: 15191 - DNA, 201 bp, Homo sapiens
gtgcttcataaatagctaggcattgtactaaacatgttatataaatgaacttactaattctcacaaaacactcgaagaggtaaatgctgtcagtatctccrttttacagataagagaaaaaaaagtgctaggtcgggtatcttgtccaactcattcaggagcaggtaaatagcagcactggaattcagcccagtctgaggc

SEQ ID NO: 15192 - DNA, 201 bp, Homo sapiens
tttttacatagctactacaatactcctttaggtggtgagtaatcagatttactctgtatcctcagattctagcacaggttagttgataaatttgtgttaartgagtgactataggctcaattaattcaagaaggcatgtgtcaggtcctttggatgacttcattgcaattcctgagacaaaatatgtaaagaaaatgaaga

SEQ ID NO: 15193 - DNA, 201 bp, Homo sapiens
aagtctactattgcacagtaacagaggtattatcttattcaaatatacatttctacatgtccatggcatcagaaattagttgcttgattttctttttttgyagaaaacgaagtttcagaacacacactagaaagttacagatcaaggtcaaataatgaagaaacatcatctgaagagaaaaatggccaatgtaagtcaact

SEQ ID NO: 15194 - DNA, 201 bp, Homo sapiens
actttaatattacactatcaaacaaaattaaatgcagtgggcagagtccttcagattaagattactgccaacaaagctttcctaatagcaaattcctgtaytgattgaaatttctccaggtgagtgacggaattccaactattccaatgttcaaaagaaccccagttgagcagaaagcctagcacagcgccatatgcaaat

SEQ ID NO: 15195 - DNA, 201 bp, Homo sapiens
ggtacaaagcctaggggtctattgacagataagacaatcaagagccagaatgttctcagaaagcttgaaccctcactccaaacttaccagataagactgaygtagggagaatatgaaatctgaactttggttccaaaatgaaatgcatcatgaacacaggatagggagacgtgatgtgacacaaattctctgaagaagatc

SEQ ID NO: 15196 - DNA, 201 bp, Homo sapiens
ctacttgggaggctgaggcacaagaatcgcttgaacccgagaggcggagtttacagtaagctgagatcacgccactgcactccagcctgggcaacagagcragactctgtctcataataataagaataataggctaagacttaatttttatttgtgatctatttgctgtactcattgccagatctccaaatagtattcaaa

SEQ ID NO: 15197 - DNA, 201 bp, Homo sapiens
gtgtgttaccattgcatcatatgccacccaggttagggacacagagatgattataaacagctcctcggtgcaacaggttcagatggtacaaagcctagggstctattgacagataagacaatcaagagccagaatgttctcagaaagcttgaaccctcactccaaacttaccagataagactgatgtagggagaatatgaa

SEQ ID NO: 15198 - DNA, 201 bp, Homo sapiens
gcaatgttattcaaaataaatattcatcttcaacatgtttttctttcagcttcccaccctatgcgttgcatgaactacatcacaaagttgtactcagaagsaaaaacaaagaggaaggaaaatgtacaacattcaaaattagaagaaaagcacatccaagtaccagagagtattgtgtagtgctctctgcaatggaacatg

SEQ ID NO: 15199 - DNA, 201 bp, Homo sapiens
ctcctactctcagttcttgcctctcccctcccattttgtttgtatttgcttattttttggtttctagaagaaatagataatacatgattgaatgaatgaaygagacaaaatccctgagacactgtggacccccggcctgatcatccccatttctcttcctccacagaggcctctctgactaaccacacagaaaccatcacc

SEQ ID NO: 15200 - DNA, 201 bp, Homo sapiens
tttttgagatggagtcttgctcttgtcgttcagactggagtgcaatggtgctatctcagctcactgcaacctctgcctcccaggttcaagcaatactcccrcctcagtctcctgagtagctgggattataggtgcccaccaccatgcccagctagtttttgtgtttttattagtagagtcaggtttcaccatgttgaccag

SEQ ID NO: 15201 - DNA, 201 bp, Homo sapiens
gcagcagaatggcttgatctagctcagtggttccccacccggaatgatcttaccttcccgtggagataggacaatgtctggagatagttttgattgtgccwaatgtagaaagcggggcagtgcttctggcatctactgggtagaggccaacgattcatcggatatctttcctcataacagctctatttccctcttgtacag

SEQ ID NO: 15202 - DNA, 201 bp, Homo sapiens
catacctgtgttctaaaaccctttatagcttcctgaagtctacaacacagagcatgagtcccaaacacctcattaggtgccatctattacctacttctgcmgtctcatatctacaaagtccttatgagatacatatttttctctgaaaacatcaacccttttcaatcgccctgcccttgtttatcctcactgcccctggtg

SEQ ID NO: 15203 - DNA, 201 bp, Homo sapiens
attttgtttgtatttgcttattttttggtttctagaagaaatagataatacatgattgaatgaatgaacgagacaaaatccctgagacactgtggaccccyggcctgatcatccccatttctcttcctccacagaggcctctctgactaaccacacagaaaccatcaccgtggaggaaggccagacgctcactctaaagtg

SEQ ID NO: 15204 - DNA, 201 bp, Homo sapiens
gattgtatatctaatttaactttgtattttacctagcatagtatccagcaatagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaaga

SEQ ID NO: 15205 - DNA, 201 bp, Homo sapiens
gaagaaatagataatacatgattgaatgaatgaacgagacaaaatccctgagacactgtggacccccggcctgatcatccccatttctcttcctccacagmggcctctctgactaaccacacagaaaccatcaccgtggaggaaggccagacgctcactctaaagtgtgtcacttctctgaggaagaactcctccctccag

SEQ ID NO: 15206 - DNA, 201 bp, Homo sapiens
atatctaatttaactttgtattttacctagcatagtatccagcaatagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaaga

SEQ ID NO: 15207 - DNA, 201 bp, Homo sapiens
ctttgtattttacctagcatagtatccagcaatagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaa

SEQ ID NO: 15208 - DNA, 201 bp, Homo sapiens
ccggaatgatcttaccttcccgtggagataggacaatgtctggagatagttttgattgtgccaaatgtagaaagcggggcagtgcttctggcatctactgrgtagaggccaacgattcatcggatatctttcctcataacagctctatttccctcttgtacagctttaaaaaattccaaataccagcttcttcatcactcg

SEQ ID NO: 15209 - DNA, 201 bp, Homo sapiens
gtattttacctagcatagtatccagcaatagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaattgg

SEQ ID NO: 15210 - DNA, 201 bp, Homo sapiens
tagaggccaacgattcatcggatatctttcctcataacagctctatttccctcttgtacagctttaaaaaattccaaataccagcttcttcatcactcggmcaatcagctctccatcactgtgcctaacgtaaccctgcaagatgaaggcgtgtacaagtgcttacattacagcgactctgtaagcacaaaggaagtgaaa

SEQ ID NO: 15211 - DNA, 201 bp, Homo sapiens
tagcatagtatccagcaatagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaattggttatggtgct

SEQ ID NO: 15212 - DNA, 201 bp, Homo sapiens
tagtatccagcaatagcagcttctcagaaaatgaattacgaaagaaagaaagaaagaaagagagaaagaaaagaaagaaagaaagaaaaagaaagaaagaragaaagaaaagaaagaaagaaaaagaaagaaagaaagaaagaaagaaagaaagaaagaaagaaaaagaaagaaagaaagaattggttatggtgctttgag

SEQ ID NO: 15213 - DNA, 201 bp, Homo sapiens
ccagcaatagcagcttctcagaaaatgaattacgaaagaaagaaagaaagaaagagagaaagaaaagaaagaaagaaagaaaaagaaagaaagagagaaaraaaagaaagaaagaaaaagaaagaaagaaagaaagaaagaaagaaagaaagaaagaaaaagaaagaaagaaagaattggttatggtgctttgagcaagac

SEQ ID NO: 15214 - DNA, 201 bp, Homo sapiens
tgaaagaaaagtcaaaagaagttctaatttggtttccagtggcaatgagaagaccctggggaacttgtccttggaaaatgtgccaccaaaacttaggcacrgcatcctgctcttccacctttaacaaaactacagacattgaaacatatttttaagcactacagtctaagcaaagctgggtgggtctgtggcttctcactg

SEQ ID NO: 15215 - DNA, 201 bp, Homo sapiens
atagcagcttctcagaaaatgaattacgaaagaaagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaattggttatggtgctttgagcaagactattag

SEQ ID NO: 15216 - DNA, 201 bp, Homo sapiens
atcctgctgctcacgctggtgtccttcctcattttcatactcttcatcatagtccagctcttcatcatgaagctgaggaaagcacatgtgatatggaagaraggtcagtgggcagggaacctgacgggggctataagacgccagaacaaatggctaaaaaaaagggaaattctgtccattaaagctttctgtcagacacta

SEQ ID NO: 15217 - DNA, 201 bp, Homo sapiens
ctcaggtgttccaactgcctcggcctcccagagtgctgggattacaggcgtgagccactgcgcccggcctgtaatcaacattcttagagttgcaaaggacyctttacagttgagaacactgagggccaaatggagttctagagagaaaagacctaaacccagatctgattcccagggcagtgccaattctacttcattata

SEQ ID NO: 15218 - DNA, 201 bp, Homo sapiens
tcagaaaatgaattacgaaagaaagaaagaaagaaagagagaaagaaaagaaagaaagaaagaaaaagaaagaaagagagaaagaaaagaaagaaagaaaragaaagaaagaaagaaagaaagaaagaaagaaagaaagaaaaagaaagaaagaaagaattggttatggtgctttgagcaagactattagcctcatccaga

SEQ ID NO: 15219 - DNA, 201 bp, Homo sapiens
cactgcacctggctagaaatattttcacaagctcatctgatttagcccaaatgccttcctgtagggccacatttaacctaaccaagataaataaattttcrttttatttggatagttttttaaactccttaacaatccctcttgctacttaactatattttgctaaaaatcattcctaaagctaatttgaatctcctgact

SEQ ID NO: 15220 - DNA, 201 bp, Homo sapiens
agaaaatgaattacgaaagaaagaaagaaagaaagagagaaagaaaagaaagaaagaaagaaaaagaaagaaagagagaaagaaaagaaagaaagaaaaaraaagaaagaaagaaagaaagaaagaaagaaagaaagaaaaagaaagaaagaaagaattggttatggtgctttgagcaagactattagcctcatccagaaa

SEQ ID NO: 15221 - DNA, 201 bp, Homo sapiens
ataagggcttggacgcagtggtatggtagaatgtcttctggaagtctttgaaagtgagattgatactcatcttcctgttccatgtggtttctgcagcagcwgagagttggtcccaagtatctgaggagcagccacagggctctggaattttattcattacactgcaactgtgggctttgggaataggatgctctgaacact

SEQ ID NO: 15222 - DNA, 201 bp, Homo sapiens
aaaaaactcgatttcctattgtacatagtacttcaattccctattttatatacttcaattaatgccttctttttttggtccctgtaccctgaggcacttartaaggattcaattttggtaatgaataatattagtttcttcattaagtggcttaaagaatagctaatacattcaaaaagagtacatttagacagctaaaat

SEQ ID NO: 15223 - DNA, 201 bp, Homo sapiens
ctgtagttctgtttcatgaaatgcacctatccttctaaatctacatttaatctggaatggcatctgaaggacgctactttaaaaaactcgatttcctattktacatagtacttcaattccctattttatatacttcaattaatgccttctttttttggtccctgtaccctgaggcacttaataaggattcaattttggtaa

SEQ ID NO: 15224 - DNA, 201 bp, Homo sapiens
tttcaaaattcatcccattaaattacactgtagacaatgaaaatgtcaaatccaatgaattttgaaccctctgttttcattgttttgtggagggtaggatkcagaaaacaaaggaaaattgcaaattgagtagttcttttcatactttctttgcccaggaaaaagtcacatgttagatgacatgttgagacagcttcttta

SEQ ID NO: 15225 - DNA, 201 bp, Homo sapiens
caccaggaggtgttctgggggcagctaactaagagggggcttccagacagatggaggagttgatacacatgaggtcacagatctactgcctctcccccttyaaaagaaactactcagctccatttgtctcagaatctagaggaagttgacaaaggtgccacagcagcacagcacagtatgtggtggagagttctcagcttg

SEQ ID NO: 15226 - DNA, 201 bp, Homo sapiens
taatcaaccatcttttttttttgagatggagtctcactctgtctcccagtgcagtggcacgatcttgactcactgcaacctctgcctcctgggttgaaacrattcttctacctcagcttctggagtagctgggattacaggtgcatgccacaacacccagctaatttttgtatttttagtagagacagggtttcaccatgt

SEQ ID NO: 15227 - DNA, 201 bp, Homo sapiens; identical to SEQ ID NO: 2233

SEQ ID NO: 15228 - DNA, 201 bp, Homo sapiens
aacactgcaagataagcagacccgtaaagccaaaagcaaggcttgttgcaaagagtaaaggaaacaacgaatattctatgcctcaaacacagccctttccrtatgaaactcaggcctctacagtgtggtcaatctggttagccgcctgataccgaattctcagcaagtgcaaacattaatcttaagacatacagtacttta

SEQ ID NO: 15229 - DNA, 201 bp, Homo sapiens
aggaaagaatattttattcttttctcagtctacatgatagtctatagtagaggtaaagattgcacatgagaacttccaaaatcttgggaaagaccaaaaartcttacgaactgcactggttttgtctatgtgtactttggtagatggctgttactgctgcttgtccttttgtttgggagtagatcacatgtgctttggtgt

SEQ ID NO: 15230 - DNA, 201 bp, Homo sapiens
ttctagcaactccgttcaagccaatcctggaagcttcagttatcagaaagcaaaatggagaagaacatgttgtactcatgtgctccaccatgagaagcaarccccctccgcagataacctggctacttgggaatagcatggaagtgtccggtaaggggagaaatggttctctttgtcttccttcctactcaaatttccagg

SEQ ID NO: 15231 - DNA, 201 bp, Homo sapiens
ccattggcctctaatagaaccaacctcatccagtagcattaaatagccataacctcttcaaattgctacataggtggaacgctccatgaatttgaaactgrtgggaagaaatgtaatactaccagcactctcataatccacacttatggcaaaaattcaacggtggactgcattatccgacacagaggcctgcaagggaga

SEQ ID NO: 15232 - DNA, 201 bp, Homo sapiens
attgctacataggtggaacgctccatgaatttgaaactgatgggaagaaatgtaatactaccagcactctcataatccacacttatggcaaaaattcaacrgtggactgcattatccgacacagaggcctgcaagggagaaaactagtagcacccttccggtttgaagatttgggtaagaagaactaatgattctcttgaa

SEQ ID NO: 15233 - DNA, 201 bp, Homo sapiens
agaaagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaattggttatggtgctttgagcaagactattagcctcatccagaaaggcataaattcctacat

SEQ ID NO: 15234 - DNA, 201 bp, Homo sapiens
tagttgatttaccagtactacccacttgtggtaaaacaatttttgtcaccaacacatcactcacacctctctgccatcaagataatacatgtggtccccaraatgttccaccaggaggtgttctgggggcagctaactaagagggggcttccagacagatggaggagttgatacacatgaggtcacagatctactgcctct

SEQ ID NO: 15235 - DNA, 201 bp, Homo sapiens
aagaaagaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaattggttatggtgctttgagcaagactattagcctcatccagaaaggcataaattcctacatatt

SEQ ID NO: 15236 - DNA, 201 bp, Homo sapiens
agaaagaaagagagaaagaaaagaaagaaagaaagaaaaagaaagaaagagagaaagaaaagaaagaaagaaaaagaaagaaagaaagaaagaaagaaagaaagaaagaaagaaaaagaaagaaagaaagaattggttatggtgctttgagcaagactattagcctcatccagaaaggcataaattcctacatattctctt

SEQ ID NO: 15237 - DNA, 201 bp, Homo sapiens
ccccaaagcaacacacgggtcccaaaccttggtgttatctatcactcctatgtatgtgtacaaatatatctatgtgtatatgtatatgcatatgcacacaygtatataaaatcagtcaatttccaagaacttttgagtcttgtctttcaggtattttgtccattgtcactgttaacgtcccaatccaggctctcatcatct

SEQ ID NO: 15238 - DNA, 201 bp, Homo sapiens
aaaaatggccaatgtaagtcaactgtatgacctgagatctgaacaatgaggttcattaatgtattagtcagatttctccagagagacagagacaacagaawatatgtgtgtgtgtgtgtgtgtgtgtgtgtgtgtgtgtgtgtgtatgaggtgggatttattaggggaattggctcatgagattatggaggctgacaagtc

SEQ ID NO: 15239 - DNA, 201 bp, Homo sapiens
aatggccaatgtaagtcaactgtatgacctgagatctgaacaatgaggttcattaatgtattagtcagatttctccagagagacagagacaacagaaaatrtgtgtgtgtgtgtgtgtgtgtgtgtgtgtgtgtgtgtgtgtatgaggtgggatttattaggggaattggctcatgagattatggaggctgacaagtcctt

SEQ ID NO: 15240 - DNA, 201 bp, Homo sapiens
atggccaatgtaagtcaactgtatgacctgagatctgaacaatgaggttcattaatgtattagtcagatttctccagagagacagagacaacagaaaatatgtgtgtgtgtgtgtgtgtgtgtgtgtgtgtgtgtgtgtgtatgaggtgggatttattaggggaattggctcatgagattatggaggctgacaagtccttg

SEQ ID NO: 15241 - DNA, 201 bp, Homo sapiens
tggccaatgtaagtcaactgtatgacctgagatctgaacaatgaggttcattaatgtattagtcagatttctccagagagacagagacaacagaaaatatgtgtgtgtgtgtgtgtgtgtgtgtgtgtgtgtgtgtgtgtatgaggtgggatttattaggggaattggctcatgagattatggaggctgacaagtccttgg

SEQ ID NO: 15242 - DNA, 201 bp, Homo sapiens
aagatttctctcttttttttttctggttttgttttgtttttagagacagggtctctctctgtctcccaggccagggtgcaggggcacgatcatgttcaccrcagccttgaactcctgggctcaagagatctcctacctccacctcccaaatagctgggattacaggtgtgagccactgtgcccagtaagcaaaagatttct

SEQ ID NO: 15243 - DNA, 201 bp, Homo sapiens
aaaaataaatgaataaataaataaagagtagtgattgaaacatgttaaatacattaaaactcatgagtttttacaatactttaaaaatgtactgatcagckttagagattgctcagacactagtttttaaactgaaatttgaaatatatcattaaaataactatgtaataaaaacagccatgagcacaagaaaagatggga

SEQ ID NO: 15244 - DNA, 201 bp, Homo sapiens
acaggcgtgagccaccgcgcccggctgttcttcccttattttttaaagagtttactcattcccaagatggttcctgttgccactaggcaaaagatttctctcttttttttttctggttttgttttgtttttagagacagggtctctctctgtctcccaggccagggtgcaggggcacgatcatgttcaccgcagccttgaa

SEQ ID NO: 15245 - DNA, 201 bp, Homo sapiens
ttcatcttcaacatgtttttctttcagcttcccaccctatgcgttgcatgaactacatcacaaagttgtactcagaagcaaaaacaaagaggaaggaaaaygtacaacattcaaaattagaagaaaagcacatccaagtaccagagagtattgtgtagtgctctctgcaatggaacatgtgatttcagggttgccgcagtg

SEQ ID NO: 15246 - DNA, 201 bp, Homo sapiens; identical to SEQ ID NO: 2232

SEQ ID NO: 15247 - DNA, 201 bp, Homo sapiens; identical to SEQ ID NO: 2234

SEQ ID NO: 15248 - DNA, 201 bp, Homo sapiens
ttccagacaagttattcttacaaccaatcaattttatgccttaatcttgaaaggctaatcatagatattgaaaatgtttttgtttaaaacaggtaaaaatstaaagtgaactataatgacttcttaaaatttcacaaaattgtctaaaataagtataatacagaagtataatatctcaggcgaggcacaatggctcatgcc

SEQ ID NO: 15249 - DNA, 201 bp, Homo sapiens
cagaaccaagcctatacaagggaactggctgaggttagaatgaggttagaaatctaatgtttgccatgaagtcaaggccattggcctctaatagaaccaayctcatccagtagcattaaatagccataacctcttcaaattgctacataggtggaacgctccatgaatttgaaactgatgggaagaaatgtaatactacca

SEQ ID NO: 15250 - DNA, 201 bp, Homo sapiens
agcagatggacactcagtgggatacagattcaaaaaccagagcaggagccacagaacacacagttctggggtttctgcacaacctctacaagcaggtagcygctaaatatattctccaatctcttttactgagcacaatgtgggtaaaactgctctctatagtagcagaattttgtttttcccctttcctagttactgatg

SEQ ID NO: 15251 - DNA, 201 bp, Homo sapiens
tgctttaagccaggcaggtgagcagatggacactcagtgggatacagattcaaaaaccagagcaggagccacagaacacacagttctggggtttctgcacracctctacaagcaggtagccgctaaatatattctccaatctcttttactgagcacaatgtgggtaaaactgctctctatagtagcagaattttgtttttc

SEQ ID NO: 15252 - DNA, 201 bp, Homo sapiens
ggcacatcaattacttgattgtcaataactcaggtcatttttgatgatgggattgaactacaaatacagaataatttagaaagcctggattataattccarttttttagacagtgaactcactagaggttaactcagagcaatgattgtatatctaatttaactttgtattttacctagcatagtatccagcaatagcagc

SEQ ID NO: 15253 - DNA, 201 bp, Homo sapiens
cttttccataaggagtttgtaatctatctacagagaaacacctgtaaccaaataattataaagtaatgtgctaagtgctgtaatagaagtatatctcaagmctttgggaaactaggggaaagacattatggggaaaagggaagctaaggcctgttttggaagttttgacaaaagttgtgtaatttgagttgagcctataag

SEQ ID NO: 15254 - DNA, 201 bp, Homo sapiens
catcctcctcagcattgctcccaatttctttccattttctatgtatctgtagctgaattttctgtgatttccccaaactcaacattgctaaataccaaacrgcaccttctcccacaaaatcagcttgtccaaagcatcacacaggccccaaagcaacacacgggtcccaaaccttggtgttatctatcactcctatgtatg

SEQ ID NO: 15255 - DNA, 201 bp, Homo sapiens
gccaccaccccagctaattttgtatttttagtagagatggggtttatccatgttggtcagtctggtcttgaactcccgacctccggtgatctgcctgcctyggcctcccaaagtgctgggattacaggcgtgagccaccgcgcccggctgttcttcccttattttttaaagagtttactcattcccaagatggttcctgtt

SEQ ID NO: 15256 - DNA, 201 bp, Homo sapiens
tgggtcctatgttacggcaagatgaaacaagcttattaggctctgtcttttaagggcataccagttgaaagagcatccgtattgaattttattttattttwtttatttatttatttatgagacacagtctcgctctgtcgcccaggctggagtgcagcggcacgacctcggctcactgcaagctccgcctcccgggttcac

SEQ ID NO: 15257 - DNA, 201 bp, Homo sapiens
ttggagaaagaagagtttagagcacctctcaaatatctggtgtgcagtggttggtgatgacattaatttatataagggaactctagaatggggcaggtggyatatctgtgttagacatgggtggagcatggggacagtagagataacgagttccaatgggacatgtagagtttggggtctttgcaggacaggcttgctctg

SEQ ID NO: 15258 - DNA, 201 bp, Homo sapiens
atgtaacctgcccaagttttaaagctagaatatgacaacataaataccagcctataaagcacatagtaaaagtatttatttcatgaaacttctaattaacktgtgtgtgtgtgtgtgtgtactagttgtgacagaaaatgtattaatgtggatcaaaagttggaaaaccactgactttcacaatttggaggattcaatatt

SEQ ID NO: 15259 - DNA, 201 bp, Homo sapiens
cctcggcctcccaaagtgctgggattacaggcgttgagccaccacgcccggcctcaaattcatggttttaaaatgtaatcctagaaccagatgatgatgawgaattagagagaagagagactagaactaagttattacagtggtccaggaaagaaatgatggagtccttaactaaggcagcaataatagtgacaaaagagg

SEQ ID NO: 15260 - DNA, 201 bp, Homo sapiens
atctaaaaataataaaaatctttttttgtaatgatctgaattaaaacacacttttgcttaatgcctcatgacagtcatgtaactagggctctgatttgagmattaatgcattgcatgtctctggctttaacttagccctagtctttattatttgatataacagttaaagagcaaagttagcatcctattataatatttatt

SEQ ID NO: 15261 - DNA, 201 bp, Homo sapiens
aggaacaccataggttgaataagatatggtctgagaatggagcattggtttgagcaatgtgaaggtctttggcaaccttggcaaagagagatttcaacgargtagtggagttgaaaacctggtcagaaaacaaagagtgggataaacaaatatagatagttctttagaaaaatgtgtcagtgaaagagagggaaggcaggg

SEQ ID NO: 15262 - DNA, 201 bp, Homo sapiens
cttctggagtagctgggattacaggtgcatgccacaacacccagctaatttttgtatttttagtagagacagggtttcaccatgttggccaggctggtctygaacccctgacctcaggtgttccaactgcctcggcctcccagagtgctgggattacaggcgtgagccactgcgcccggcctgtaatcaacattcttagag

SEQ ID NO: 15263 - DNA, 201 bp, Homo sapiens
cctgacctcaggtgatccacctgcctcggcctcccaaagtgctggtattacaggcgtgagccaccgcatccggcccagaaatgacatattttaatgaaaamaaaaagtatattttgtaacactgaaaagattagtgtgaaaatgtcatttttttacattttgaaaatctcataaatgtctagcttaacggaaaacaattag

SEQ ID NO: 15264 - DNA, 201 bp, Homo sapiens
ttaattaacaggataaatcaaagtaaatacagagtctagttttaaatatgtatagataaaacttgttttgtacataaacataattttctgaattcacatartatatactatgttagaagatttaaatcactattgataaattttattctatatgtccccagtgatgtccttcttcttttttaaaattttgagacagggtct

SEQ ID NO: 15265 - DNA, 201 bp, Homo sapiens
gagcaatgattgtatatctaatttaactttgtattttacctagcatagtatccagcaatagcagcttctcagaaaatgaattacgaaagaaagaaagaaaraaagagagaaagaaaagaaagaaagaaagaaaaagaaagaaagagagaaagaaaagaaagaaagaaaaagaaagaaagaaagaaagaaagaaagaaagaa

SEQ ID NO: 15266 - DNA, 201 bp, Homo sapiens
tcgcttgaacctgggaggtggagcttgcagtgagctgagatcataccactttactccagcctgggcaacagagcgagactccatctcaaaaaaaaaaaaaagtgtatgtcctacttttaaaattgctttaatgaggccaagcacagtggctcacacctctaatcacacccatttgggaggctgaggtgggaagattgctgg

SEQ ID NO: 15267 - DNA, 201 bp, Homo sapiens; identical to SEQ ID NO: 2256

SEQ ID NO: 15268 - DNA, 201 bp, Homo sapiens
gctttgctcatgttgcccaggctggagtgcagtggcgcgatcttggttcactgcaacctccgcctcccagcttcaagcaattctgctgcctcagcttcccragtagctgggattacaggtgcatgccaccatgcctggctaattttttgtattttcagtagagacagggtttcaccatgttggccaggctggtctcaaact

SEQ ID NO: 15269 - DNA, 201 bp, Homo sapiens; identical to SEQ ID NO: 2257

SEQ ID NO: 15270 - DNA, 201 bp, Homo sapiens; identical to SEQ ID NO: 2258

SEQ ID NO: 15271 - DNA, 201 bp, Homo sapiens; identical to SEQ ID NO: 2259

SEQ ID NO: 15272 - DNA, 201 bp, Homo sapiens; identical to SEQ ID NO: 2260

SEQ ID NO: 15273 - DNA, 201 bp, Homo sapiens; identical to SEQ ID NO: 2261

SEQ ID NO: 15274 - DNA, 201 bp, Homo sapiens
aaaaaaaaaaagaaaaaaatggaaaacatcctcatggccacaaaataaggtctaattcaataaattatagtacattaatgtaatataatattacatgccamtaaaaagaataaggtagctgtatatttcctggtatggaaaaaacatattaatatgttataaactattaggttggtgcaaaactaattgtggtttttgcca

SEQ ID NO: 15275 - DNA, 201 bp, Homo sapiens
ttaaaagtagatgtagaaaacttactcttaaatatataacagttcaaaaatccagcaggaactaagttaattaaatagaatattcacctgttttttctgayaattatcctgtgttatatttacatattaatgcagtataatattttagtatacattacactctagggagtcactgaaatgtcagcaaagaaaaatacggcc

SEQ ID NO: 15276 - DNA, 201 bp, Homo sapiens; identical to SEQ ID NO: 2262

SEQ ID NO: 15277 - DNA, 201 bp, Homo sapiens
gtggacaaagagggccatatgtggttgctgtaaagaagaggatggttaacaacctgtgagcatttggtttcttgataagctttctcccagaccacctacaytgagctattaattaggaataggatgcacttcgagttttatttcaattcttgtgaacttataactttcctaagaatatatttatacatgtaggcaaagtct

SEQ ID NO: 15278 - DNA, 201 bp, Homo sapiens; identical to SEQ ID NO: 2263

SEQ ID NO: 15279 - DNA, 201 bp, Homo sapiens; identical to SEQ ID NO: 2264

SEQ ID NO: 15280 - DNA, 201 bp, Homo sapiens
tccagcctggtgacagagcgagactccatctcaaaaaaaagaaaaaaaaaaaagaaaaaaatggaaaacatcctcatggccacaaaataaggtctaattcrataaattatagtacattaatgtaatataatattacatgccactaaaaagaataaggtagctgtatatttcctggtatggaaaaaacatattaatatgtta

SEQ ID NO: 15281 - DNA, 201 bp, Homo sapiens; identical to SEQ ID NO: 2266

SEQ ID NO: 15282 - DNA, 201 bp, Homo sapiens; identical to SEQ ID NO: 2267

SEQ ID NO: 15283 - DNA, 201 bp, Homo sapiens; identical to SEQ ID NO: 2268

SEQ ID NO: 15284 - DNA, 201 bp, Homo sapiens; identical to SEQ ID NO: 2269

SEQ ID NO: 15285 - DNA, 201 bp, Homo sapiens; identical to SEQ ID NO: 2270

SEQ ID NO: 15286 - DNA, 201 bp, Homo sapiens; identical to SEQ ID NO: 2271

SEQ ID NO: 15287 - DNA, 201 bp, Homo sapiens; identical to SEQ ID NO: 2272

SEQ ID NO: 15288 - DNA, 201 bp, Homo sapiens; identical to SEQ ID NO: 2273

SEQ ID NO: 15289 - DNA, 201 bp, Homo sapiens
ttgatatcaagtcaaaggctcacaatgtctggtaataaaacaaattactttcaattttcttgaaatcttcaggctatcaaaaggagatgtgagagagggtmttgagtctggcctgacaatgcagttcttaaaccaaaggtccattatgcttctcctctctgagaatcctgacttacctcaacaacggagacatggcacagt

SEQ ID NO: 15290 - DNA, 201 bp, Homo sapiens
tgaggacccacttgagatagggagtgggtctggtagtgcatcctgaagtcctgccaggggacaagcacaatgaaaaactcctgactgtgggtctggaagtygcctacacctgtacatctattcaacagccagctgctgagacactgccctccttcacagatgggggctctgagctgctggacaacactgcgttctggatgt

SEQ ID NO: 15291 - DNA, 201 bp, Homo sapiens
cagaggaagctgtatcgagatgtgatgctggagaacttcaggaacctgctctcagtgggtgaggacaggcaccctctgtaacagaacgtcaggccccagargtggctttgtatcctagggtacaaagtttcaagtcttaattagtaacttgaacctatggttcaagtttgagtgtgcagtaagaacctaaatttctggtaa

SEQ ID NO: 15292 - DNA, 201 bp, Homo sapiens; identical to SEQ ID NO: 2275

SEQ ID NO: 15293 - DNA, 201 bp, Homo sapiens
ctaatcagattaccaaagtaatgggaaaattgataacttgcttttggctatgttaagaaaaaccagaataatgtatccccttgaaagattttgaagttagktaaaaaaaaaaattgagaaaacatgacataatcataatattaaatttctgacattttgttatttaaaacttactttaaataggagagtaagatctacctg

SEQ ID NO: 15294 - DNA, 201 bp, Homo sapiens; identical to SEQ ID NO: 2277

SEQ ID NO: 15295 - DNA, 201 bp, Homo sapiens; identical to SEQ ID NO: 2279

SEQ ID NO: 15296 - DNA, 201 bp, Homo sapiens
gagtaggaaatctacgagttgacctatgtctctcaagatccaaaacaacttcccacccctcccctctgtctgctcagtgccacccctctcccaggaatcaytggtcatgagactgagattgcatatgtttgatgctataggaggcaatgaccttcaaggacgtggctgtggtcttcactgaggaagagctggggctgctgg

SEQ ID NO: 15297 - DNA, 201 bp, Homo sapiens; identical to SEQ ID NO: 2284

SEQ ID NO: 15298 - DNA, 201 bp, Homo sapiens
tctgcctttcctggcactttgcaggcacaattctgctttcccaggaactgcatcactcaggactctgcaagtttccagaagtaagagggaaaatgaccacrttcaaggtgggtaggacttgcttctattactcttaaaattccctctcagtacttaaattgtcacaagttttcctctgtcttgggaagactcaaggagaaa

SEQ ID NO: 15299 - DNA, 201 bp, Homo sapiens; identical to SEQ ID NO: 2286

SEQ ID NO: 15300 - DNA, 201 bp, Homo sapiens; identical to SEQ ID NO: 2288

SEQ ID NO: 15301 - DNA, 201 bp, Homo sapiens; identical to SEQ ID NO: 2290

SEQ ID NO: 15302 - DNA, 201 bp, Homo sapiens
gagcgcataggcacccgactagtgagaggtggagctggggttggaacctaagcagtctgggtcagagcctgatttgatcttctcttgggatacgttgtcaytgaggcagaggaactagttggacttaggtggggaaagcaagacttaggggcttgaaattttctgagtttctaaaaatgttgtcaactattttgtttcaat

SEQ ID NO: 15303 - DNA, 201 bp, Homo sapiens
tttgaaaagatggtggtattcatttataatcaaataagtgagaataataaaacaaaatcatggccaggcctgtgactcacacctataatcctggcactttrggaggcttaggaaggaggattgtttgaaaccaggagctcaagaccatcctgggaaacatagcaagactctatctctacaaaaagaaaaaaaagaaaaaaa

SEQ ID NO: 15304 - DNA, 201 bp, Homo sapiens
gatggtggtattcatttataatcaaataagtgagaataataaaacaaaatcatggccaggcctgtgactcacacctataatcctggcactttaggaggctkaggaaggaggattgtttgaaaccaggagctcaagaccatcctgggaaacatagcaagactctatctctacaaaaagaaaaaaaagaaaaaaacaatttct

SEQ ID NO: 15305 - DNA, 201 bp, Homo sapiens; identical to SEQ ID NO: 2292

SEQ ID NO: 15306 - DNA, 201 bp, Homo sapiens; identical to SEQ ID NO: 2293

SEQ ID NO: 15307 - DNA, 201 bp, Homo sapiens
taaaacaaaatcatggccaggcctgtgactcacacctataatcctggcactttaggaggcttaggaaggaggattgtttgaaaccaggagctcaagaccakcctgggaaacatagcaagactctatctctacaaaaagaaaaaaaagaaaaaaacaatttcttcctaatcagattaccaaagtaatgggaaaattgataac

SEQ ID NO: 15308 - DNA, 201 bp, Homo sapiens; identical to SEQ ID NO: 2294

SEQ ID NO: 15309 - DNA, 201 bp, Homo sapiens; identical to SEQ ID NO: 2295

SEQ ID NO: 15310 - DNA, 201 bp, Homo sapiens; identical to SEQ ID NO: 2296

SEQ ID NO: 15311 - DNA, 201 bp, Homo sapiens
gagaaaaacagacatttgaggatctcttgtgtaccatgtacttcctttgttacttttgagtggattttgcatttgtttttactacttgttttcttctatcrtttattctatggagtagacaagattgtaggaatggataattatttcattatactacttctctgctcacacattagctatttttatcctgtgatactcttc

SEQ ID NO: 15312 - DNA, 201 bp, Homo sapiens
ttggttgtgccgttttgggtttttatgattaatgctgctgtgaacagtcatgtgccaattcacaatacacatccctgttggtgggtggcatccctggccascttttcatgtctctttttctgcctttcctggcactttgcaggcacaattctgctttcccaggaactgcatcactcaggactctgcaagtttccagaagta

SEQ ID NO: 15313 - DNA, 201 bp, Homo sapiens; identical to SEQ ID NO: 2297

SEQ ID NO: 15314 - DNA, 201 bp, Homo sapiens; identical to SEQ ID NO: 2298

SEQ ID NO: 15315 - DNA, 201 bp, Homo sapiens
agtctcctgggccactgattccatgtaacctaaagcctcaccttaaatcacgttgctctttgtgacatagggggcaccgacccccaaaggcgtggccagcyacaaccctaaatcatattgtttcactttccagtgacctagttttactctcaagcaaacaaagacactctcctcaggcataaactcctagacattacctct

SEQ ID NO: 15316 - DNA, 201 bp, Homo sapiens; identical to SEQ ID NO: 2301

SEQ ID NO: 15317 - DNA, 201 bp, Homo sapiens; identical to SEQ ID NO: 2303

SEQ ID NO: 15318 - DNA, 201 bp, Homo sapiens; identical to SEQ ID NO: 2484

SEQ ID NO: 15319 - DNA, 201 bp, Homo sapiens; identical to SEQ ID NO: 2308

SEQ ID NO: 15320 - DNA, 201 bp, Homo sapiens; identical to SEQ ID NO: 2312

SEQ ID NO: 15321 - DNA, 201 bp, Homo sapiens; identical to SEQ ID NO: 2313

SEQ ID NO: 15322 - DNA, 201 bp, Homo sapiens; identical to SEQ ID NO: 2314

SEQ ID NO: 15323 - DNA, 201 bp, Homo sapiens; identical to SEQ ID NO: 2316

SEQ ID NO: 15324 - DNA, 201 bp, Homo sapiens; identical to SEQ ID NO: 2315

SEQ ID NO: 15325 - DNA, 201 bp, Homo sapiens; identical to SEQ ID NO: 2317

SEQ ID NO: 15326 - DNA, 201 bp, Homo sapiens; identical to SEQ ID NO: 2318

SEQ ID NO: 15327 - DNA, 201 bp, Homo sapiens
ttaaacaaccagctcttgtgtgaattaagagtgcgaactcattcattaccatggtggggacaccaatgtttatgaaggatctgcttccatgaccaagcacyttccaatagtcccgacctccaacactggaggtcatacttcaacatgagatttggaggggatacatattcaaactattgtcagatgttaattcatcaggta

SEQ ID NO: 15328 - DNA, 201 bp, Homo sapiens; identical to SEQ ID NO: 2274

SEQ ID NO: 15329 - DNA, 201 bp, Homo sapiens; identical to SEQ ID NO: 2276

SEQ ID NO: 15330 - DNA, 201 bp, Homo sapiens; identical to SEQ ID NO: 2278

SEQ ID NO: 15331 - DNA, 201 bp, Homo sapiens; identical to SEQ ID NO: 2280

SEQ ID NO: 15332 - DNA, 201 bp, Homo sapiens; identical to SEQ ID NO: 2281

SEQ ID NO: 15333 - DNA, 201 bp, Homo sapiens; identical to SEQ ID NO: 2282

SEQ ID NO: 15334 - DNA, 201 bp, Homo sapiens
agtatgcattgggaacctaagtttccagtaaattttacttagatttttttctaggatatattggcactaagcacatgacttttcacgttcacagggcatcratcactccacagagatactttccacttcctaaaggaagaaaagttttggatgatggagacagcaacccaaagagaagggaatttaggtaagaagcaagca

SEQ ID NO: 15335 - DNA, 201 bp, Homo sapiens
ctaaactagtgaattatcatgttatatcatactcattaatctcattattgttattatttttcctatgactgtttcctaaaattataaaactttttattttyatgtcatttgaaacctatagaaaagttgcaaaagtagcctaagaaattcttatttactctttacccacgtttgccaagtgtttacatttttcctgtttgt

SEQ ID NO: 15336 - DNA, 201 bp, Homo sapiens; identical to SEQ ID NO: 2283

SEQ ID NO: 15337 - DNA, 201 bp, Homo sapiens
aaggaagaaaagttttggatgatggagacagcaacccaaagagaagggaatttaggtaagaagcaagcaactctgtgtccttgtgcgtgactctcccatckgtttcacttctgtccattgcccagctctgttgtcctggtctaaatggccagacctctttcctgaattattacagctgactttcggctggtttccctgctc

SEQ ID NO: 15338 - DNA, 201 bp, Homo sapiens
tatttattaccatactgagctatatgccttccatatgacttatcctggagcttttcataggaagcatattcatttctggaaagaaatcatttttgaatgarcattctgatgtctactagtgagacagctcttctacaaggggaaaaaattctccattttgtgatgtgtcagataataaccagcttcccagctagctttcct

SEQ ID NO: 15339 - DNA, 201 bp, Homo sapiens; identical to SEQ ID NO: 2287

SEQ ID NO: 15340 - DNA, 201 bp, Homo sapiens; identical to SEQ ID NO: 2289

SEQ ID NO: 15341 - DNA, 201 bp, Homo sapiens; identical to SEQ ID NO: 2291

SEQ ID NO: 15342 - DNA, 201 bp, Homo sapiens
tggtacttggttgggtcgcgtctcacctggtttcagggtttccggggctctgagctcgcccactccgccccctgcaccccacgcgcgtggccacttcttckcgatataacgttggggtgttaatctccttgggtttcccgttactgttctttaaaatggggactttagggccatcctaatggaatcgttttgggaactgga

SEQ ID NO: 15343 - DNA, 201 bp, Homo sapiens
gtgaggcaggagaatcgtttgaatctgggaggcggaggttgcagtgagcggagatctgccattgcactccagtctgggcgacagtgcgagactccgtctcaaaaaaaaaaaaaaaagaacaaaatgtttttattacctacgaatccatgaagtaaaggtagcaactgttaagctcgtaatgtgtttctttctttttgtata

SEQ ID NO: 15344 - DNA, 201 bp, Homo sapiens
gcaactgttaagctcgtaatgtgtttctttctttttgtatatttataggtttatttatgaacatttacaaatttttataatttttttcttaatatttcccycttatgtgtttaactatggaaatttccaaatgctgacagactaaactagtgaattatcatgttatatcatactcattaatctcattattgttattatttt

SEQ ID NO: 15345 - DNA, 201 bp, Homo sapiens
aacatttacaaatttttataatttttttcttaatatttcccccttatgtgtttaactatggaaatttccaaatgctgacagactaaactagtgaattatcrtgttatatcatactcattaatctcattattgttattatttttcctatgactgtttcctaaaattataaaactttttattttcatgtcatttgaaacctat

SEQ ID NO: 15346 - DNA, 201 bp, Homo sapiens
ctacccatctgccaccaccacctgtgttcacagtctaattttatgcattgcctttaattgtcacatttccataatctttaatcttgaggattctacaccctttgtctttctatgcttgatatttttgaagagtataggcaagttattttggagaaaggcattcatttggagttgtgtctgatgtaattcatgtgcgggttc

SEQ ID NO: 15347 - DNA, 201 bp, Homo sapiens
agaaaagttttggatgatggagacagcaacccaaagagaagggaatttaggtaagaagcaagcaactctgtgtccttgtgcgtgactctcccatcggtttyacttctgtccattgcccagctctgttgtcctggtctaaatggccagacctctttcctgaattattacagctgactttcggctggtttccctgctcccact

SEQ ID NO: 15348 - DNA, 201 bp, Homo sapiens
cctgagtggctggggttacaggcatgcgtcaccatgcctaattttgtatttttagtagagacagggtttctccatgttggtcaggctggtctcgaactccygacctcaggtgatccacctgcctcggccttccgaagtgctggaattacaggcgtgagccaccgcgcccagcctaacctaaattttttgtgcatgatacta

SEQ ID NO: 15349 - DNA, 201 bp, Homo sapiens
atgcctaattttgtatttttagtagagacagggtttctccatgttggtcaggctggtctcgaactcctgacctcaggtgatccacctgcctcggccttccraagtgctggaattacaggcgtgagccaccgcgcccagcctaacctaaattttttgtgcatgatactagaaaatttgccagtcacttgtgttttgtttctt

SEQ ID NO: 15350 - DNA, 201 bp, Homo sapiens; identical to SEQ ID NO: 2299

SEQ ID NO: 15351 - DNA, 201 bp, Homo sapiens; identical to SEQ ID NO: 2300

SEQ ID NO: 15352 - DNA, 201 bp, Homo sapiens; identical to SEQ ID NO: 2302

SEQ ID NO: 15353 - DNA, 201 bp, Homo sapiens; identical to SEQ ID NO: 2304

SEQ ID NO: 15354 - DNA, 201 bp, Homo sapiens; identical to SEQ ID NO: 2306

SEQ ID NO: 15355 - DNA, 201 bp, Homo sapiens; identical to SEQ ID NO: 2305

SEQ ID NO: 15356 - DNA, 201 bp, Homo sapiens; identical to SEQ ID NO: 2307

SEQ ID NO: 15357 - DNA, 201 bp, Homo sapiens
gctatgaaacaggaagagaaaatggagtttggtaatttcatcaaatatattcattattgggggcaggagtaacatttaaatcctcctctttattgctggcmgtaaaaatatgtcttttggagagcagaacatgccagaatgtataaggtgcaactgtttgatatgaaaaccataggataggaaactatgcctatgacacta

SEQ ID NO: 15358 - DNA, 201 bp, Homo sapiens; identical to SEQ ID NO: 2309

SEQ ID NO: 15359 - DNA, 201 bp, Homo sapiens
cagtggtgcaatcttggctcactgcaacctctgcctcccggtttcaagcgattctcctgcctcagcctcccgagtagctaggattgcaggtgcccgccacygcacccggctgatttttgtatttttagtagagacggggtttcaccatcttggccaggctggcctcaaactcctgacctcgtgatccacccgccttggcct

SEQ ID NO: 15360 - DNA, 201 bp, Homo sapiens; identical to SEQ ID NO: 2310

SEQ ID NO: 15361 - DNA, 201 bp, Homo sapiens; identical to SEQ ID NO: 2311

SEQ ID NO: 15362 - DNA, 201 bp, Homo sapiens
aatgtataaggtgcaactgtttgatatgaaaaccataggataggaaactatgcctatgacactaaaactccaaaaagtagaagaccacattgatgatgtcmctgcattttaaaatggaaagaacaagtgttcaagaacaggaatttgtgtgaattgcatttattcctataataatatgaactcaatgagatgatgacatag

SEQ ID NO: 15363 - DNA, 201 bp, Homo sapiens
gtaaaaatacaggaagtctttttcatctttgtgtttctggtggaactcagggaaatcagtcattgtcaggatacagacagaatgagtaggaaatctacgakttgacctatgtctctcaagatccaaaacaacttcccacccctcccctctgtctgctcagtgccacccctctcccaggaatcattggtcatgagactgaga

SEQ ID NO: 15364 - DNA, 201 bp, Homo sapiens
tgtgggtgtctggagtgtcctgttgagtgatgatgtccacaggtggcatcgctcctccctggacctaccttgggaggggggcatcttctcttcctgtcgtrgtacctcttccatggcccccagcacttcaggcacccaaggacggcaattaccacaattgttatagaacattttaaaattcattatgggaaaagatgcctt

SEQ ID NO: 15365 - DNA, 201 bp, Homo sapiens; identical to SEQ ID NO: 2495

SEQ ID NO: 15366 - DNA, 201 bp, Homo sapiens
atacatatccatatatgtctacacacatttttttcccatgaactctttgaaagtaaggtgatcatgacctttatccctaaatacttcagtgttttatgacmtttatccttaaatacttcatcttctaggaatgaggacattttcccacattacactgaagaaaatcaacaataaagcacgaatatctactataatatccag

SEQ ID NO: 15367 - DNA, 201 bp, Homo sapiens
cctggagcctggagaggccgagatcaggggctggggccgagggtgacctctctgggctccagcttgtgaattcactggggacccctcccctaggcccctayggcgccaacatggaagacagcgtctgctgccgtgattacgtccgttaccgtctgcccctgcgcgtggtgaaacacttctactggacctcagactcctgcc

SEQ ID NO: 15368 - DNA, 201 bp, Homo sapiens
ctggttgtcctcgtcctccttgctgtggcgcttcaagcaactgaggcaggtgaggctggggagcaggaagaccccctacagaggccagggcagacggtggkgtgtcttcctcatgtcttggacaagcactggaccaagagcagaagacctcagtctgctgttggctcttgcggccttcggctagttgcagtgcttctctgg

SEQ ID NO: 15369 - DNA, 201 bp, Homo sapiens; identical to SEQ ID NO: 2501

SEQ ID NO: 15370 - DNA, 201 bp, Homo sapiens
catggccaaggccacacagtgcagagaccctggggagcacaagcctctaagagggggattttacaagtctgtctgaaaccagaggcgaggacagagttgagggggggtcccctctgagtggttccccgccaaagagaatttctccactttggaggaagtgggaggtagttcttcttttgagatgtgaatgtcaagtgactc

SEQ ID NO: 15371 - DNA, 201 bp, Homo sapiens; identical to SEQ ID NO: 2503

SEQ ID NO: 15372 - DNA, 201 bp, Homo sapiens
tacaggacagagcatggctcgcctacagactgcactcctggttgtcctcgtcctccttgctgtggcgcttcaagcaactgaggcaggtgaggctggggagmaggaagaccccctacagaggccagggcagacggtggggtgtcttcctcatgtcttggacaagcactggaccaagagcagaagacctcagtctgctgttgg

SEQ ID NO: 15373 - DNA, 201 bp, Homo sapiens
gtgggtatggcagtaggtagtcagtagctgtggcatctagggtatttgggtatagcaggtataggagtatacctagtgccactgagtcagcaaagatgctyccaggttctgggcaaaaatggatggtgaaccaggcgtggtggctcatgcctgtaatcccagcattttgggaggccgaggcaggcagatcacttgaggtca

SEQ ID NO: 15374 - DNA, 201 bp, Homo sapiens
tgaggcaggagaatcatttgaacctggaaggtggaggttgcagtgagccgagatcgctccacctcactccagcctgggcaacagagggagactctgtctcaaaaaaaaaaaaaaaaaatgctcacaccagaagtgtcttggatcctctccaggctcccagaagtccaaggcagcccattttgaccagaagaataacattaa

SEQ ID NO: 15375 - DNA, 201 bp, Homo sapiens
accacgccaggctaatttttgtatttttagtagagatggggtttcaccattttggccaggctggccttgaactccagacctcaggtgatccacctgcctcrgcctcccaaagtgctgggattacaggcgtgagccactgtgcctggccccctgttttttctttttcttttctgagatagggtctcactctatcacccaggc

SEQ ID NO: 15376 - DNA, 201 bp, Homo sapiens; identical to SEQ ID NO: 2509

SEQ ID NO: 15377 - DNA, 201 bp, Homo sapiens; identical to SEQ ID NO: 2498

SEQ ID NO: 15378 - DNA, 201 bp, Homo sapiens; identical to SEQ ID NO: 2499

SEQ ID NO: 15379 - DNA, 201 bp, Homo sapiens; identical to SEQ ID NO: 2500

SEQ ID NO: 15380 - DNA, 201 bp, Homo sapiens
gcacctggctgggtgacaagtcctgccctctctgcggtagcctctctggctgcttctccaactgctcagagcctgctgcctaccaaatctcacacctgggraggctgggtttggggactcatgacccactttgggcctctattatcttctcatcttcctcctccttattgctgacaccatctcttagagggatctgcaggt

SEQ ID NO: 15381 - DNA, 201 bp, Homo sapiens; identical to SEQ ID NO: 2502

SEQ ID NO: 15382 - DNA, 201 bp, Homo sapiens; identical to SEQ ID NO: 2496

SEQ ID NO: 15383 - DNA, 201 bp, Homo sapiens
ggtagagatggagaaacaggcttagcaagggacagtgacctgctcaaggctgcccaggttggagccagaactcactcctggttcctcgttcagggctttcycctgagtttcttgttctcctttgcttctttctctggcttctttgcctccttttccctggcctggggcctgcacctgcacctggctgggtgacaagtcctg

SEQ ID NO: 15384 - DNA, 201 bp, Homo sapiens
aataatgtgatcgtttagccaatatcctcaggcgcttactaggtgccaggcaacatgtcaggttctgaggatgcagagctgagtgaacagggtgccaccasagtgtgggtatggcagtaggtagtcagtagctgtggcatctagggtatttgggtatagcaggtataggagtatacctagtgccactgagtcagcaaagat

SEQ ID NO: 15385 - DNA, 201 bp, Homo sapiens
catccattttttaaaatgttattattattattttttattttattttattttattttttgagacacagtttcactcttgttgcccaggatggagtgcagtgrggcaatcttggcccactgcaacctctacctcccaggttcaagcgattctcctgcctcagcctcctgagtagctgggattacaggcatgcaccaccacacc

SEQ ID NO: 15386 - DNA, 201 bp, Homo sapiens
atgaagttggactcaatccttctttcagcagaccctgcaccaagcccctgctgacttcaggctccctgctgggctctggagatgcatagatcaacaaggtsccccaggagcttgggattctaagaggggaaatttaggggtccatcctgatgtgggcgaggcattctctggatcaaagaagagcttgtcagacccaggatg

SEQ ID NO: 15387 - DNA, 201 bp, Homo sapiens
tctcctgcctcagcctcctgagtagctgggattacaggcatgcaccaccacacctggctaatttttgtatttttagtggagacagggtttcaccatgttgsccaggctggtctcaaactcctgacctcagatgatcctcccacctcagcctcccaaagtgctgggattacaggcatgagccactgcgtctagcctaaattt

SEQ ID NO: 15388 - DNA, 201 bp, Homo sapiens
aatttattttttatttcattttatttatttattttttgagatggagtctctgttgcccaggctggagtgcagtggcgcaatctcagctcactgcaacctcyacctctggagttaaagtgattctcctgcctcagcctcctgagtagctgggattacaggcacctgccaccatgcccggctaatttttgtatttttagtaaa

SEQ ID NO: 15389 - DNA, 201 bp, Homo sapiens
gagtatacctagtgccactgagtcagcaaagatgcttccaggttctgggcaaaaatggatggtgaaccaggcgtggtggctcatgcctgtaatcccagcaytttgggaggccgaggcaggcagatcacttgaggtcaggagttcaagatcagcctggtcaacatggtgaaaccccatctctactaaaaatacaaaattagc

SEQ ID NO: 15390 - DNA, 201 bp, Homo sapiens
caggcagatcacttgaggtcaggagttcaagatcagcctggtcaacatggtgaaaccccatctctactaaaaatacaaaattagctgagtgtgatggtgcrtgcctgtggtcccagctacttgggaggctgaggcaggagaatcatttgaacctggaaggtggaggttgcagtgagccgagatcgctccacctcactccag

SEQ ID NO: 15391 - DNA, 201 bp, Homo sapiens; identical to SEQ ID NO: 2504

SEQ ID NO: 15392 - DNA, 201 bp, Homo sapiens; identical to SEQ ID NO: 2505

SEQ ID NO: 15393 - DNA, 201 bp, Homo sapiens
acctatctctactaaaaatacaaaaattagctgggtgttgtggcgggcacctgtaatcccggctactcgggagcctgaggcaggaggatcgcctgaacccrggagttggaggttgcagtgagccaagatcgtaccactacactccagcctgggtgacagagactccatctcaaaaaataaaaacaaaacaaaacaaaaaca

SEQ ID NO: 15394 - DNA, 201 bp, Homo sapiens; identical to SEQ ID NO: 2506

SEQ ID NO: 15395 - DNA, 201 bp, Homo sapiens
ccgagggtgtggcatccttgctgcgtgctaatgttgctgcattgtctctggggtctccttcttccaggttgctaaccttcagggataaggagatctgtgcygatcccagagtgccctgggtgaagatgattctcaataagctgagccaatgaagagcctactctgatgaccgtggccttggctcctccaggaaggctcagg

SEQ ID NO: 15396 - DNA, 201 bp, Homo sapiens
aagtaagtgaggcttgtgggtggagccagcaccttaaatagcaggtcttcctatgtccctttgcagacacctgggctgagacatacaggacagagcatggmtcgcctacagactgcactcctggttgtcctcgtcctccttgctgtggcgcttcaagcaactgaggcaggtgaggctggggagcaggaagaccccctacag

SEQ ID NO: 15397 - DNA, 201 bp, Homo sapiens
attttcctgtgttggaagagagggttctttaaagcagattgcataattatctcctcatgaggataaatgggaaacagaaaagtcggtttaaggagattcastcagattagacattatcatttaaggagtgggaatgagtggaggagaaaggccagtctgggaaatgggatgttaggtggagaccttcagggtacagtcttg

SEQ ID NO: 15398 - DNA, 201 bp, Homo sapiens
tattagtatatagatcctgtgtataaatcaattttccatctgtgaaaagttaagaaagctgtagattcaattcattaaaaaattccccctggacccagatrtctatcgtatcccactccgctggtataaattggaagaaaaatatttttagctcaattagttttaggagtgatacatgttcagctagataactgtgtgctt

SEQ ID NO: 15399 - DNA, 201 bp, Homo sapiens
agatattttttagccattcatttgtcatgaaatacgttccgctagctggaacgtctcacataagggtaagcacggtccctttgtagatgcctcggatctgwaactcctggtacaacttctttgcacagtccaaggttccagtgtacttggtttcccctgaagaaggctgaaagtgtaacaaggacttgatgggttctccag

SEQ ID NO: 15400 - DNA, 201 bp, Homo sapiens
gaagggatacttgagcacatcttgcgggactgccattgcccagttgaagatccctgcaatgcacccagccaccaggattcaaggcacactgagctcacagrccctctttccttccggagtgaagatattttttagccattcatttgtcatgaaatacgttccgctagctggaacgtctcacataagggtaagcacggtccc

SEQ ID NO: 15401 - DNA, 201 bp, Homo sapiens
atttggtccttttcctgtcatccctttctttagggtcccccttttgttccccttcgggaaatggaataaaaaaaaaaacccctgcattcgtcagtaactcygggtcaaccacaacttaaagacagtaagcaggtcaatcgaaacaggggcaatgattgctataaaactaacaggtactctcattgatagaacacaggcata

SEQ ID NO: 15402 - DNA, 201 bp, Homo sapiens
tccaaaagcctgagagttgcccgcctgtgccaggaggtagtatgaagcttgacattggcatcatcaatgaaaaccagcgcgtttccatgtcacgtaacatygagagccgctccacctccccctggaattacacgtaagtgcaaatgagactgattttcacattctttggaaaaatatgttaattcattctaatcataaagt

SEQ ID NO: 15403 - DNA, 201 bp, Homo sapiens
ggattcaaggcacactgagctcacagaccctctttccttccggagtgaagatattttttagccattcatttgtcatgaaatacgttccgctagctggaacrtctcacataagggtaagcacggtccctttgtagatgcctcggatctgaaactcctggtacaacttctttgcacagtccaaggttccagtgtacttggttt

SEQ ID NO: 15404 - DNA, 201 bp, Homo sapiens
agaaaaccttgggacggtagtgccccctgcctcgaactgggaagatatggagagatcaaagaatgacttggacaagtccagcttagcgagtggatgagtttattaagacttactatggggcgccctagggccacagcaggacagatctagagatccgctctgcctcccatctctaagctgctcttaagcgaattttctggc

SEQ ID NO: 15405 - DNA, 201 bp, Homo sapiens
ccttccctaccttaactcatggaaggtgtgagcctgaacaacgctaagcctagagaataaaagcaacttattttcagctctttttttttttttttttttttccaagcaggagtctcgcactgtcgcccaggctggagtgcagtggtgcaatttcggctcactgcaacctccacctcctaggttcaaaggattctcctgcct

SEQ ID NO: 15406 - DNA, 201 bp, Homo sapiens
ctactaaaaatacagaaattaggtcgagcctggtggctcacgcctgtaatcccagcactttgagaggctgaggtgggtggatcacttgaggtcaggggttygagaccagcctgactaacttgaaaccctgtctctactaaaaatacaaaaattagctgggcatgggtcagttgcctgtaatcccagctactcgggaggctg

SEQ ID NO: 15407 - DNA, 201 bp, Homo sapiens
tctttctcatggcatttattgggaggattaattaatatctttgagaataaatgagtctatactctgtactggcagatttgtgtatgcttaattttcagttaatttggccattctaataaacaacgactgataatgatagagaaagcattcagtaagtgttaactgttcatattaatattgttattattgtcctggaaattc

SEQ ID NO: 15408 - DNA, 201 bp, Homo sapiens
atctttctcatggcatttattgggaggattaattaatatctttgagaataaatgagtctatactctgtactggcagatttgtgtatgcttaattttcagttaatttggccattctaataaacaacgactgataatgatagagaaagcattcagtaagtgttaactgttcatattaatattgttattattgtcctggaaatt

SEQ ID NO: 15409 - DNA, 201 bp, Homo sapiens
catctttctcatggcatttattgggaggattaattaatatctttgagaataaatgagtctatactctgtactggcagatttgtgtatgcttaattttcagttaatttggccattctaataaacaacgactgataatgatagagaaagcattcagtaagtgttaactgttcatattaatattgttattattgtcctggaaat

SEQ ID NO: 15410 - DNA, 201 bp, Homo sapiens
cgttccgctagctggaacgtctcacataagggtaagcacggtccctttgtagatgcctcggatctgaaactcctggtacaacttctttgcacagtccaagrttccagtgtacttggtttcccctgaagaaggctgaaagtgtaacaaggacttgatgggttctccaggggtcgcgatgcctgtggtgaatgtaccagataa

SEQ ID NO: 15411 - DNA, 201 bp, Homo sapiens
gcatctttctcatggcatttattgggaggattaattaatatctttgagaataaatgagtctatactctgtactggcagatttgtgtatgcttaattttcagttaatttggccattctaataaacaacgactgataatgatagagaaagcattcagtaagtgttaactgttcatattaatattgttattattgtcctggaaa

SEQ ID NO: 15412 - DNA, 201 bp, Homo sapiens
aagttggaaataaaaacaagagctatcgtttattaagcctctatttttcttatacagatttataggtgttttatatagaacattctatttaatctcattaktagtctcataaagtgagcattattatccagttggaaggaagagaaactagaggctcagcaaggaagccaggataggattttaactcaatctcagaccctt

SEQ ID NO: 15413 - DNA, 201 bp, Homo sapiens
gcttcagttactagctaggctactgagtttagttctcagtttggcaccttgatacctttaggtgtgagtgttcccatttccaggtgaggaactgaggtgcraagagaagccctgatcccataaaaggacaggaatgctgagttccgccagaccatgcatctcttgctagtaggtgaggcgagtctctaactgattgcagcg

SEQ ID NO: 15414 - DNA, 201 bp, Homo sapiens
aagtagggtagaaggaaagaaaaatttggtccttttcctgtcatccctttctttagggtcccccttttgttccccttcgggaaatggaataaaaaaaaaaacccctgcattcgtcagtaactccgggtcaaccacaacttaaagacagtaagcaggtcaatcgaaacaggggcaatgattgctataaaactaacaggtact

SEQ ID NO: 15415 - DNA, 201 bp, Homo sapiens
gtattctaggcagtgtattctaggtagaggggtggctccgaagaaggattttgtgggagattcatgggatatcaagttggaaataaaaacaagagctatcrtttattaagcctctatttttcttatacagatttataggtgttttatatagaacattctatttaatctcattagtagtctcataaagtgagcattattatc

SEQ ID NO: 15416 - DNA, 201 bp, Homo sapiens
tgttaaactaaatgtgtacatttattttatcattattcccagcaatctcatattattatcttactggtttatatgtgcgtgttcacttttttccatgactrttttaagctcattaaggtagagactgtaataatacagtctattgcctgtgctactagccccaacaaaatgtatcatggctccaagcacatatgagggcat

SEQ ID NO: 15417 - DNA, 201 bp, Homo sapiens
cacacagcaaagatgggggtgacaccgatgataggggcagccattcccttatatagccctgtgatgtcccttctaagagtctttgggagagagtcaaaggycccagagtacatgggaggctgtctaggcaaactcggtggctgtgtctgcagtcggaccttgacagtgtccagagggtgccccatgaacaccaggcacatg

SEQ ID NO: 15418 - DNA, 201 bp, Homo sapiens
tcccatccagcaagagaccctggtcgtccggaggaagcaccaaggctgctctgtttctttccagttggagaaggtgctggtgactgttggctgcacctgcrtcacccctgtcatccaccatgtgcagtaagaggtgcatatccactcagctgaagaagctgtagaaatgccactccttacccagtgctctgcaacaagtcc

SEQ ID NO: 15419 - DNA, 201 bp, Homo sapiens
tcactgcatcagaccctttagacaaggatgtgattccttcatcccagatcagctccctcagcacatctccaaaactgttaggatatttcccaggaggtgcrtctggaagggatacttgagcacatcttgcgggactgccattgcccagttgaagatccctgcaatgcacccagccaccaggattcaaggcacactgagctc

SEQ ID NO: 15420 - DNA, 201 bp, Homo sapiens
gtaagtatcaaagtagattccagggacaattgaagtgcttctggggttgtcacatagcttctcatgtgagtgtgttatgagaaaaccttgggacggtagtrccccctgcctcgaactgggaagatatggagagatcaaagaatgacttggacaagtccagcttagcgagtggatgagtttattaagacttactatggggcg

SEQ ID NO: 15421 - DNA, 201 bp, Homo sapiens
aatgcacccagccaccaggattcaaggcacactgagctcacagaccctctttccttccggagtgaagatattttttagccattcatttgtcatgaaatacrttccgctagctggaacgtctcacataagggtaagcacggtccctttgtagatgcctcggatctgaaactcctggtacaacttctttgcacagtccaaggt

SEQ ID NO: 15422 - DNA, 201 bp, Homo sapiens
ggtggcatataagagttcaagtcatgctctggatttctctgagaggtgctgtttaaatcattcttaagaaccagcaacagcctggttcagagcccctgctytgtattacataaccactaaaatctacagtttcagatcaaaagctttgtggagcaaattggagtatttgcagacatcatctgatttcctgataacgagcta

SEQ ID NO: 15423 - DNA, 201 bp, Homo sapiens
ctcttaagcgaattttctggctctttgcctactgtgtgtgtccaatgggactgttttccttggtaggttctcagatactctctgagatgtttgggttctcrgtggcctgctccttggctgtgcatggtggccttggctcactgcccgtccttcagggttcagacagtggacacacaccctcaagtaacctggtgggggtcc

SEQ ID NO: 15424 - DNA, 201 bp, Homo sapiens
ctggtcgtccggaggaagcaccaaggctgctctgtttctttccagttggagaaggtgctggtgactgttggctgcacctgcgtcacccctgtcatccaccrtgtgcagtaagaggtgcatatccactcagctgaagaagctgtagaaatgccactccttacccagtgctctgcaacaagtcctgtctgacccccaattccc

SEQ ID NO: 15425 - DNA, 201 bp, Homo sapiens
tacccctcggaagttgtacaggcccagtgtaggaacttgggctgcatcaatgctcaaggaaaggaagacatctccatgaattccgttcccatccagcaagrgaccctggtcgtccggaggaagcaccaaggctgctctgtttctttccagttggagaaggtgctggtgactgttggctgcacctgcgtcacccctgtcatc

SEQ ID NO: 15426 - DNA, 201 bp, Homo sapiens
tttttggaattacttcttaaaaaacagagatgactttaattttgactcctgtctggtggagaaaaagaaaaaaataactagaaaagttataatggcataamaatgcagctcctggccaggcgtggtggctcatgcctgtaatcccagcactttaggaggccaaggcgggcgggtcacatgagttcaggagttcgagaccag

SEQ ID NO: 15427 - DNA, 201 bp, Homo sapiens
atctagccccagcaggtctggaatcttgcctgacattagtcagataaggcctgagaagaatttactatagaggtacatgaaaacaggggttaggaaatccygcatcatattattggcttagataatttcctttttttctccttttacaagccatacaacttaaaagagcttgaatatcataaaaggttcatggcatatagc

SEQ ID NO: 15428 - DNA, 201 bp, Homo sapiens; identical to SEQ ID NO: 2518

SEQ ID NO: 15429 - DNA, 201 bp, Homo sapiens; identical to SEQ ID NO: 2520

SEQ ID NO: 15430 - DNA, 201 bp, Homo sapiens; identical to SEQ ID NO: 2521

SEQ ID NO: 15431 - DNA, 201 bp, Homo sapiens
gagtcacacagacccgggttcaagtctcacttccactgctcgttaactgaggggatttggacaaagtaccccagctttctgtgcagttaacctgcaaaacyccaagaataatccttcgcgggactggtgaggatacatggggtgtaggagatgagcattaaacacgtgctcccctacgctgctcctaacctccctgtctcc

SEQ ID NO: 15432 - DNA, 201 bp, Homo sapiens
tctggtggatggtgattcatctttacgagatagcatctctaaattgcaccacagctgcatcttaaagatcattgatctgccattaatctatcaggctggcrgcttctgggaaatgcagtatttggtaaaaccaggaaattccatggtcatattgccacttctgtaactcttttgctacaaattttgccccttggtctaatg

SEQ ID NO: 15433 - DNA, 201 bp, Homo sapiens
tgaatgacatacaatcctctgatgaagaaggcatggccttgcttcagagcacaagtattatgaactgtattttgttttgcattgggattgtcataaactayacatggtatcaattcccactacagataactaattccagagggtctgccaaataatatggcccatgcggtgaagctgcttacgttgcattgtggaccagct

SEQ ID NO: 15434 - DNA, 201 bp, Homo sapiens; identical to SEQ ID NO: 2522

SEQ ID NO: 15435 - DNA, 201 bp, Homo sapiens
catggacgctgaagttggatggcaaccttcagctagactgcctggctcaagggtggaagcaataccaacagagagcatttggctggtgagtgtgggtttcycaggcaatagctcttctgagaagagaggctcaggctcagcttagcatgatttattcctctgagagcttgttgaaggagtaaatgtcaccagggcctccat

SEQ ID NO: 15436 - DNA, 201 bp, Homo sapiens; identical to SEQ ID NO: 2523

SEQ ID NO: 15437 - DNA, 201 bp, Homo sapiens; identical to SEQ ID NO: 2514

SEQ ID NO: 15438 - DNA, 201 bp, Homo sapiens; identical to SEQ ID NO: 2515

SEQ ID NO: 15439 - DNA, 201 bp, Homo sapiens; identical to SEQ ID NO: 2516

SEQ ID NO: 15440 - DNA, 201 bp, Homo sapiens; identical to SEQ ID NO: 2517

SEQ ID NO: 15441 - DNA, 201 bp, Homo sapiens
gatcttcaacccaggtatgagggatgcagtctgtttctccaggtgtgagagattagctacactactcaccagaggcaacgtgttacagcaggtaaatgagwtgaatttcagatggcctgagattagcagcatgcctctaacatttaccctgtgtgtccttaagcaggttgcgtatccttttcatgattcagtttccttatc

SEQ ID NO: 15442 - DNA, 201 bp, Homo sapiens
catggtgctatccgaggagaactcaggcatctcatattgggaccaggagcacttctggcacctttggccaaagagcctcatacgcacctgaccctgggatytccagtgctcccagtacgtgtggcacagaatctgcacttgggcggaagcccaacttcgctggcaggaggaacaccggaacctgcagtcagaaggaagaca

SEQ ID NO: 15443 - DNA, 201 bp, Homo sapiens
ggaaatgtgtaaatatttctgtccacaccagccagagctttttgagggactcatgatgtcttacaacgttttggcactcctccaaacagaaagaaggtgtktctcctgttgggatgatttgatttgattgtcatttcgagatcggaaaagcaacctaccagtgtacttttggaaaatatcaatcagcttttgaaaagcatt

SEQ ID NO: 15444 - DNA, 201 bp, Homo sapiens; identical to SEQ ID NO: 2524

SEQ ID NO: 15445 - DNA, 201 bp, Homo sapiens
gagtgcccattggtgtattcacaatcccttagctagacataaaggttctccaagtccccactagactcaggagcccagctggcttcacccagtggatcccrccccgggggcagcaggtggagctgcctgccagtcctgcgtgtgtgcccgcacttctctgcccttgggcggtcgatgggaccaggcaccatggagcagggg

SEQ ID NO: 15446 - DNA, 201 bp, Homo sapiens
cccagagtttgttccttctgatgttcggatgtgttctgagtttcttccttctggtgggtttattgtcttgctggctcaagagtgaagctgcagaccttccsggtgagtgttaacagctgataaaggcagagcagacccaaacactgcgcagcagcaagattcattgcaaaaaccaaaagaacaaatcttccaccatgtgga

SEQ ID NO: 15447 - DNA, 201 bp, Homo sapiens
aggagcacttctggcacctttggccaaagagcctcatacgcacctgaccctgggatgtccagtgctcccagtacgtgtggcacagaatctgcacttgggcygaagcccaacttcgctggcaggaggaacaccggaacctgcagtcagaaggaagacacccattatgccttcatctggttgttaacctgagggaaaatggtc

SEQ ID NO: 15448 - DNA, 201 bp, Homo sapiens
gagggttctgccgggcatggtggctcacgcctgtaatcccagcactttgggaggctgaggcgggtggatcacctgaggtcaggagttcgagaccagcctgrccaacatggagaaaccccgtctctactaaaaatacaaaaactagctgggtgtggtggcacattcctgtaatcccagctcctcgggaggctgaggcaggag

SEQ ID NO: 15449 - DNA, 201 bp, Homo sapiens
gtagctggaattacaggcatgcaccaccacgcctggctaattttatatttttagtagagacgggatttcaccatgttgaccaggctggtctcgaactcctracctcaggtgatccgcttgccttggcttcccaaattgctgggattacaggcatgagccaccatgcccagcccatactgtatttacttttgtaattctttt

SEQ ID NO: 15450 - DNA, 201 bp, Homo sapiens
gatagcaattcattaatgagcacttgttagttatgattgttcaaacaattacctagccacctagttgcactgttatccatcttatatttatcttgtatatkggtgtaatgaaaacctggtcaaataccttattgaaatcctaccaacacactgtttttactgcctctttttgatctgtgacctatctgtacatacactctt

SEQ ID NO: 15451 - DNA, 201 bp, Homo sapiens
gatgatatcctgaattatgttttccatgttgcttacactctccccatgtcttaaaattaaaattggtcatattggattatagtgttatggctatatcttamcactgcaggtaaaatgagttccactatattagtgttttccagagaaacagagatagatgggtattggctgatcgtaaggaattggctcacgtgattatag

SEQ ID NO: 15452 - DNA, 201 bp, Homo sapiens
acagcatgtacctcctaatacaatacaccaaaaaagggtgtgtcatcacatctatggtgattatttccctgttgttttagattatacattttgaaaaaaaatcatagatttatataaaattttaagaaatacagagccgtcatgtgccctttgcctagttccccccaatggcaattaagttgcaaaacagtagtacagtgt

SEQ ID NO: 15453 - DNA, 201 bp, Homo sapiens
gcacttgcattgaatttgtgtatcaatttggaaagatttgctttttcttcatgtacagtcattccttggtacctatgggggattgatttcaggatcccccygtggataccaaaatctgtggatactcaagttccttatataaaagggtgtagtatttgcttgtaacctatgcacattctcttgtatactttaaatctctag

SEQ ID NO: 15454 - DNA, 201 bp, Homo sapiens
tctttttctttttctttttttttttagtagagatgagatttcaccatgttggccagactggtcttgaactcctggcctcaggtgatccacctgcgtcggcytcccaaagtactgggattacaggcatgagccactgcgcctggcccatggagtcaattttttgatgtccaaggagcggaagaaaagcctttctcagctctc

SEQ ID NO: 15455 - DNA, 201 bp, Homo sapiens
cctgcgtcggcctcccaaagtactgggattacaggcatgagccactgcgcctggcccatggagtcaattttttgatgtccaaggagcggaagaaaagcctktctcagctctcagagaccaattgccttttgtatttgttctttcctggccctcagccagttggatgatgcttgccgacattgaggtcagatcttcctgcct

SEQ ID NO: 15456 - DNA, 201 bp, Homo sapiens
aatgctctagtaaaaccatctgggcctggaggtttctttttcttgttgttgttgtttttgagtttaaaaattactaattcaattttcttgttattataggkctattcaaattattatcaaggaatgaatgtagatcattggcattttttcaggaattggtttatttcattctgagttgtcaaatttatgcttgtagagttg

SEQ ID NO: 15457 - DNA, 201 bp, Homo sapiens
ttagacactcggggctttcgactttagggattttgatcttttaagatttcaacatttgggattatggcatttggggttgtcttttgagattgtgatccaarcccagttgaatccacaggtacagaacccacggatatggagggccaatggtattctgagactctattgttaggtttatacatatttaggcttatatatgtt

SEQ ID NO: 15458 - DNA, 201 bp, Homo sapiens
agggcatggggaggttatcactaggccaagccaagactgtaagtgagccaaggaaccacacgttctgggtgcatggctggagcagacctcccgcagacccytcacactgtcagcagccagcagcggcagagccccttcctcctgcagagtcctccgcaccctccaccaagaaagtgtcatcacgttcactgtaaagcaatt

SEQ ID NO: 15459 - DNA, 201 bp, Homo sapiens
cttagctccatttatgagtgagaacgtatgatgtttggttttccattcctgagttactttacttagaataatagtcttcagtcctatccaggttgctgtgratgccattacttcattcctttttatgctgaccagtattccatcgtatacatatataccacattttctttatccacttgttgattgatgggcatttgggct

SEQ ID NO: 15460 - DNA, 201 bp, Homo sapiens
tgacaaatgattttcaattaaaatctgaacatttttccattatatgaagagactctgaatcttaattaaataagatccttctgtttttgctggcttttttrggataccattctggcaggggaaggggctgcatcctcattattgccagatggagctagaagtccagattccacacttgtcctccacggacaccctggagat

SEQ ID NO: 15461 - DNA, 201 bp, Homo sapiens
agaattgtctattcatgtccttagcccactttttgatgggattgtttttttccttgctaatttatttgaattccttgtagattctgggtattagtcctttrttgggtgtatagattgtgaagatttcctccaactctgtaggttgtctgtttactctgcttattttcatctttctttatttgccctgcatatctatttgtt

SEQ ID NO: 15462 - DNA, 201 bp, Homo sapiens
gtgggcaggaggtcttcagaatattggttgccttgtggagagggcatggggaggttatcactaggccaagccaagactgtaagtgagccaaggaaccacaygttctgggtgcatggctggagcagacctcccgcagacccttcacactgtcagcagccagcagcggcagagccccttcctcctgcagagtcctccgcaccc

SEQ ID NO: 15463 - DNA, 201 bp, Homo sapiens
tttttccattatatgaagagactctgaatcttaattaaataagatccttctgtttttgctggcttttttgggataccattctggcaggggaaggggctgcrtcctcattattgccagatggagctagaagtccagattccacacttgtcctccacggacaccctggagatgaggctcgttggtatctctgggtgggagtgg

SEQ ID NO: 15464 - DNA, 201 bp, Homo sapiens
aatgaggaaacattaaactgaaaatagattagtgatgtacttttctgaaaaattcggagattaactgaaagaccaacataagctttattatttagacatgscttttcagttcattttcacatttacatatgtaatgagatatagtatactatttaaatttaacattaggtgactaactttaagctctgttaaaatggctgt

SEQ ID NO: 15465 - DNA, 201 bp, Homo sapiens
tcaacgtctcaattttttaaagctgttgtatctactctagattgttcacatgttgattatatggatttgctctttttgagggagtcggtttactcggacaytaaaaaaacaaatagtggccggtcatggtggctcacgcctgtaatcccagcactttgagaggctgaggcggatggatcacctgaggtcaggagttcgaga

SEQ ID NO: 15466 - DNA, 201 bp, Homo sapiens
caaacaagagatggaaaccacacagtggattaaatggggaggaagtttaatagagagtattattaaactctgagaaattaaggaaattctatgcagtcccscagggccttgggagaatacccaaggaaagacaaagtgggaaggaggtcctttcaccaaggctgggggttcagcccaaaggacagcagagaaacgcactgc

SEQ ID NO: 15467 - DNA, 201 bp, Homo sapiens
agctgttgtatctactctagattgttcacatgttgattatatggatttgctctttttgagggagtcggtttactcggacattaaaaaaacaaatagtggcyggtcatggtggctcacgcctgtaatcccagcactttgagaggctgaggcggatggatcacctgaggtcaggagttcgagaccagcctagccaacatgggg

SEQ ID NO: 15468 - DNA, 201 bp, Homo sapiens
gcttctaaagatttctcacagatcttacaataactgaattggaggaaatatattttacatattttaaagtgatatggcacttacccagaaataaataatamtaactgatgttttcagtagaaaaaaaacaattgggaaattcctagattgtgctatttgcatttttattgacaaggttgctgattttaaaagtaagataga

SEQ ID NO: 15469 - DNA, 201 bp, Homo sapiens
aactgtttacctaaatgatttttccttttcttctccctcagtgtgagatggtatctcattgtggttttgatttgcatttctgtaatgatcagtgatgttgmgctttttttcatatgcttgttggctgcgtgtatgacttcttttgaaaagtgtctgttcatgttttttgcccactttttaatggtttttttttcttgtaaa

SEQ ID NO: 15470 - DNA, 201 bp, Homo sapiens
actttctctcctgccagccatgtgaaaatgtacctgcttcccattcaccttccaccatgattgtaagtttcctgagacctccccagaagcagacgcctgtwcattctgcaaaaccatgagccaattaaacctcttttctctgtaaattacccagtctcaggtagttctctatagtagtgcaagaatggatgaatgcgtgca

SEQ ID NO: 15471 - DNA, 201 bp, Homo sapiens
gaaatggtagctcattgcggttttgttttgcatttatctaatggctaatgatgtgttgagcattttttcatttgcttattgaccatctttaaagacatatytattcaaatccttttgatcattttaaaattagattgtcttcttattgaattctaagagttctttatatattctgatataaatcttttgccatatatatga

SEQ ID NO: 15472 - DNA, 201 bp, Homo sapiens
acgcctgttcattctgcaaaaccatgagccaattaaacctcttttctctgtaaattacccagtctcaggtagttctctatagtagtgcaagaatggatgartgcgtgcatctattgagataattgtgtggttgtctttagttatgtgatgaatcatattttttgatttgtgtgtgtatgttgatccaaacttgcattccag

SEQ ID NO: 15473 - DNA, 201 bp, Homo sapiens
cttgcatatatgcctatagtcttattcaactcttgttttacttatcttctgtatctatctgaaagctcctatagaagcatgactacatactctacttcatyttatttccccatagcatctgacttagtagcataaacatggtagatatgcaataaggatttgctagctgagtaaataagccatgcgtctggtggtctgtct

SEQ ID NO: 15474 - DNA, 201 bp, Homo sapiens
acactaaagaagttatacatgcaattttaaaatgaaggaactaggatcttgcatatatttctgattgagaatttcagcttgttgggaaatatgcaaacttyagcgtcctcacagctcaaagtacaaaaatattggtgtattgactgccagtggggcagaatgaagggccaggccacaaaaaatattggctataataaatac

SEQ ID NO: 15475 - DNA, 201 bp, Homo sapiens
gaactgaactgtgcatgcaatttacctcaggccactcattttttttcagtagatttacctttctaattatattttgcttgcacaaatatttaaattacttygcattccctgagagcagtatacttcttgtgtcaaggaggacacacatttaacaaccataaaactatctgcaaaagcaaaaagctcattttccccccaaag

SEQ ID NO: 15476 - DNA, 201 bp, Homo sapiens
ccacctatccatgctaaaattggtgaaagtatggtgacaaacaggatatttgcacagtcctaaaatatcttacaaagagaaaaatagtaactttataatgragaaacctagacaggcaccacaaagttaataaacatcacctgtaacgaagtttatcaacagcatgtacctcctaatacaatacaccaaaaaagggtgtgt

SEQ ID NO: 15477 - DNA, 201 bp, Homo sapiens
cagtaaacccttaattacgattgttcagagaatatagtggttattgaatttcttggctaaatcgccagaaacccgtttcaatccttgctgttgaagaagtktgttcattttattctcatagtaaacataattgaatctgataattcaggatcttgcagtgcctcggagctatgtgaacatggattctcggcctaggatacc

SEQ ID NO: 15478 - DNA, 201 bp, Homo sapiens
ctgcttttgcaactgctgttttagggagatattcattctttccactatggcttgtccttgagaattgtatgggatgccagtaatgtgtttaatattccacrtagagaaaaatgtagctagagcttggctagtataacctggggcattgtctgttttaatagaagctggaatgcccatcaccgcaaaacactggaaaaggtg

SEQ ID NO: 15479 - DNA, 201 bp, Homo sapiens
ggcattattgccagccaaaatggataaatatgcccaataagtataattgttctctgtgtcagcccttgttgaaggaatactcacggcagtggtgataaccrctatcatagctaccattaaattattcattgtgactgactgtccccctttcctccggttttcttctgccatctgtgacagctttttgatctgtccccagat

SEQ ID NO: 15480 - DNA, 201 bp, Homo sapiens
tgcagagattttgtttatggccagttttggggccagtttatggccagattttgagggggggcctgctcctaacacgtcccccttattcgatttgcaaatcrataaaagcaagggcagctttgtcatggtgagctacttctcgcaggagtcaggatccacatctgcagactatacaaagacaaacaacacagattaaaagca

SEQ ID NO: 15481 - DNA, 201 bp, Homo sapiens
tggccatcacaaacatgtcacagtgctgcagagattttgtttatggccagttttggggccagtttatggccagattttgagggggggcctgctcctaacaygtcccccttattcgatttgcaaatcaataaaagcaagggcagctttgtcatggtgagctacttctcgcaggagtcaggatccacatctgcagactataca

SEQ ID NO: 15482 - DNA, 201 bp, Homo sapiens
gaatggctttaagcggttttccgccctgggtgggccaggtgttccttgccctaattcccataaacccacaaccttccagcatgggcgttatggccatcacraacatgtcacagtgctgcagagattttgtttatggccagttttggggccagtttatggccagattttgagggggggcctgctcctaacacgtccccctta

SEQ ID NO: 15483 - DNA, 201 bp, Homo sapiens
tagaggtgtgaagtgggaaatcaggggtctcacagcctgcagagctgagagcccgaacagagatttacacacatatttattaacagcaagccagccattcrcattgtttctatagatattaaattaactaaaagtatcccttatgggaaatgaagggatgggccgaatgaaaggaataggttgggctagttaactgcagca

SEQ ID NO: 15484 - DNA, 201 bp, Homo sapiens
gcattgtgagttgctttttgtacttagtgtgagacagggatctaattttctttcttttgcatgtgtgccaagaacagctcagtcagggagaccctaacccrgcagcgctagaggaattaaagacacacacacagaaatatagaggtgtgaagtgggaaatcaggggtctcacagcctgcagagctgagagcccgaacagag

SEQ ID NO: 15485 - DNA, 201 bp, Homo sapiens
tttgatgaaatcaaatttactttttctttcattgcttatgctttaacaaaacattctctaattcaagatcataaagatttattcctatgtattcttctaaraatttatagttttagctcttatgtttagttccatgatgcattgtgagttgctttttgtacttagtgtgagacagggatctaattttctttcttttgcatg

SEQ ID NO: 15486 - DNA, 201 bp, Homo sapiens
catcatttcacttccactaagaacatgcggtatttggttttctgtttctgcattagtttgctaaggataatggcctccagctccatccatctctctgcaaaggacttgatctcattcttttttatggctgcatagttttccatggtgtatgtgtaccactttttctttatccagtctatcattgatgggcatttgggttga

SEQ ID NO: 15487 - DNA, 201 bp, Homo sapiens
tatgcttgctggggaataggaaaatgagaaccaggtggcaaatgaccagtcactcaaccagtttcttgttacagtcagaatatagtcagaaaatgggccaygagtgacttctatttattttttttgatacagaatctcgctctatagctcaggctggaatgcagtggtgtgatcttggctcactgcaccctccgcctccca

SEQ ID NO: 15488 - DNA, 201 bp, Homo sapiens
atcagcctcccaaaatgccgggattacaggcgtgaaccaccgcgcccggcttctcttagcacaaatttcaagtgccatatataacatattattattaactrtagtcaccgtgctgtactttaagtccccagaacatactcatcttaaaactgcaagtttgtaccctttattggtcattaatttgtttcttgaaaacttggt

SEQ ID NO: 15489 - DNA, 201 bp, Homo sapiens
tggctaaagaaggaaagaaccatcatgtcccatctccagtaagacttgcagatatgaaagaacattcatttattcatttattcaacaaacatttgttgagyatctattatatgccagacatatacaatgtaatactgccttggggacatattagaacatagaactagacacactcctgcctttttaggcatatgaagagaa

SEQ ID NO: 15490 - DNA, 201 bp, Homo sapiens
cattgtgaattttaccttgttagttgctggatatttattttttaagttcaggggtatgtgtgcaggtttgttataaaggtaaatttatgccataggagttygttgtaccaattatttcatcacccaggtattaaacctagtacctattagttatttttcatgatcctttccctcctcctaccctccaccttctggtatgca

SEQ ID NO: 15491 - DNA, 201 bp, Homo sapiens
tagtcaagtatatatgccgtataaaaatatatccaggatggtttgtcagcacagaagcagagtatctaagacttagggcatcaggaagacttctagaacgraggatgcccgagcttaaaggaaaacaggaattggctaaagaaggaaagaaccatcatgtcccatctccagtaagacttgcagatatgaaagaacattcat

SEQ ID NO: 15492 - DNA, 201 bp, Homo sapiens
atgtgcagaagatacaacatgaaccggtaaattggctaaattaggaaaaattcaaaatgatgcccacaattgtggctacttgtctctgggatttttaggascccccatctctgctttagctttttgttttgaaatcactttagacttacagattggatattttcagccctatttccttagcgtgtgggaggctttgctaga

SEQ ID NO: 15493 - DNA, 201 bp, Homo sapiens
agatacaacatgaaccggtaaattggctaaattaggaaaaattcaaaatgatgcccacaattgtggctacttgtctctgggatttttaggaccccccatcyctgctttagctttttgttttgaaatcactttagacttacagattggatattttcagccctatttccttagcgtgtgggaggctttgctagatgttgaatg

SEQ ID NO: 15494 - DNA, 201 bp, Homo sapiens
agaaaccatttcccaccctaaactttaccccagtcattgagggtggccgggacaatccagtgggccactacctattaaataaatatgtaggtgtatgtatmttataattagaacatagacacctggaaagtgaaaatctcccataattctgatgataaacttacatacatttaaaaactggaaaaatatatacattaacac

SEQ ID NO: 15495 - DNA, 201 bp, Homo sapiens
aaaataaggattatagtgtctatccacctacttcagagatatcagaaagacacaaatataaattgagatttagaaagtcgattgagtcttttagatgaaarttattatataccatgctgactttttcattgactataccaatgttgaatgattttattactagtttcttttgaggtgttactgaaatatttttaaagacat

SEQ ID NO: 15496 - DNA, 201 bp, Homo sapiens; identical to SEQ ID NO: 2526

SEQ ID NO: 15497 - DNA, 201 bp, Homo sapiens
attgactataccaatgttgaatgattttattactagtttcttttgaggtgttactgaaatatttttaaagacattgagtcctcagaaaccattatggccaygttaatatagtttgtgtaatatagatttcaagtgtctttttgtgtcttcacaggcaaatacatgtatcagcctatgacccctgtggaacagcttccaagc

SEQ ID NO: 15498 - DNA, 201 bp, Homo sapiens
ttgccttagcaaccaactcctctctttcaatatgggaatccaggagaaatttacagacatcattaccatcgtctgtaaagggacaaagtaatttgcagggrgagtttttaagtttaagtgtcttttcagtagtagagtaacacggtagagtggttcttgagatcatattattttaaaatgacttaacttgcgtagagtaca

SEQ ID NO: 15499 - DNA, 201 bp, Homo sapiens
gaggcacccagggaagttatttgggactctgtactgacagtaatgatgctgttctatatctgttttgtcatatatccctgaatttcacttgtctgagaagwcagatccttcagtctgtgactgacatccttttctatcatcttgcaacaacttctctaggctattttacctaggaaataggcctagagctttcagctgtca

SEQ ID NO: 15500 - DNA, 201 bp, Homo sapiens
ttagcagaggcttcccccacctttatttatatgccaaaaaactgcatgattagtttatagttgacccttgaacaacatgggtttgaactgcatgagtccaygtatgactgggttttacaaccaaatgtggattggaaatatagtattcccagggtgtgaaacccatgaataccgagggccaactgtgggacttgagtatgt

SEQ ID NO: 15501 - DNA, 201 bp, Homo sapiens
tgggccaggtgttccttgccctcattcccgtaaacccacaaccttccagcatgggtgttatgaccatcatgaacatgtcacagtgctgcagagattttgtktatggccagttttggggccagtttatggccagattttggggggcctgctcccaacacatgtggatatccagttgtcctaacatctacttaacctattgaa

SEQ ID NO: 15502 - DNA, 201 bp, Homo sapiens
aaataaaaactgtaattttaaaaagtcatgtctaatgtatttaatagtatttgtctttgactcacagaaaaaaataataatttaaaatttatgttcatagragcttttaaagagaaatagataattgaatttttaaaattatcaacatgctgggcactcaaggaatatttgttattaatgattaaactcagatattaatca

SEQ ID NO: 15503 - DNA, 201 bp, Homo sapiens
ttttttttgtcattttaggttgctccttccctggtccattggctagagagagcaggcattttttagggcttcttttgtctgctgccatttatgtttcctgrttgacaacttttttagccccaagtctggcaaataggaggagaaaaagatacacaagaaaataccagggaactcactaccgtgtggttgcttgggccccga

SEQ ID NO: 15504 - DNA, 201 bp, Homo sapiens; identical to SEQ ID NO: 2531

SEQ ID NO: 15505 - DNA, 201 bp, Homo sapiens
ttgagaatgctttctgagtttaagagaagggcaattatatgcagtatgaatatttttggaatggttgtgaactctataaaaccatgctttcaaaaacatttaataatgtatttgaatgaaataaaattaaaataagaggcaaaaaagactaggcagtttttattatttgtatgatacgaagcttcagtcatgtcttatcct

SEQ ID NO: 15506 - DNA, 201 bp, Homo sapiens; identical to SEQ ID NO: 2527

SEQ ID NO: 15507 - DNA, 201 bp, Homo sapiens; identical to SEQ ID NO: 2529

SEQ ID NO: 15508 - DNA, 201 bp, Homo sapiens
gctatatcttaccactgcaggtaaaatgagttccactatattagtgttttccagagaaacagagatagatgggtattggctgatcgtaaggaattggctcrcgtgattatagagactggtaagtccaaatctgcagtgtgggccagcagacaggccggagaccctggagagctgacagtgtggatgacgcccacgggaaat

SEQ ID NO: 15509 - DNA, 201 bp, Homo sapiens; identical to SEQ ID NO: 2536

SEQ ID NO: 15510 - DNA, 201 bp, Homo sapiens
catctattatgaagactggattcacagttcttttcctaagcttgttctttcaggaaaagcacttttaactcagtagttttatatgccattcctttgggggmgaataatcaaggatattcagtaagctctcttggcttcacttagttatttttgatattattgagatagaatattcaagtaacaaagacaatgttctttaaa

SEQ ID NO: 15511 - DNA, 201 bp, Homo sapiens
cttcccctaatgctttggatttcctcagtggcaccaattttgaaattggctggtttaactacagtttcaggagaaatgagaggtaattattaaagaaaaawacagaagtatattttctttgattacattgggaactataattcatgtatatgttaataatagctcattgatacttgaatgtgtttattatggttattaaaa

SEQ ID NO: 15512 - DNA, 201 bp, Homo sapiens
aactggagatctttgctgagacagtaaagtggatttttaaaaagctatagaatctcctttggggattttaatgtgaagattttgaataatatttttatcaygtgattatcattgcagtaagggaatggacaagtgatttcttgcatgtttaaaatttgtcagtgggctgtaccatctctccagggcttgttttgtggccat

SEQ ID NO: 15513 - DNA, 201 bp, Homo sapiens
ctgctatattgtatgtccctttttaaaaagttgtttcaaagtttgttttgaacaacatggaatataaatacatgtacatatgaattcagtaaaataagagrcaataaatatattaatactctgtttaaccggatatcagacttcaggcaaactctattataacaagatattaccacttggttactttttgttgagtggtaa

SEQ ID NO: 15514 - DNA, 201 bp, Homo sapiens
tgtctaatgtatttaatagtatttgtctttgactcacagaaaaaaataataatttaaaatttatgttcataggagcttttaaagagaaatagataattgawtttttaaaattatcaacatgctgggcactcaaggaatatttgttattaatgattaaactcagatattaatcacttgattaaatccatacattcatgctgt

SEQ ID NO: 15515 - DNA, 201 bp, Homo sapiens
ttgtgtccacctcactttttaaggctgttcatacctggcaatattcacttactctgctatttttaaaaactattttaaagttttaagcacaatgttgactsttctgtaatttcctaaaattatattgttttcctacagacagctcaactttccttgatatgtaacactctaggaaaataactgccttgtaaaataaacgtg

SEQ ID NO: 15516 - DNA, 201 bp, Homo sapiens
tctccaaccatcgctccagcgacccttcgacctggattcgagcccccacgatggatgccatttgccgagaccagctcggttggggagaccctaacccagcrgcactagaggaattaaaaacacacagagaaatatagaggtgtgaagtgggaaatcaggggtctcacagcctgcagagctgagagccccaaacagacattt

SEQ ID NO: 15517 - DNA, 201 bp, Homo sapiens
ttaaggcacagatcgctcatgctattgtttgtggcttaagaatggctttaagcggttttccaccctgagtgggccaggtgttccttgccctcattcccgtraacccacaaccttccagcatgggtgttatgaccatcatgaacatgtcacagtgctgcagagattttgtgtatggccagttttggggccagtttatggcca

SEQ ID NO: 15518 - DNA, 201 bp, Homo sapiens
tttttggttgtcacaactggagagttgcctactcatttctagtgagcaagaggtcagggatgctgctgaacatcctagaatgtagaggatagctcttcacragaattgtccagcctaaaacgtaaataataacagaaaccctgaattaaggcaagattgataagactacctttggttaatatatagtccttgagtagatat

SEQ ID NO: 15519 - DNA, 201 bp, Homo sapiens
tacatacctttgctttgctgtactgacacaacaaattaaggcagtggttctcaacagtggataattttgccacccaggggacatttggtaatgcctggaarcatttttggttgtcacaactggagagttgcctactcatttctagtgagcaagaggtcagggatgctgctgaacatcctagaatgtagaggatagctcttc

SEQ ID NO: 15520 - DNA, 201 bp, Homo sapiens
ccttattgaaatcctaccaacacactgtttttactgcctctttttgatctgtgacctatctgtacatacactctttttttaaaaaaaaacaagaaattagrttaatctggtaaaactcaggttgattccacaaatggttaccattttcttttctaaatggttagaaactgttttaaaataaataatctgaatttagaaaag

SEQ ID NO: 15521 - DNA, 201 bp, Homo sapiens
ccaagctccccttcttactcaccacagggattgctttaagagtactctggtgtcctccagctagttccacattctccaaccatcgctccagcgacccttcracctggattcgagcccccacgatggatgccatttgccgagaccagctcggttggggagaccctaacccagcggcactagaggaattaaaaacacacagag

SEQ ID NO: 15522 - DNA, 201 bp, Homo sapiens
cctattagttatttttcatgatcctttccctcctcctaccctccaccttctggtatgcagtgtgtgttgttcccctctatgtgtccatgtgttctcatcayttcacttccactaagaacatgcggtatttggttttctgtttctgcattagtttgctaaggataatggcctccagctccatccatctctctgcaaaggact

SEQ ID NO: 15523 - DNA, 201 bp, Homo sapiens
gatttatgtgcatgtcaaatggcaattattattttggaataaaaatgttaaaaatttaactcatgttcagtgactcaagtttgaaataatgtcatgagaayttttactgaacttgcattattggttattatttattgtatactgagagtttggtggcatgtaatattcaaaaaaagaaaatattaattagtttagacatgc

SEQ ID NO: 15524 - DNA, 201 bp, Homo sapiens; identical to SEQ ID NO: 2532

SEQ ID NO: 15525 - DNA, 201 bp, Homo sapiens
tttcacttccactaagaacatgcggtatttggttttctgtttctgcattagtttgctaaggataatggcctccagctccatccatctctctgcaaaggacwtgatctcattcttttttatggctgcatagttttccatggtgtatgtgtaccactttttctttatccagtctatcattgatgggcatttgggttgattcca

SEQ ID NO: 15526 - DNA, 201 bp, Homo sapiens
catttttttctctgtggattcataaaaatatcaactgtaaagggagatgctttctgccttcatcacattttgtaatcctttgagattttatgggaaaactrtagattttctgagttattagcattaatcaataggctctaggacctacttgtttgaaatgtgccctgcttgtattccagaccaaagtaatgaaatcctaat

SEQ ID NO: 15527 - DNA, 201 bp, Homo sapiens
atctctctgcaaaggacttgatctcattcttttttatggctgcatagttttccatggtgtatgtgtaccactttttctttatccagtctatcattgatggrcatttgggttgattccatgttgttgctactgtgaacagtgctgcagtgaacatatgcatgcatgtgtctttatgatagaatgattttatattcctttggg

SEQ ID NO: 15528 - DNA, 201 bp, Homo sapiens
ctttttattatactttttataatattccaggatgttatataaatggaatcgtgtagcatgtagctttgtccacttaacataaggatctcgagattcatccmtgctgtcgagtatatcagtagttgattcttttcttttgcagtttagcattccattggatgtaccacaatttgtttaacattcatcagctggtggatattt

SEQ ID NO: 15529 - DNA, 201 bp, Homo sapiens
gggtatttagtgctatacatttccctcttaacactgtcttagctgtgtcccagggattctggtatgttgtatctttgttttcattggtttcaaagaatttstttttctgcctaaatttcattatttacccaaaattcactcaggagcaggttattcaacttccatataattgtatggttttgacagaatttcttagttttg

SEQ ID NO: 15530 - DNA, 201 bp, Homo sapiens
tcatcatctcacaaccaagagaattaaggagcatggacacaaaggatgaggttggagggaaagtttaataagcaaaagaagaaagctgtccacagcggagkggggagccagagtggattgccgttttacagttgaactcaaaagcttttataagaaactcctgtcatctctgtagctgtttgagtaacttctcttatctga

SEQ ID NO: 15531 - DNA, 201 bp, Homo sapiens
tgtgtcatctctgatttctttgagcagtattttgtagttctccttggagagatctttcacctccctggttagctatattcctggttaattttttgtgtcarttgtgaatgggattgtgtttctgatttggctgttggcctgtttttggtatataggaatgctaatcatttctgtacattgaatttgtatcctgagactttg

SEQ ID NO: 15532 - DNA, 201 bp, Homo sapiens
gagtaacttctcttatctgaaaagctgtctgcataactctcccttatctgtgtagttgtgcgtatgtctctaggcatgcacaaagcaccctttctcttgtytgtataactgtgggtttcttttaggtaagtccccctcctccctgtgcaggttcccacagagcccaccatgtatatgcctgaaagggacaggagccttttt

SEQ ID NO: 15533 - DNA, 201 bp, Homo sapiens
atttacctagtaatgggattgctgggtcaaatggcagttctgtttttaggtctttgaggaattgccacacagttttccacaatgattgaactaatttacaytcccaccaacagtgtataagcattcctttttctctgcaacctctccaacacctgttattctttgactttttaataatagccattctgactggtgttgaaa

SEQ ID NO: 15534 - DNA, 201 bp, Homo sapiens
tgctaaggataatggcctccagctccatccatctctctgcaaaggacttgatctcattcttttttatggctgcatagttttccatggtgtatgtgtaccactttttctttatccagtctatcattgatgggcatttgggttgattccatgttgttgctactgtgaacagtgctgcagtgaacatatgcatgcatgtgtctt

SEQ ID NO: 15535 - DNA, 201 bp, Homo sapiens; identical to SEQ ID NO: 2530

SEQ ID NO: 15536 - DNA, 201 bp, Homo sapiens
ttgctaaggataatggcctccagctccatccatctctctgcaaaggacttgatctcattcttttttatggctgcatagttttccatggtgtatgtgtaccactttttctttatccagtctatcattgatgggcatttgggttgattccatgttgttgctactgtgaacagtgctgcagtgaacatatgcatgcatgtgtct

SEQ ID NO: 15537 - DNA, 201 bp, Homo sapiens; identical to SEQ ID NO: 2533

SEQ ID NO: 15538 - DNA, 201 bp, Homo sapiens
tttgctaaggataatggcctccagctccatccatctctctgcaaaggacttgatctcattcttttttatggctgcatagttttccatggtgtatgtgtaccactttttctttatccagtctatcattgatgggcatttgggttgattccatgttgttgctactgtgaacagtgctgcagtgaacatatgcatgcatgtgtc

SEQ ID NO: 15539 - DNA, 201 bp, Homo sapiens
tttgtgtatggccagttttggggccagtttatggccagattttggggggcctgctcccaacacatgtggatatccagttgtcctaacatctacttaacctrttgaacatatagaatacagttgtagtcattgttttagtatatttgctaattttaacatttgtgtcagttctgggtagattttaattgatactttctacat

SEQ ID NO: 15540 - DNA, 201 bp, Homo sapiens
tatttattaacagcaagccagccattagcattgtttctgtagatattaacttaactgaaagtatcccttatgggaaatgaagggatgggccgaatgaaagkaataggttgggctagttaactgcagcaggagcatgtccttaaggcacagatcgctcatgctattgtttgtggcttaagaatggctttaagcggttttcca

SEQ ID NO: 15541 - DNA, 201 bp, Homo sapiens
taaacattacctcttcacagaaacctttcctggctatgctatctagagtaggctctccctgttctttctaacagaatcatgcttcttttttttttttttttaatttccatagattttggggaacaggtggtaatttggtaatttgtgagattttggtgaacccgtcacccgagcagtatacactgaatccagtttgtagtc

SEQ ID NO: 15542 - DNA, 201 bp, Homo sapiens
taatagctttagcttctttccaggtaatgctgtatctgtgtttgagactagaggcattaacatgggttaaattgtgaaagtgtctagcattaaatattgcmttagcaactaggcgattggccatttgattcccttcagtcaaaggtcctggaagaaagaggtgtatgagccctaatgtgagtgatgtaaaaagggtgcatt

SEQ ID NO: 15543 - DNA, 201 bp, Homo sapiens
aaatgcaaatgtaaaaaaaggactttttttatttgttaagtttcagcatttttatgcttacacacacagtcaacattgtgataatgcagtttcacagagtsaattttttttttttttttttttttgagatggagtctcggtctgtcacccaggctggagtgcagtggcgcgatctcggctcactgcaacctctgtcctccc

SEQ ID NO: 15544 - DNA, 201 bp, Homo sapiens
taatttaaaaaaagaatgaatgtctaggtcttagttcctttcttcaagctaatctataccatatatcttctcagggagttagaaattagactttttcttamaagttgagataaaattataaaaagtttacagttctgcaacaacatttagtttttcagtaacaccttatttatctcatttttaggcccagtctttaaactg

SEQ ID NO: 15545 - DNA, 201 bp, Homo sapiens
ctcaacagtggataattttgccacccaggggacatttggtaatgcctggaaacatttttggttgtcacaactggagagttgcctactcatttctagtgagyaagaggtcagggatgctgctgaacatcctagaatgtagaggatagctcttcacaagaattgtccagcctaaaacgtaaataataacagaaaccctgaatt

SEQ ID NO: 15546 - DNA, 201 bp, Homo sapiens
tttctagtgagcaagaggtcagggatgctgctgaacatcctagaatgtagaggatagctcttcacaagaattgtccagcctaaaacgtaaataataacagraaccctgaattaaggcaagattgataagactacctttggttaatatatagtccttgagtagatatgacattctatctgtactataatatttgttttttcg

SEQ ID NO: 15547 - DNA, 201 bp, Homo sapiens
tcactggataatagctttagcttctttccaggtaatgctgtatctgtgtttgagactagaggcattaacatgggttaaattgtgaaagtgtctagcattaratattgccttagcaactaggcgattggccatttgattcccttcagtcaaaggtcctggaagaaagaggtgtatgagccctaatgtgagtgatgtaaaaag

SEQ ID NO: 15548 - DNA, 201 bp, Homo sapiens
aggattaactcctcctttaaaagatgaggaatgtaccatttggcaagttgggcatcactggataatagctttagcttctttccaggtaatgctgtatctgygtttgagactagaggcattaacatgggttaaattgtgaaagtgtctagcattaaatattgccttagcaactaggcgattggccatttgattcccttcagt

SEQ ID NO: 15549 - DNA, 201 bp, Homo sapiens
gcattgtctgttttaatagaagctggaatgcccatcaccgcaaaacactggaaaaggtgacgtttaacacaggcagaagactctcctgattggcatgtagyccagacaaagtgagaaaaggtgtccacacatacatgtacataagctagtctcccaaacgagggaacatgtgtgacatccatttgccaaagagagttaggt

SEQ ID NO: 15550 - DNA, 201 bp, Homo sapiens
ttctgccatctgtgacagctttttgatctgtccccagatgagtggctgtgttcgacgggtgttgcttgtgtcagttggggtcctcctcagcatcagcctcsacatggctgcaaccggggggtccttgggatcctcccagaatctcttcctcggcatctggctcatgataaagtttcaggtgtcttgatggtatccaaatca

SEQ ID NO: 15551 - DNA, 201 bp, Homo sapiens
tagagtgattacatccaggcattattgccagccaaaatggataaatatgcccaataagtataattgttctctgtgtcagcccttgttgaaggaatactcayggcagtggtgataaccgctatcatagctaccattaaattattcattgtgactgactgtccccctttcctccggttttcttctgccatctgtgacagcttt

SEQ ID NO: 15552 - DNA, 201 bp, Homo sapiens
tagtagagacagggtttcttcatgttggtcaggctgttctgaaactcccgacctcaggtgatccacccacctcggcctcccaaagtgctaggtttacaggygtgagccaccacgcccggcccatttggttattttcttagagcaatcaacttagaaagtattctttgacatttaagttgttaatttaaattgttacagatt

SEQ ID NO: 15553 - DNA, 201 bp, Homo sapiens
tatggagcttatgattctgtggttgatcatggtggttgtcctggtctggactggctcagcagatctctgttggactctcatgcttctgtgaccagctggtrggtctacatgatctgccatagccccattcatagttctagtggttgacagaccattggctggggatcagctgctcgccaactggagcacctcattctcctt

SEQ ID NO: 15554 - DNA, 201 bp, Homo sapiens
tgagacggagtctcgctctgtcacccaggctggagggcagtggcacgatctcggttcactgcaagctccgcctcctgcgttcacgccattctcctgcctcmgcttccctagtaactgggactacaggcacccaccaccatgcctggctaattttttgtatttttagtagagatggggtttcactgtgttagccaggatggt

SEQ ID NO: 15555 - DNA, 201 bp, Homo sapiens
ttgtgataatgcagtttcacagagtgaattttttttttttttttttttttgagatggagtctcggtctgtcacccaggctggagtgcagtggcgcgatctyggctcactgcaacctctgtcctcccaggttcaagcgattctcctgccttagcctcctgagtagttgggactacaggtgtgtgccaccatgcctggctaat

SEQ ID NO: 15556 - DNA, 201 bp, Homo sapiens
ttttttatttgttaagtttcagcatttttatgcttacacacacagtcaacattgtgataatgcagtttcacagagtgaattttttttttttttttttttttgagatggagtctcggtctgtcacccaggctggagtgcagtggcgcgatctcggctcactgcaacctctgtcctcccaggttcaagcgattctcctgcctt

SEQ ID NO: 15557 - DNA, 201 bp, Homo sapiens
gctccacaccagacagtagaaatcaataacgtctttagggcaaggtgatggaatgagtttcatggtacagaaaatgtaaaggcttctcaacttcaaatcaygtgtctaacctaaaataaggtgtttggataattcatcttgcctcctagctaaagtgctatattgcatgctttctcatgctcattttttactagctgagat

SEQ ID NO: 15558 - DNA, 201 bp, Homo sapiens
gttaaagatgctcctctttttctttctcacttttgtcttcctgggctgctatttaaaagaaggagcccttggatatccaattgtttcccccttgattgtayccaaattgagaaaaagcgctaatgtgggagggattgcttccaagaagttaatattaacagtttggaaggtcgagctccttaaatacccagatgtagaatt

SEQ ID NO: 15559 - DNA, 201 bp, Homo sapiens
acagcgggccatatcatatgaggttgaggtgccactataccaccatggttccagataataggaactcttgtcatactttttatcatttctgccatccgacsgttttgttcagaccagctgaacatagtgtggccgtggcatgcagactgacaggtgcaatttaagctaaacatctccttaggggaccaattaataatgatt

SEQ ID NO: 15560 - DNA, 201 bp, Homo sapiens
gcagtggcgcaatctcggctcactgcgacctccacctcctgggttcaggcgattctcctgcctcgttcctgagtagccaggattacaggcgtgcaccaccrtacccggctaatttttgtgggtttttttgttttgttttgttttgtttttgagacagagtcttcgctctgtcgcccaggctggagtgctgtggcgcgatct

SEQ ID NO: 15561 - DNA, 201 bp, Homo sapiens
tttctgttttttaaaaaatcaggactacagttatttgttcttttccagtctttggcagtcctccggttctccacacttcctccactggcagcagctcagtratcccattcactaaaagcttgacttcatttaaagcagctaggtgctctgttacaatctcctcagttatcctgggaattaattctctctatgctttttagc

SEQ ID NO: 15562 - DNA, 201 bp, Homo sapiens
tattttggaaactcagaataaaaatatgaatacagctggaccacactggaccccatatggaccattatggaccctatatgcagagtctaaggacacaatcrtactgtatttactgttttttttttttttttttgggagacagagtttcactcttgttgcccgggctggagtgtagtggcgcgatgtctgctcactgcaacc

SEQ ID NO: 15563 - DNA, 201 bp, Homo sapiens
cagctggaccacactggaccccatatggaccattatggaccctatatgcagagtctaaggacacaatcatactgtatttactgtttttttttttttttttkgggagacagagtttcactcttgttgcccgggctggagtgtagtggcgcgatgtctgctcactgcaacctccacctcccgggttcaagtgattctcctgcc

SEQ ID NO: 15564 - DNA, 201 bp, Homo sapiens
taacaacgaaatactgagtaactaggattgggaggaaggtcatgaatctagttttggatctgtaggatttaagctgcctttgtcctcacatggtgatgtcrgtaggcaattagatacagggatgtagaactcagaggagaggtctgggctagaaataatatgtaagtaatttacttacttataggttgcagttgtagctgt

SEQ ID NO: 15565 - DNA, 201 bp, Homo sapiens
taagctttccctttacaacaccagagtgttttcttttaggacatcagagtctgggtacaagaggataagctggcagaggagtctaagaagagatggctagrgaagaaaaatctggaaaatatggtattgcagaagccaggggaaattagtgttttaagaaagagtatgaagatgaaaccagttttcagcaggctaattatt

SEQ ID NO: 15566 - DNA, 201 bp, Homo sapiens
tttttttttttttttgagacagagtctagctctgttgcccaggctggagtgcagtgtcacgatctcagctcactgcaacctctacctcccacattcaagcratcctcctgcctcaacctcgagtagctggaactacaggcatgcaccaccacgcccagctaatttttgtatttttagtagagatggggtttcactatgttg

SEQ ID NO: 15567 - DNA, 201 bp, Homo sapiens
tttttttatttgttaagtttcagcatttttatgcttacacacacagtcaacattgtgataatgcagtttcacagagtgaattttttttttttttttttttttgagatggagtctcggtctgtcacccaggctggagtgcagtggcgcgatctcggctcactgcaacctctgtcctcccaggttcaagcgattctcctgcct

SEQ ID NO: 15568 - DNA, 201 bp, Homo sapiens
agatatatcaaaaaccacgatgggtcaccactacatatgtcctctttcaaagagccgagatctcaagaaatttatctttcacaaatgcaaatgtaaaaaaaggactttttttatttgttaagtttcagcatttttatgcttacacacacagtcaacattgtgataatgcagtttcacagagtgaatttttttttttttttt

SEQ ID NO: 15569 - DNA, 201 bp, Homo sapiens
actagctgggtgtggtggcacattcctgtaatcccagctcctcgggaggctgaggcaggagaatcgcttgaactcgggaggcagaggttgcagcgagccargatcgcgccattgcactccagcctgggcaacaagagcgaaactccctctcaaaaaaaaaaaaaaaaaaaaaaaaaaaatgagagttgtaactttgtctag

SEQ ID NO: 15570 - DNA, 201 bp, Homo sapiens
cagctgcttgggaggctgaagggggaggatcgcttgagcctaggagttcaagtccagtcttgacaacgtagtgagacctcatctcttaaaaaaaaaaaaaaggaaagaaaaatatatcaaaaagtgaaatgtataaaggcactatagttggtaattgtgtgtacccagctttgtaactgtagtcacccaaaatatcatgat

SEQ ID NO: 15571 - DNA, 201 bp, Homo sapiens
atccaccggctctgcatccggggattcaaccaatcattaattaaaaatacctgggaaaagaactaagaaataacaatacaacaataaaaaatacaaatagkccgggcgcagcggctcacgcctgtaatcacagcactttgggaggacaaggtgggcagatcacttgaggtcaggattttgagaccatcctggccaacctgg

SEQ ID NO: 15572 - DNA, 201 bp, Homo sapiens
ctaagtagccttcaaggttaatcagatacaaatccatttattttcagaaaaggagttagaaaactcaaaaacttctctgatttcattagtgggttttgttkttttttttttttttccgaaacagtctcgctctgtagccaggccggagtgcagtggtgcgatatcggctcactgcaacctctgcttctggggttcaggcga

SEQ ID NO: 15573 - DNA, 201 bp, Homo sapiens
ggcatgcaccaccaagcccagctaatttttctgttttttgtatggatgggatttcaccatgttgcccagaatggtcttgaactcctgagctcaagtgatcygcccacctcagcctcccaaagtgctaggattacaggtggcttctttctcatttcttcatgcttgcatgctactttgttgcatatatgtgtaatagatgtg

SEQ ID NO: 15574 - DNA, 201 bp, Homo sapiens
ttacaggcgtgagccaccatgcctggccagatatttgtagttcttttgtctgatgcatacacatttgggattgctgatatcttgttacactgacccttttkttcattatctgatgtccctctctgtatctggtaattttcttttctgtgaagttgactttagttgatattaatatagccataactgctttcttttggttaa

SEQ ID NO: 15575 - DNA, 201 bp, Homo sapiens
actgcgacctccacctcctgggttcaggcgattctcctgcctcgttcctgagtagccaggattacaggcgtgcaccaccatacccggctaatttttgtggktttttttgttttgttttgttttgtttttgagacagagtcttcgctctgtcgcccaggctggagtgctgtggcgcgatctcggctcactgcaagctccgcc

SEQ ID NO: 15576 - DNA, 201 bp, Homo sapiens
tttttctgactacacactctcttcctcttgtctcgcctttccccccaatacatttagaagaaagttgcagacatcatgacacttcataccaaaatatatcrgtatgccaaaaaaagagaaatatatcagtatgcctgtctcaagaatgaggacatttttctatgtaaccacaatactgtactcacacctaagataattaac

SEQ ID NO: 15577 - DNA, 201 bp, Homo sapiens
taggttcttccagagatagagaacgctgataggtgtctttctgtgtagctggtgcttcaatgatggatgcacgtaaacttcaacaataacaaataacacayatcatggctatgtgcaggcacataactttttgtaatcttttcgtatgtgtttgctcatttaaacgtcacaacaatcttgtgaagtaggtactgttactat

SEQ ID NO: 15578 - DNA, 201 bp, Homo sapiens
tattacacttggattttttttattattctcattgtggaaagttctattttgtaatagttcctatgtgttgagtgtgtgtgtgtgtgtgtgtgtgtgtgtgtttaccatagaatcttatattttgctccaattcttactccccagcttcatcctgttttcctccattgttaagcaatggacagctctggttaatcaaatata

SEQ ID NO: 15579 - DNA, 201 bp, Homo sapiens
agagatagagaatgctgataggttcttccagagatagagaacgctgataggtgtctttctgtgtagctggtgcttcaatgatggatgcacgtaaacttcarcaataacaaataacacacatcatggctatgtgcaggcacataactttttgtaatcttttcgtatgtgtttgctcatttaaacgtcacaacaatcttgtga

SEQ ID NO: 15580 - DNA, 201 bp, Homo sapiens
aggttcttccagagatagagaatgctgataggttcttccagagatagagaacgctgataggtgtctttctgtgtagctggtgcttcaatgatggatgcacrtaaacttcaacaataacaaataacacacatcatggctatgtgcaggcacataactttttgtaatcttttcgtatgtgtttgctcatttaaacgtcacaac

SEQ ID NO: 15581 - DNA, 201 bp, Homo sapiens
tacaaaaactagctgggtgtggtggcacattcctgtaatcccagctcctcgggaggctgaggcaggagaatcgcttgaactcgggaggcagaggttgcagygagccaagatcgcgccattgcactccagcctgggcaacaagagcgaaactccctctcaaaaaaaaaaaaaaaaaaaaaaaaaaaatgagagttgtaactt

SEQ ID NO: 15582 - DNA, 201 bp, Homo sapiens; identical to SEQ ID NO: 2528

SEQ ID NO: 15583 - DNA, 201 bp, Homo sapiens
ggtcttttttactatgtcatttttaagatatgaaataagaatctgaggacagccctgaagaacagtcctttcctgggaggggaagacttgtaattcaaggkcatacaatacaaaataaaacaaaaacaaaagcaccaagagcagaacaaaacaacgtagttgctttcctgaaatactttttggatttgattctatcttggg

SEQ ID NO: 15584 - DNA, 201 bp, Homo sapiens; identical to SEQ ID NO: 2534

SEQ ID NO: 15585 - DNA, 201 bp, Homo sapiens
ggctgctataataaaataccacagactgggtggcttaaacaacaaacgtgtatttctcacagtctagaagctgagaattctaagagtgaggcagaagtcastgtctgatgaggacgctcatcctggtttgcagatgctgtaccctcacatagaggagaaagggatctggtctcttcctcttctcatagggcactaaaccaa

SEQ ID NO: 15586 - DNA, 201 bp, Homo sapiens; identical to SEQ ID NO: 2535

SEQ ID NO: 15587 - DNA, 201 bp, Homo sapiens
aatcctgttccactgcctggtgaacgcccttgcatatatgcctatagtcttattcaactcttgttttacttatcttctgtatctatctgaaagctcctatagaagcatgactacatactctacttcatcttatttccccatagcatctgacttagtagcataaacatggtagatatgcaataaggatttgctagctgagta

SEQ ID NO: 15588 - DNA, 201 bp, Homo sapiens
gaatcctgttccactgcctggtgaacgcccttgcatatatgcctatagtcttattcaactcttgttttacttatcttctgtatctatctgaaagctcctatagaagcatgactacatactctacttcatcttatttccccatagcatctgacttagtagcataaacatggtagatatgcaataaggatttgctagctgagt

SEQ ID NO: 15589 - DNA, 201 bp, Homo sapiens
ggaggtggaggttgcagtgagcccagatcatgccattgtactccagcctgggtaacaaagtgactccatctcaaaaaaaaaaaaaaaaaaaaaaccccagrgtataactcattacaaaccatttactttgtattaggtactataatctagagaggatttaaaatatacagaaggatgtgcataggttatatgcaaaatacc

SEQ ID NO: 15590 - DNA, 201 bp, Homo sapiens
tactactgtaagaaatcccataccttggtcattgaatcaatttaagaccaaacaagagatggaaaccacacagtggattaaatggggaggaagtttaatakagagtattattaaactctgagaaattaaggaaattctatgcagtcccccagggccttgggagaatacccaaggaaagacaaagtgggaaggaggtccttt

SEQ ID NO: 15591 - DNA, 201 bp, Homo sapiens
gtttaagagaagggcaattatatgcagtatgaatatttttggaatggttgtgaactctataaaaccatgctttcaaaaacatttaataatgtatttgaatraaataaaattaaaataagaggcaaaaaagactaggcagtttttattatttgtatgatacgaagcttcagtcatgtcttatcctcagctaatctctgactg

SEQ ID NO: 15592 - DNA, 201 bp, Homo sapiens
agactagtgcctcgtctacctcagtgcacctggtcccaacacagtggaggagaaacactgacaggcttccctctttgtccccttctctgtcctccataccytgcccccccaccccgcaccctataccatgtctctgcaaatatctctatgctctgatgaggccattgcttcttccatgtttaatcacctcttgactagcat

SEQ ID NO: 15593 - DNA, 201 bp, Homo sapiens
atcttttataatgaagaggttctctaactgtaccccatcttcctcatgttactgtagacaaattgattctttgtttttgagcagggtttcgctgtgtcacscaggctggagtgcagtgcaaccttcctagggtcaagcagtccttccacctcagcctccaagtggctggggccacagaagcatgccaccatgcctggctca

SEQ ID NO: 15594 - DNA, 201 bp, Homo sapiens
cagactagtgcctcgtctacctcagtgcacctggtcccaacacagtggaggagaaacactgacaggcttccctctttgtccccttctctgtcctccatackatgcccccccaccccgcaccctataccatgtctctgcaaatatctctatgctctgatgaggccattgcttcttccatgtttaatcacctcttgactagca

SEQ ID NO: 15595 - DNA, 201 bp, Homo sapiens
cacgatctcgggtcactgcagcctctgcctcctgggttcaagcgattctcctgcctcagcctcccaagtagctgggattacaggtgtaggtcaccatgccyggctaatttttgtatttttcttttttttttttttttttagtagagacggggtttcaccatgatggccaggctggtctcaaactcctggactcaagtgatc

SEQ ID NO: 15596 - DNA, 201 bp, Homo sapiens
ccaggcgtgagccaccgcctggccctggcgtcttttttataagggccctaatcccattcatgagggctctaccctcaagacctattattacttcccaaagrccccacttcctaagaccctcacattaaggattaggatttcaacgtatgaattttgggggacaaacatgcagcccacaacaggtgtgtattgatgactgat

SEQ ID NO: 15597 - DNA, 201 bp, Homo sapiens
cctggttagctatattcctggttaattttttgtgtcaattgtgaatgggattgtgtttctgatttggctgttggcctgtttttggtatataggaatgctartcatttctgtacattgaatttgtatcctgagactttgctgaagttgtttattagctgaaggagcttttgggccgagactgtggggttttctagatatagg

SEQ ID NO: 15598 - DNA, 201 bp, Homo sapiens
atattacacttggattttttttattattctcattgtggaaagttctattttgtaatagttcctatgtgttgagtgtgtgtgtgtgtgtgtgtgtgtgtgtgtttaccatagaatcttatattttgctccaattcttactccccagcttcatcctgttttcctccattgttaagcaatggacagctctggttaatcaaatat

SEQ ID NO: 15599 - DNA, 201 bp, Homo sapiens
ctactatagctgtataagaagtctttagttgggtagactgaattttttttttttttttgagacagtcttgctccgtcacccaggctggagtgcagtggtaygatctcggctgactgcaacctctgcctcctgggttcaagcaattctcctgtctcagcctcctgagtagctgggattacaggcgtgcaccaccacacctgg

SEQ ID NO: 15600 - DNA, 201 bp, Homo sapiens
ttggagagatctttcacctccctggttagctatattcctggttaattttttgtgtcaattgtgaatgggattgtgtttctgatttggctgttggcctgttkttggtatataggaatgctaatcatttctgtacattgaatttgtatcctgagactttgctgaagttgtttattagctgaaggagcttttgggccgagactg

SEQ ID NO: 15601 - DNA, 201 bp, Homo sapiens
tctttaacacagtaaacccttaattacgattgttcagagaatatagtggttattgaatttcttggctaaatcgccagaaacccgtttcaatccttgctgtkgaagaagtgtgttcattttattctcatagtaaacataattgaatctgataattcaggatcttgcagtgcctcggagctatgtgaacatggattctcggcc

SEQ ID NO: 15602 - DNA, 201 bp, Homo sapiens
aatattacacttggattttttttattattctcattgtggaaagttctattttgtaatagttcctatgtgttgagtgtgtgtgtgtgtgtgtgtgtgtgtgkgtttaccatagaatcttatattttgctccaattcttactccccagcttcatcctgttttcctccattgttaagcaatggacagctctggttaatcaaata

SEQ ID NO: 15603 - DNA, 201 bp, Homo sapiens
tgactgcaacctctgcctcctgggttcaagcaattctcctgtctcagcctcctgagtagctgggattacaggcgtgcaccaccacacctggctcattttcrtatttttagtagagatggggtttcaccatgttggccaggctggtctcgaactcctgacctctggtgatctgcccaccttggcctcccaaagtgctgggat

SEQ ID NO: 15604 - DNA, 201 bp, Homo sapiens
ttctgtgaagaatgtcatttgtagtttgataggaatagcattgaatctataaattgctttgggcagtatggccattttaatgaaactgattctttctaatracaagcatggaatgttttcccatttgtttgtgtcatctctgatttctttgagcagtattttgtagttctccttggagagatctttcacctccctggttag

SEQ ID NO: 15605 - DNA, 201 bp, Homo sapiens
atattggctataataaatactaagttcatttgcttttggtttgtgatatgctattcagtgaaaaatgaaccttccagaaatttctaaattagaatatttarcattactttcaaaataatgaatgcccttgggaataaaataaacataattataattcaaaatataaagtcaaagaactgaactgtgcatgcaatttacctc

SEQ ID NO: 15606 - DNA, 201 bp, Homo sapiens
tgagaatgctttctgagtttaagagaagggcaattatatgcagtatgaatatttttggaatggttgtgaactctataaaaccatgctttcaaaaacatttaataatgtatttgaatgaaataaaattaaaataagaggcaaaaaagactaggcagtttttattatttgtatgatacgaagcttcagtcatgtcttatcctc

SEQ ID NO: 15607 - DNA, 201 bp, Homo sapiens
tccaacacctgttattctttgactttttaataatagccattctgactggtgttgaaacaggtcagggttactggtcttgttgtcttaaggtgttacccaarctcatcatctcacaaccaagagaattaaggagcatggacacaaaggatgaggttggagggaaagtttaataagcaaaagaagaaagctgtccacagcgga

SEQ ID NO: 15608 - DNA, 201 bp, Homo sapiens
gcttagcattccaagccccatccagcctcagtcttcctcagaaactttatcctcctttgcccttttgatcgactgtctaaccccaaatgcagagctgatayattggagccattctgcttgctacaataccggtctctgtcttctaatatccatataaaaatccttcaatgaaacttggaatcctgttccactgcctggtga

SEQ ID NO: 15609 - DNA, 201 bp, Homo sapiens
gttgagaatgctttctgagtttaagagaagggcaattatatgcagtatgaatatttttggaatggttgtgaactctataaaaccatgctttcaaaaacatttaataatgtatttgaatgaaataaaattaaaataagaggcaaaaaagactaggcagtttttattatttgtatgatacgaagcttcagtcatgtcttatcc

SEQ ID NO: 15610 - DNA, 201 bp, Homo sapiens
ggcagaaggctcacagcttttgtgtagcatagatctactgcggcactaccggctgtggcgggggacagacattgtacaggggtgagggaatggcctgagcyggaaaggccccggtttagaatggggcctgggacgggccctcatggtgtttcccaaaatcaggttcccatctttatcaaacttagagtgacactgattagc

SEQ ID NO: 15611 - DNA, 201 bp, Homo sapiens
tgttgagaatgctttctgagtttaagagaagggcaattatatgcagtatgaatatttttggaatggttgtgaactctataaaaccatgctttcaaaaacatttaataatgtatttgaatgaaataaaattaaaataagaggcaaaaaagactaggcagtttttattatttgtatgatacgaagcttcagtcatgtcttatc

SEQ ID NO: 15612 - DNA, 201 bp, Homo sapiens
ttgatctgaagtataggacatctggaaaactttactttttgagccagaataagaagctttaccattgctagacctatctgtaacattttcagcaccttcarttggtttaaatttagttattttagggagaatctaattagttaatttcaaaaactgaaacagttttaagaaaatgattatcaagaatacttacaaagtcag

SEQ ID NO: 15613 - DNA, 201 bp, Homo sapiens
acatggagaaaccccgtctctactaaaaatacaaaaactagctgggtgtggtggcacattcctgtaatcccagctcctcgggaggctgaggcaggagaatygcttgaactcgggaggcagaggttgcagcgagccaagatcgcgccattgcactccagcctgggcaacaagagcgaaactccctctcaaaaaaaaaaaaaa

SEQ ID NO: 15614 - DNA, 201 bp, Homo sapiens
gaaggagtgatgggggaaggagagaggagagggtgggaggaaggaaagggagggagctggcccttccagagcagtcatttccggattctgtggcctttcartgaacacagaggtctttcgaggcctctcagagctctggctgccttctccagtctttggctgtgggaggcagcatgggaggagcctgaactggcctgacag

SEQ ID NO: 15615 - DNA, 201 bp, Homo sapiens
aattataaaccattgctgagataagttagttcttaactgagagtagagataaatcatgtccatgggtgagaggattcattagtgttgagatgtcagttctycccaaattgatctacagatttaaggcaatctcagtcaaaaccccaacagggaaatttacaagctgattctaaaattcctttttttttttttttttttgag

SEQ ID NO: 15616 - DNA, 201 bp, Homo sapiens
aaggtccaataagtctacaattccttattcaaagtgtcttaactattcttgaatatttgtatttgactagaattgcattaaatttataggttaatttggcsagagaagagatctcgatgatgatttgttcagggcacacaaaaatggacactgtaacttcctgaagggcagggacaggttgtaggaacagatgggtaacag

SEQ ID NO: 15617 - DNA, 201 bp, Homo sapiens
tatgttggaatcctaagccccagtattatactattgggagaggggcctttcggaggtgattatgtcctgagggtggagcactcatgaatgggattagtgcycttataaaagacacaagagagctctctttctctgcactccatcatgggaggacacattgagaagttagccatctgcaaaccaggaagctggctctcacca

SEQ ID NO: 15618 - DNA, 201 bp, Homo sapiens
taacttctttcactacacaatatacatttaagattcatccgtggtttttttgtgacttgatagctccattctttttatggctgaataagatgccattgtayaaatgtaccacagtttatccacttggctcttgaaggacatcttggttgcttcagtttttgatgattatgagaaagcctggtataaacacgtgtgggtgga

SEQ ID NO: 15619 - DNA, 201 bp, Homo sapiens
cttttgtgtacagaagttttaaattttaattgaagccaaatttattaatgacatctttggcttgtgctttttaaaaaaaggcttgtttaagaaatctttcrtgactgtaaggtcttaaatacagtcttccttgtatttggctttgaaagctttcactttcactttttacacctaggtattcaaaccctcttgaatttgtct

SEQ ID NO: 15620 - DNA, 201 bp, Homo sapiens
ttccacttgtctcctccctgtggaatggacagcattctcttagcagtgatgtgtgacaatatgcaggaagtattggcaatctgagaagctaacctgagccygggagtccagagtttttactggggcttaatcacatagacatagttgactacccatgtggctgaccttgtctccagctgataccacatgactcaaagcgtc

SEQ ID NO: 15621 - DNA, 201 bp, Homo sapiens
ggctacctctgcataatagctctgcggcctccctgtctgtattaggaagctgatgatcatttattattccagcaagcagtgacaaatcagctctgtgtgtyggtgaggataggcgaggctatgttacactcaggagtgacccaaactttcagtggcttaaaccgagcaagtcatattctcactcgtgctgtgtagcttata

SEQ ID NO: 15622 - DNA, 201 bp, Homo sapiens
accttctgtcatctactttgggtctacggcttcatcctatatgggccactggccaatagggaaaggacttgtgtgcccccattttgattcatattcatttycccccccaaatccatagctgacctgactgattcatattcagtctgcggactcttgtcatgtaaatcttcctgactgctgggaaacacagcagtataattg

SEQ ID NO: 15623 - DNA, 201 bp, Homo sapiens
cccttagtcacacccaacttcagaggggcagcaaagcccagccctaccctgtcgctggaaggaggccaccagaatattcgtgcctggtctttgatgctccmgtgaccaaggatgggtttgcgataaatggagtggggccccactgttctcagggcttctaaaaaggaatgccccttgccacatctccaccctcagttccga

SEQ ID NO: 15624 - DNA, 201 bp, Homo sapiens
ctttataacaaccagcgcctcatgagaaccaactcagtctctagagaacagtgttaatgcacgcatgagggtgtgcccccatgacctaatcacctctgaargttcccattacctctcactcagtactgttgccctggggaccaaattcaccctgagtttcggaggggtcaaaccacatccaaaccatagcagggaggatgt

SEQ ID NO: 15625 - DNA, 201 bp, Homo sapiens
tcccatccactttgaaggatataattccactgttggtctgaagagcaaatgccctgcgtaatttagagctgggcctcagaggggagtgtgttaccggacartcccctcagcaaactcagttattccactgggcttttgctgagccctgctgtgtgtttggactttatgtgaccttcaatactgactgatccataggcttgt

SEQ ID NO: 15626 - DNA, 201 bp, Homo sapiens
cagcaggcttcccaatggaagccaagagcagggattccagaatcccaagaggaaccaatttccaacctcaaggcctgggaagttcaaggtcgaggggtcayatctggttggcttctggtgacagcgttcatcccgtgtaatagcatggcagaaaactggaagggcaggcaagcgcttgaaaaaagagatggggcaaagggg

SEQ ID NO: 15627 - DNA, 201 bp, Homo sapiens
tgttgtacagattattttgtcacccaggtattaagatgagcacccattagttactttttcctgatcctctccctcctcccaccctctacccttaaggcccyagtgtgtgttgttctcctctgtgtgtccatgtgttctcatcttttagcttctacttttgggaatgtgtggtatttggttttctgttcctgcattagtttg

SEQ ID NO: 15628 - DNA, 201 bp, Homo sapiens
aatgtgtgtccatctgctgctgctggtactggctagagcaggtggggcgctgagggtggaatatgaaagtcatgagccccaagacggactagtgcagggckcagagctcagagtagagggtggccactgtgataccacgcccctgtgacagagccatgtggtagaaactccagggggagagaaaggaccttgtgttttcat

SEQ ID NO: 15629 - DNA, 201 bp, Homo sapiens
cccaaagctgagctcatcagtactgattcaactgcctgcctgtttgccctcatccaggagttttcagtgtgatttttaaatgcctagctggttctttgggygaggacattttgccatttggaacaatttgcaggtgttatcctcaccttttccaagaggcacacaccacctgcccattttcctcactcatctaaactttgg

SEQ ID NO: 15630 - DNA, 201 bp, Homo sapiens
ctgcctcagcctcccaagtagctgggactacaggcgcatgccagcacacccagctaatttttgtatttttagtagagacggtgtttcacaatgttggccaygacggtcttgatttcttgagctcgtgatccactctcctcggcctcttaaagtgctgggattactgcggtgagccaccacacccagcgtattttgcattct

SEQ ID NO: 15631 - DNA, 201 bp, Homo sapiens
acagaagtcattttaacaacagcagccacaaacccttacccataacagatccataagcctcctttcagataatgaaaaataggatcagttctggtgcgccmtgccagcaaatgaacctctcgaaagataaaaacaacccctgccccccaaaaagaagggggaaattaaatgtgtcagtggtgagtgatggtgggcgagagg

SEQ ID NO: 15632 - DNA, 201 bp, Homo sapiens
tgtacagtggctatgtctttacactggtctgtaccacctgtgtgatctgactcccccaccctacccacacggttacctctctgatcccctacttctttgcycttcactctctctgctcccgacattggcctccttggtcctcacatgttttctcctctgggctctgcagcttactgttccctctgtctggaacgttcttct

SEQ ID NO: 15633 - DNA, 201 bp, Homo sapiens
aggttaaatttttcactatacactcttagaagcaggatgaccatgagatggtgatgataacaataataataatagtgatcagaagaaattagatggcagtrtaggaaaagccacgtgggccttgcttttgggtgccttctttctcttgataattaataattgttatttttataagagacacgatagaggaggcacaagctt

SEQ ID NO: 15634 - DNA, 201 bp, Homo sapiens
gatctgactcccccaccctacccacacggttacctctctgatcccctacttctttgcccttcactctctctgctcccgacattggcctccttggtcctcayatgttttctcctctgggctctgcagcttactgttccctctgtctggaacgttcttctacatggttccctccctcaccttcaggaccttatcatacgtcag

SEQ ID NO: 15635 - DNA, 201 bp, Homo sapiens
tttgcacatctaaaagctaggagtgcaaagattctgtcaattttgtttcctgctctattcccagcatctggaacaatgcctggcatatagcagacattcartaagtatctgtggagtgattgtatccaccagatgttttttactgactgtgtgcaaagaacagttctcgaaattgggagagacacaagtacatcagatgtg

SEQ ID NO: 15636 - DNA, 201 bp, Homo sapiens
acacagcagtataattgtgagcacctcactaatgtatgagtgagtgattagtaagaatggtgatttcatttttttccttaagtaaatgccatttctaatgyagtgaatattaaaatagatctgacttacaggtagcaaaaggatgtttccatataatgcaagaggcaaaagtaattttattttggatattacttgtatttg

SEQ ID NO: 15637 - DNA, 201 bp, Homo sapiens
caccttctgtcatctactttgggtctacggcttcatcctatatgggccactggccaatagggaaaggacttgtgtgcccccattttgattcatattcattyccccccccaaatccatagctgacctgactgattcatattcagtctgcggactcttgtcatgtaaatcttcctgactgctgggaaacacagcagtataatt

SEQ ID NO: 15638 - DNA, 201 bp, Homo sapiens; identical to SEQ ID NO: 2539

SEQ ID NO: 15639 - DNA, 201 bp, Homo sapiens
caaaagaaatggaagcatattccatacaaagatttgtacatgaatgttttaaacaactttatttataatagccccaaactggaaacaacccacatttctaycaacaggtggatggataaattgtggtacatctttatgatggatgctactcagcaacagaaaaggaatgaactattaatccatgcagcagtgtagctgaat

SEQ ID NO: 15640 - DNA, 201 bp, Homo sapiens
agatcatgcagatagtatgcttgtggttgttgtctgccttaaatacgttcagcttatggcatttcaattatgccttaataaagctgctaaaaaaaaaaaaactcactgggaaccttgtagcctctttcccaaccattctactcaaacttctctcatctaagacacactggccctttcttgcccgatccattatatttgtct

SEQ ID NO: 15641 - DNA, 201 bp, Homo sapiens
tccaacagagacaaacctgtggttcccaccatccgtatccattcccttaattgttcagttgtagtatatatgtacagcaatatcagaattgttaactcaayccctatgggaaacaactttatcaactagaagatggcgcttatatgcactccttttacatttgattttaacagactctacttatttctagttacttaggtc

SEQ ID NO: 15642 - DNA, 201 bp, Homo sapiens
ttgaatgaatgaaaaaggatcaatgttcagcaaatgtttaaaagtcattgatgtttctgtatctgaactaattggtgatattcctttatcatagacatggygagggcaaaagtcaatctgtgtttttgttactgtagtcatatcacattcttgcatccttacagctttatgtcagtgctgttggaaaatacacctttcttc

SEQ ID NO: 15643 - DNA, 201 bp, Homo sapiens
cccccactaccacacaaataccttcccctcctccgccctgtattcccccaccgcacatgccgctccgtctttctccttccctttctgggtttttcctcttytgcctgctcttcagtgatgacatttctctgtcttcgggccctggctctctgttttttttgttgtttgttttgttttgtttttttttccttcactcctgcg

SEQ ID NO: 15644 - DNA, 201 bp, Homo sapiens
tagtggctgtagccactggctacaaaagccttataatgttttagtgtcattgggcaggcaagtattaaaggattggggtttattagccagaaacatgtgtrgctttacttaatagcccaaaggattttggtcccattattacaattgctcacatactttcattaggattctatgcaccagacctcatctgccccaggtaaa

SEQ ID NO: 15645 - DNA, 201 bp, Homo sapiens
ataatgatattcttggattattacatttaaagagttgactttaaagaatcttctaatttcccagaagtgatattgtttttggtgtgtcaccttctgtcatmtactttgggtctacggcttcatcctatatgggccactggccaatagggaaaggacttgtgtgcccccattttgattcatattcatttccccccccaaatc

SEQ ID NO: 15646 - DNA, 201 bp, Homo sapiens
ccaaaatggcttttaaaaaatgtgatgtcaacatttagcagctacagactggcttcttttccttagtaatatgcacttaagtttgctccaggtcttttcaytgcttgatagctcatttcttttcagtgctgaataatattctattatctggatgtaccagagtttatccattcattcacctactgaaatactcttggttgc

SEQ ID NO: 15647 - DNA, 201 bp, Homo sapiens
acaggcattagccaccatgcccagcccaaaatggcttttaaaaaatgtgatgtcaacatttagcagctacagactggcttcttttccttagtaatatgcayttaagtttgctccaggtcttttcactgcttgatagctcatttcttttcagtgctgaataatattctattatctggatgtaccagagtttatccattcatt

SEQ ID NO: 15648 - DNA, 201 bp, Homo sapiens
aattgtcaccatctcctcacagagaggtacatttgttagaactggtgaacctacattaacacatcattatcgcccgaagtccacggttaacattaggattyactcttggtactgtacattatggatttgactgatttcataatgacatgtatccaccactacagcatcatacagagtagtgtcactgccctaacaatcctc

SEQ ID NO: 15649 - DNA, 201 bp, Homo sapiens
cttcttatccattgcctgtagcccaggaccagtgccaagcctgtagcttccgcatggtgttcctctcccttccggggatcttcatgtaggtgctgcacggrgaaagaagggccctgagaagagaggctgctgtcggcacaggagccgtgagggtggcggccgcctggccactgtgtccagtgctttcaaggtgttctcagt

SEQ ID NO: 15650 - DNA, 201 bp, Homo sapiens
ttagagcagttttaggttcacagtgaaattgactagaaggtacagatttccaatatgctcactcccatccacctcacacatgtacacagcctccccaattrtcaccatctcctcacagagaggtacatttgttagaactggtgaacctacattaacacatcattatcgcccgaagtccacggttaacattaggatttactc

SEQ ID NO: 15651 - DNA, 201 bp, Homo sapiens
atttttaagtgtacaggtcagctacattaagtacatttactatttttttttgcaaccatccccaccattcatctcccgaactttctcatcttcccaaactragacactgtgcccattcttgatgggttttaatatgcctaggaccacagagctatgggaggccagaggacaggaaactcccagttctaaggcagtgtcagg

SEQ ID NO: 15652 - DNA, 201 bp, Homo sapiens
tttataggtagttggggaattaatataggaaagcgattttaaattgtgtgatgggttagacaagaaaaatagaattgtagtcaagaaaaatgatgaatgaygtagatgaatgaacatgtaatatgggagtggaaggggttgctgcagagaggaggccccattggtcgctgcagacacgcattcactaatttcatcaatccc

SEQ ID NO: 15653 - DNA, 201 bp, Homo sapiens
ggccagtcttcttcagcaggccctgaatatcttgtacttctctccctggtaacaggatctctaaaccggccacacctgtcataagtgactctactaaaggrgaattcagaattccactggggatacttagaacagtgagctgatgtgatcttgtgttattttccctttcttgggggttatcccttgattaattacctgtct

SEQ ID NO: 15654 - DNA, 201 bp, Homo sapiens
ttgtttttgaacagagtcttgctctgtcaccccaggctggggtgcagtggcgccatgtaggctcgctgaaaaacctgccttccgggttcaagcgatgctcrtgcctcagcctcctgagtagttgggattataggcatggggcaccatgcctggctaatttttgtatttttagtagaggcggattttgccatgttggccagg

SEQ ID NO: 15655 - DNA, 201 bp, Homo sapiens
gccttcttctgcagacaggtgggtctcttggcagacagatgagtctctttaactctgtttaatacctgaggatgcctggttctcactgtgttttccttacrtgctttatcttgttcagtcttcagaataatgccgatgccagccagcgctaggaatggaggcccgcagaggcttatggaactggcccatggtcactcagcc

SEQ ID NO: 15656 - DNA, 201 bp, Homo sapiens
gtcgtgcattaccacacccagctaaattatttttatttttttatagagactgggtctcactatgttgcccagacttgtcttgaactcctggcctcaagctrtcctcctgcttcagcctctcaaagtgctggaattacaggcatgagccactatgcctggcctacttattcttttattcttaaatatgcatttactgttttt

SEQ ID NO: 15657 - DNA, 201 bp, Homo sapiens
ttgtgatttttgacctttgctttaaaaaaaaaacaagcttacattcaaatactgaaactttttgtagtagtcatatgcataacagattccaaaaacaacaraattgaaactgtatgtgcagaatactatgtattggttaaaccacataacacaggaggcaataggaaatgcatttacatttgcaaaatgaaaattgaatat

SEQ ID NO: 15658 - DNA, 201 bp, Homo sapiens
tcagccttcttctgcagacaggtgggtctcttggcagacagatgagtctctttaactctgtttaatacctgaggatgcctggttctcactgtgttttcctwacgtgctttatcttgttcagtcttcagaataatgccgatgccagccagcgctaggaatggaggcccgcagaggcttatggaactggcccatggtcactca

SEQ ID NO: 15659 - DNA, 201 bp, Homo sapiens; identical to SEQ ID NO: 2540

SEQ ID NO: 15660 - DNA, 201 bp, Homo sapiens
ccaatttcagccttcttctgcagacaggtgggtctcttggcagacagatgagtctctttaactctgtttaatacctgaggatgcctggttctcactgtgtkttccttacgtgctttatcttgttcagtcttcagaataatgccgatgccagccagcgctaggaatggaggcccgcagaggcttatggaactggcccatggt

SEQ ID NO: 15661 - DNA, 201 bp, Homo sapiens
agcgcacacattggtaaagccatttcattcatttctgctaatgttaatggaattaaatctgtttcaagccaggtaggtgaggtgttgagttttcagattgkcagagatagcttttctgtttggttcttatgagctaatactctacataacaattcaaattagtcaactggtttttctcatgtttgtgttggggtgtggcag

SEQ ID NO: 15662 - DNA, 201 bp, Homo sapiens
taagtttggaatctgacagcacagacacttacagccaccatagctgctttttctttgcatttaattgggttaacttttaagaaatggcatgtttgacttamgatttttaggcatataacctataatattggctttggggggtgcttttctgttcttattatttgtcctttatcttggcacctcataattaactaatggtgg

SEQ ID NO: 15663 - DNA, 201 bp, Homo sapiens
gaaccttgctggcacctatgagattaattcctgtcggctgttcccagtgtgaggtagtgggaatggcccttgcctgtgagctccgtcctagtcgggccacygctgaccagctagatgagcttggcaagtcattttcaccaacagagtttgttttcaggttttctttcttgatttgaaaaaaaatgagggagatctgggact

SEQ ID NO: 15664 - DNA, 201 bp, Homo sapiens
gggattacaaaatagaacctccattgtactgggaggatgaacagaaaatgcatttaatgtgggcttgagggcatctgccttaccgtctgttaggggagttgtctagtcaatgagcttttttaaaaaaatctctttttatagctgaagatacctatgccattgctctttgataaacatcaggtttttctttccatgcattta

SEQ ID NO: 15665 - DNA, 201 bp, Homo sapiens
tattacttgtatttgcatgatcagtagtgttagcctagtggacatggtaaaaatcagagatgggggtctggaagcctgctagccagacttaggaggagctkcttctcctttttctcactatctttgcacagtttccaattttgggattacaaaatagaacctccattgtactgggaggatgaacagaaaatgcatttaatg

SEQ ID NO: 15666 - DNA, 201 bp, Homo sapiens
attgatttctagacctatagacctatgtgaagtatctcaaccaaagagatgtttatctccaacctaagcatagctctattttatttctccttttgtttttkggaatcattaaagataaaactactcccagccattacaactgtcatgatgacataaaatactgcatcagaaatagtaaccagggtctttatactgttgttt

SEQ ID NO: 15667 - DNA, 201 bp, Homo sapiens
gtcatctactttgggtctacggcttcatcctatatgggccactggccaatagggaaaggacttgtgtgcccccattttgattcatattcatttccccccccaaatccatagctgacctgactgattcatattcagtctgcggactcttgtcatgtaaatcttcctgactgctgggaaacacagcagtataattgtgagcac

SEQ ID NO: 15668 - DNA, 201 bp, Homo sapiens
atgctagttgaatcttattctgtataaagtaatgcttgcctatcacatgttaaatatgcaagaagtccaagtttgccaataatgatattcttggattattrcatttaaagagttgactttaaagaatcttctaatttcccagaagtgatattgtttttggtgtgtcaccttctgtcatctactttgggtctacggcttcat

SEQ ID NO: 15669 - DNA, 201 bp, Homo sapiens
ctgttattggatttgagcgagagtctagcctcttgattggataaggaagacacctggctatccttgattgcatttggaaaacattctgcttttttttttttgtggaagattgagaaatactctagtctcatcttcaatatagtatcaagtcatcttttatgttggaggctttctgttgatggctaaactcgtcattttgat

SEQ ID NO: 15670 - DNA, 201 bp, Homo sapiens
aatttttgtatttttttagtagagacagggtttcaccatgttgtccaggcgggtcttgaactcctgacctcaggcgattgaaccacctcggcctcccaaartgttgggattacaggcatgagccacggcacccagccctaaagctcttaaggaaatttaaaggacctagaatagccaaaacaattttgagaaagatcaaca

SEQ ID NO: 15671 - DNA, 201 bp, Homo sapiens
catgcctggctaatttttgtatttttttagtagagacagggtttcaccatgttgtccaggcgggtcttgaactcctgacctcaggcgattgaaccacctcrgcctcccaaagtgttgggattacaggcatgagccacggcacccagccctaaagctcttaaggaaatttaaaggacctagaatagccaaaacaattttgag

SEQ ID NO: 15672 - DNA, 201 bp, Homo sapiens
atgtatccaccactacagcatcatacagagtagtgtcactgccctaacaatcctccgtgctctgcctgttcatctctccttccccactcacccctggcaaycactgatctctttattgtctccatagttttacctttctcagaatgtcatatctttggaattaaccgtatatagcctttctattttcagaatagccatagc

SEQ ID NO: 15673 - DNA, 201 bp, Homo sapiens
cctgagaagctgggattacaggcacctgccaccatgcctggctaatttttgtatttttttagtagagacagggtttcaccatgttgtccaggcgggtcttraactcctgacctcaggcgattgaaccacctcggcctcccaaagtgttgggattacaggcatgagccacggcacccagccctaaagctcttaaggaaattt

SEQ ID NO: 15674 - DNA, 201 bp, Homo sapiens
aattagctgggcatggtggcacatgcttgtaatcccagctacttaggaagctgaggcacaagaatcgcttgaacccgggaggcggaggttgcaatgagccragatcatgccattgcactccagcctgggtgacagagtgagactcttgtctcaaaagaaaaaaaaagtgtcagaattgaattgaatcgtaggacactctgt

SEQ ID NO: 15675 - DNA, 201 bp, Homo sapiens
aacccgtagcatctaactctaacgccagctccaggtaaatagtgtcagaatcagccaggcacagtggctcacgcttgtaatctcagcattttgggaggccraggtgggcggatcacttgaggccaggagttcgagaccagcctagccaacatggcgaaaccccatctctactaaaaatacaaaaattagctgggcatggtg

SEQ ID NO: 15676 - DNA, 201 bp, Homo sapiens
caggtattcacccgcctcggcctcccaaagtgctgggattacaggtgtgagccaccgcacccggcctatcggtatgtattttttaaaagcgtaaaggcagktctgtctttccaaagagttacctttattgggaaaaaatgttatgctttgtttagatatttatcaagtgtaatgtataaacattatcataaaaatgagcat

SEQ ID NO: 15677 - DNA, 201 bp, Homo sapiens
aaaggacactgtgtccactcgcacgcccagtcttggtatgcacctgccactccttgaccatgatgcctctgcacacaccagtggtgatgtccccctaggcmagaacagatctgggaggagcttgttcatgccctagaagctacttgggatttgagaagggaattctggggacccggatcacagactaaaaccaagtggagg

SEQ ID NO: 15678 - DNA, 201 bp, Homo sapiens
ggttgttggcaatttgtaatcactatgctggtggtgtacctccatttaataataaagaaacatgggcaaataagtagccaaataaaggcttgtctctttgyatctatttctctgctgatagtgctctatttttagcattgggttctcttgttgagtaacctttctttgttgatagcttcaagtatttcagcctctggtttg

SEQ ID NO: 15679 - DNA, 201 bp, Homo sapiens
tgctgcctgcatgtcattaacgtggcaagtatttttcttcaagttgtttgttcagtcattgtaggctgaaggaagagaaataattaggttgttggcaattwgtaatcactatgctggtggtgtacctccatttaataataaagaaacatgggcaaataagtagccaaataaaggcttgtctctttgcatctatttctctgc

SEQ ID NO: 15680 - DNA, 201 bp, Homo sapiens
tgaagtctgcaacctaatggatgcttgagcatccctgtccttttttaaaagaagcttttttcctcagcaagacattcaaaacctggtcaaggggctgggcrtggtagctcacgcctgtaatcccagtgctttgggaggccaaggcgggtggatcacctgaggtcgggagttcgagaccagcctggctaacagggcaaaaac

SEQ ID NO: 15681 - DNA, 201 bp, Homo sapiens
gtgctcttcaacagagatgacaaccagatgaactcacaggctttaccactaatgtcgggtgttctgtatttgacacatttcatggcctgttgtgaagacaygttttcttaaacaccctcattgcacaagaaaacagcatactcgttactgactactgataaatgattataatataatgaagcttgactgtatgactaatgg

SEQ ID NO: 15682 - DNA, 201 bp, Homo sapiens
aggaggtaaaaagtcattgaccagaggagtgggtttgaaaccatttggatcctgccgggttatatccagttaattgaaggaaaaccggaaagggggatttrgttcctgtggaaggccatcctggatttgagctactaaattagtccacatctctctgaagtctgcaacctaatggatgcttgagcatccctgtcctttttt

SEQ ID NO: 15683 - DNA, 201 bp, Homo sapiens
tgccattgttcttaatgtccactgataattactgttaatgactgttggtgaccacaaatggcaaatggccactacggcaatcaaagggcacatttgaatgwattaatgtgtttaatgcattagttattactagcatcccttgagtggtgaacagtctcaattatgacaattatttcttcttgctagatttagctgggagac

SEQ ID NO: 15684 - DNA, 201 bp, Homo sapiens
tttttcctctctaagctcagttactcccattgatgggcgcagaatgagcatctggggcaacctcgacgggtgcctcggtggaagggcgggagccctgcggrgggcctgcgggatcccgggatctgtcagcttcaggctcccagctcccctctcctccacgacatcgtgacttcccaaggtccagggactaaggtcatacac

SEQ ID NO: 15685 - DNA, 201 bp, Homo sapiens
gagcaaagtgtgattgtctccaggaagctctgcatctgggtttttttgctgacattttcttttctttttttctctttgaacgctgtggttttgaacaaatyggtaatgtgataagtcttcacttaacgattttcaggcatcaggagtacacgattccctggaagagacatttacatggaatatttatttatttgaagagga

SEQ ID NO: 15686 - DNA, 201 bp, Homo sapiens
gtgtttagtgttcataagcagagcaaagtgtgattgtctccaggaagctctgcatctgggtttttttgctgacattttcttttctttttttctctttgaaygctgtggttttgaacaaatcggtaatgtgataagtcttcacttaacgattttcaggcatcaggagtacacgattccctggaagagacatttacatggaat

SEQ ID NO: 15687 - DNA, 201 bp, Homo sapiens
ttggtggcccacacctgtaatcccaggccaatcacttgagtgcagcagttcaagaccaacctggtcaacatggcgagatctcgtcttttaagaaaaaaaaattggcctgtcgcggtggctcatgcctgtgatcacagcactttggggggccgagacgggtggatcacgaggtcaggagatcgaggccatcctggctaacac

SEQ ID NO: 15688 - DNA, 201 bp, Homo sapiens
tttgagacggagtttcactcttgtcgcccaggctggagtgcaatggtgcaatcttggctcactgcaaccttcgcctcctgggttcaagagattctcctgcstcagcctcctgggtagctgggattataggcacctgccaccatgcccagcaaatttttgtatttttagtagagacaagatttcattcaccatgttggccag

SEQ ID NO: 15689 - DNA, 201 bp, Homo sapiens
cacggcttagaagattgtccttgccatctttagcaactgtctcagccgtcacttattttcactcgtcttacgaggaccaacctgccgactttctcgtcackggggcattgttaacaaccagctgtgcgtgtttagtgttcataagcagagcaaagtgtgattgtctccaggaagctctgcatctgggtttttttgctgaca

SEQ ID NO: 15690 - DNA, 201 bp, Homo sapiens
gtttttcaggaagctggtggacagtggtgggcatttctgctctgggattcaggttgtccttagaggagaaattctaatgatctggtagaacattaaaaaawgttctcgaatatttaattattagctatcaatgttcttttctgctgccctgtctcttcgcttactttatttcttgttccccaagtaatccacttctcaaat

SEQ ID NO: 15691 - DNA, 201 bp, Homo sapiens; identical to SEQ ID NO: 2537

SEQ ID NO: 15692 - DNA, 201 bp, Homo sapiens
ttttgtgtttttagtagagacagggtttcaccatattggtcacgatggtctcgaactcccaacctcaggtgatctgcttgcctcggcctcccacagtgctrggattacaggcgtgagccaccatgcctggcccagagtagcatattcttgatttgaatttgtagactggaaagttcagtgtagtctgatgatgatgatgat

SEQ ID NO: 15693 - DNA, 201 bp, Homo sapiens; identical to SEQ ID NO: 2538

SEQ ID NO: 15694 - DNA, 201 bp, Homo sapiens
ggtttgacttttcttttaagttatgcttgacttagtcttttttttttttgagacggagtttcactcttgtcgcccaggctggagtgcaatggtgcaatctyggctcactgcaaccttcgcctcctgggttcaagagattctcctgcctcagcctcctgggtagctgggattataggcacctgccaccatgcccagcaaatt

SEQ ID NO: 15695 - DNA, 201 bp, Homo sapiens
agatggggttttgccatgttggccaggctggtctcaaactcctggccccaagtgatccacctgccttggcctcccaaagtgctgggattacaggcgtgagycactgtgcccggccataacgcttgtctttggttttgtctaataccaattggtattttttgttgaactctccagtgtgtttgtcaaacatgtaacatattt

SEQ ID NO: 15696 - DNA, 201 bp, Homo sapiens
attagccgggagtggtggcatgtgcctgtaatcccagctactcaggaagctgaggcgtgagaatcacttgaacctgggatctgaaggttgcagtgagccgrgattgtgccactgcaccccagcctgggtgacagagtgagactccatttcaaaaaacaaacaaacaagaaagaattaactgagatgattcatgcagtcaag

SEQ ID NO: 15697 - DNA, 201 bp, Homo sapiens
tggtcaggtttgacttttcttttaagttatgcttgacttagtcttttttttttttgagacggagtttcactcttgtcgcccaggctggagtgcaatggtgyaatcttggctcactgcaaccttcgcctcctgggttcaagagattctcctgcctcagcctcctgggtagctgggattataggcacctgccaccatgcccag

SEQ ID NO: 15698 - DNA, 201 bp, Homo sapiens
taattacacgcctgtaatcccagcactttgggaggccaaggcgggtggatcacttggggtcaggagtttaagaccagcctggccaacatggtgaaaccccrtctctacaaaaaatataaaaaattagctgggcgtggtggtgcatgcctgtaatcccagctactcgggaggctgagggaggagaatcacttgaacctggga

SEQ ID NO: 15699 - DNA, 201 bp, Homo sapiens
gtgttttggggaaacagataacaaaagggatgttgtaagaattaactgagatgggccaggcacggtggctccggcctataattccagctgtttgggaggcygagggggatagatcacctgaggtcaggagtttgagaccagcctggccaacatgacaagaccctgtctctaccaaaaccacaaaaattagccgggagtggt

SEQ ID NO: 15700 - DNA, 201 bp, Homo sapiens
actggtggagaggcagtcagttaataaaaatttccccggaaggagtgatgggggaaggagagaggagagggtgggaggaaggaaagggagggagctggcccttccagagcagtcatttccggattctgtggcctttcagtgaacacagaggtctttcgaggcctctcagagctctggctgccttctccagtctttggctgt

SEQ ID NO: 15701 - DNA, 201 bp, Homo sapiens
tgttagagaagacttgacttgcctagttaattacatttcttctctaggcccaaatatgtttctggaccagttctgctggctaaagtccttggggaaggctkgttgacctcaggttgtccagttggcagtaatgaatctatttaaccatccagccagtcatgcaataaatatcttttatgggcctactatgtggcaggcata

SEQ ID NO: 15702 - DNA, 201 bp, Homo sapiens
aggtggttggtgccactgtgtgtgtgtgtgtgtgtgtgtgtgtgtgtgtgtgtgtgcgcgtgtgtgtgtttagccaggagggagctgttgggaaatgccasctaaggaatgttttcaagtgcaattctagcacttcatgatgtgaagaataaatacgatctcctttgtagtcccttgagacgggaggtcgcacagtctggg

SEQ ID NO: 15703 - DNA, 201 bp, Homo sapiens
tctactaaaaatacaaaaattagccagacgtggtggcatgctcctgtaatcccagctactcgggaggctgagacaggagaatcgcttgaacccaggaggcrgaggttgcagtgagccgagatcatgccattgcactccagcctgggtgacagagcaagactgtttaaaaaaaaaaagacgaagaaaaaagaaaagaaaaga

SEQ ID NO: 15704 - DNA, 201 bp, Homo sapiens
tcagaggagccagcatgaggaggaggagctgaaagcggagggaggtggttggtgccactgtgtgtgtgtgtgtgtgtgtgtgtgtgtgtgtgtgtgtgcgygtgtgtgtgtttagccaggagggagctgttgggaaatgccacctaaggaatgttttcaagtgcaattctagcacttcatgatgtgaagaataaatacgat

SEQ ID NO: 15705 - DNA, 201 bp, Homo sapiens
tgcgtcaccacgcccggctaatttttgtatttttagtagagacggggtttcaccatgttggccaggctggtctcaaactcctgacctcaggtattcacccrcctcggcctcccaaagtgctgggattacaggtgtgagccaccgcacccggcctatcggtatgtattttttaaaagcgtaaaggcaggtctgtctttccaa

SEQ ID NO: 15706 - DNA, 201 bp, Homo sapiens
gcagatcgcctgaggtcaggagttcgagatcagcctggccaacatggtgaaaccccatctctactaaaaatacaaaaattagccagacgtggtggcatgckcctgtaatcccagctactcgggaggctgagacaggagaatcgcttgaacccaggaggcagaggttgcagtgagccgagatcatgccattgcactccagcc

SEQ ID NO: 15707 - DNA, 201 bp, Homo sapiens; identical to SEQ ID NO: 2541

SEQ ID NO: 15708 - DNA, 201 bp, Homo sapiens
actcagaggagccagcatgaggaggaggagctgaaagcggagggaggtggttggtgccactgtgtgtgtgtgtgtgtgtgtgtgtgtgtgtgtgtgtgtgygcgtgtgtgtgtttagccaggagggagctgttgggaaatgccacctaaggaatgttttcaagtgcaattctagcacttcatgatgtgaagaataaatacg

SEQ ID NO: 15709 - DNA, 201 bp, Homo sapiens
attgtgaaagggtttggaatcattttagtaaaagttttaggtttataactggtttatatattctattggtttattggtatgtattttttttttttttttttgagacggagtctcgctctgttgcgcaggttggagtgcagtggtgtgatctcggctcactgcaacctccgcctcctgagttcaaccaattctcccgcctca

SEQ ID NO: 15710 - DNA, 201 bp, Homo sapiens
ttttttttttttttgagacggagtcttgctctgtcgcccaggctggagtgcagtggcgcgatctcggctcactgcaagctccacctcctgggttcacgccrttctcctgcttcagcctcccgagtagctgggactgcaggtgcccaccaccacacccagctaattttttttttttttgtatttttagtagagatggggttt

SEQ ID NO: 15711 - DNA, 201 bp, Homo sapiens
cggccacatccaaagactcagaggagccagcatgaggaggaggagctgaaagcggagggaggtggttggtgccactgtgtgtgtgtgtgtgtgtgtgtgtktgtgtgtgtgtgtgcgcgtgtgtgtgtttagccaggagggagctgttgggaaatgccacctaaggaatgttttcaagtgcaattctagcacttcatgatg

SEQ ID NO: 15712 - DNA, 201 bp, Homo sapiens
agcgctaggaatggaggcccgcagaggcttatggaactggcccatggtcactcagccaggacatgggagcccaagactgcagacctgaggctcctaagcaycccaatctctcatctcaacttcaggatagcctcgtgagttctgctcacgccattcccaggatcccccatcctcaaagcttcctctgtcttagtcctgccc

SEQ ID NO: 15713 - DNA, 201 bp, Homo sapiens
ttttccgtgagagggtaaaacttcacctgcagtgtgacagcggccacatccaaagactcagaggagccagcatgaggaggaggagctgaaagcggagggargtggttggtgccactgtgtgtgtgtgtgtgtgtgtgtgtgtgtgtgtgtgtgtgcgcgtgtgtgtgtttagccaggagggagctgttgggaaatgccacc

SEQ ID NO: 15714 - DNA, 201 bp, Homo sapiens
ggtgacagagcgagattctgtctcaaaacaaacaaacaaacaaacaaaactggtcaagggttatattttgttttcaatgctatggtagcaaaaaaaaaaaataaatattttcctgttcaaaaaacttctatgtagcacatgtgtatgcaggctgaagaatttatgaaggttaaacgttttctatcttcagactaccaactg

SEQ ID NO: 15715 - DNA, 201 bp, Homo sapiens
tccatgcggtgcattctcagatcccaaaatagtgcccaggactgagatgagaggtaggggcccaggagtttactgaagacaggaccttttcattgttttcygtgagagggtaaaacttcacctgcagtgtgacagcggccacatccaaagactcagaggagccagcatgaggaggaggagctgaaagcggagggaggtggt

SEQ ID NO: 15716 - DNA, 201 bp, Homo sapiens
ccggtggggctgggccctcgattcgcatcaggcaagctcatctccatgccttgcgtgctccccagcttgtcaagcctccatctgtttcgttcttcactccrgcatcccatgtaccttcctcaatctggatttggggacatgccctctggccttcatgagccacaactgtagaggatataagaaaatcaaagtttatttctc

SEQ ID NO: 15717 - DNA, 201 bp, Homo sapiens
ctctgtttaatacctgaggatgcctggttctcactgtgttttccttacgtgctttatcttgttcagtcttcagaataatgccgatgccagccagcgctagraatggaggcccgcagaggcttatggaactggcccatggtcactcagccaggacatgggagcccaagactgcagacctgaggctcctaagcaccccaatct

SEQ ID NO: 15718 - DNA, 201 bp, Homo sapiens
agaggcctcacatggctggatgtaggttacaaggtcgctctcacagtcaaggtgtgagcaaggccttggtcttcccatcagccatgctgccttataagccrctcagtcaactccccatccacctccaaactgctgcttgcctggcctccctcttcattgatgatgtgatgagccacccaaatagacctggagttttttttg

SEQ ID NO: 15719 - DNA, 201 bp, Homo sapiens
tgtaactgatgtggggagaccgactggggacaaagaatgaggatagtaacaggagatgactcctcctccccaggaggccagatgcatccagaggcctcacrtggctggatgtaggttacaaggtcgctctcacagtcaaggtgtgagcaaggccttggtcttcccatcagccatgctgccttataagccactcagtcaact

SEQ ID NO: 15720 - DNA, 201 bp, Homo sapiens
gtggacagcaataaagtacagtacttatttcccttcccacaggaggtcaaatctatcatttttaaatctgcttttgggagtttctaaaaccaattaacttktgacttgccattgttcttaatgtccactgataattactgttaatgactgttggtgaccacaaatggcaaatggccactacggcaatcaaagggcacattt

SEQ ID NO: 15721 - DNA, 201 bp, Homo sapiens
tccttttccttccttccttcatttcccttcttcatctgtccccatccctccttcccttttcctgtcttttcccttcttctcctctttaccccttcatcctktttccccttttctctctttccttccctcctctccccctagcctctccttccccctgcttatctgtcagcccttctcaattgatgatctagttgtttgttc

SEQ ID NO: 15722 - DNA, 201 bp, Homo sapiens
caggttttccatagacccagagctgtgaaggaagatgtggacccccaaataaagattggggtaatcacccagcaaagggtggctgtcagataggaaactgycatctcccggctctatcatctgccagtctccccttatatacttacagatgcagcttaatgctagaaagtagaaaattctcattttttgaaagattacttt

SEQ ID NO: 15723 - DNA, 201 bp, Homo sapiens
attccaaatcagtggggtctttcaccaaatccatctggcccttcttccctctttttgggctagaggtctttggtggcaggaatattaaactagacccacaytggctgcaacaatgaaagaggttgattcactcactgataggcaggcttcagaggtggtttgacacagggatgtggtgactttatctagaaccctgttttc

SEQ ID NO: 15724 - DNA, 201 bp, Homo sapiens
tttggcctaacttggctggcgtcaaaactatttgaattatatttgcagaaaaacccattgctgtgctgttctgcggagggcattagttactaattgttctytcatttcctttaaaaatagcagacaccaagctcccttagctgtgatttaaggagccacagtggtatagctggcgagtgcagtcacgaaccgcataacagc

SEQ ID NO: 15725 - DNA, 201 bp, Homo sapiens
tgcctcctgctaccattttgcctcttgggagtgctctcccttccctctaaacctgttcaaatcctgtcattccgcaaggtcagttcacctcctccctcctrtgtgcaacttccctgcctgcccctggcggagttttctctctccctgaatcactaaagcgcttcaggtttgtctgtggctttggggccattgcatgtcatt

SEQ ID NO: 15726 - DNA, 201 bp, Homo sapiens
gcccagagctgactggcttcctggccaaggacctttctacacccacatttagaattcatcttgtctctttgcctcctgctaccattttgcctcttgggagkgctctcccttccctctaaacctgttcaaatcctgtcattccgcaaggtcagttcacctcctccctcctgtgtgcaacttccctgcctgcccctggcggag

SEQ ID NO: 15727 - DNA, 201 bp, Homo sapiens
tctgagtccctgacagatactcagtacccgcgagagcacggtactgtgccaagcaaactagaaatgcacacacataggaaagaatagtctcgggtgagtgratgcattaaaaaggtccatgcggtgcattctcagatcccaaaatagtgcccaggactgagatgagaggtaggggcccaggagtttactgaagacaggacc

SEQ ID NO: 15728 - DNA, 201 bp, Homo sapiens
caacaaatgtttatcagcattcagaatttctccatttctttttttcttttttcttttttttgagacggagtcttgctctcacccaggctggagtgcagtggtgcggtcttggctcaccgcaacctctgcctcccgggttcaaatgattctcctgcctcagcctcctgagtagctgggattacaggttcccgccaccatgcc

SEQ ID NO: 15729 - DNA, 201 bp, Homo sapiens
ttgtaattagactataattacctaacccggttgcttaataataaagacttctcaccccaggcagcatggtgcaaagggaattgtgccctccaccccagggyggtgatcatcccaggtccctttggcctttatattaacctacggtttgaatcttggtctgaccattgagctgctgtgtgacctcagacaaaccgctaaacc

SEQ ID NO: 15730 - DNA, 201 bp, Homo sapiens
aacacatctttaatttcagaagaacttgacccaagcaggttaggaatcagatgacttgaccttttcagaatagaaaataatcttttggagcagtgtaaagygatgtatttagaaagaggaagaggaaagaagaaatacacagaaccactttctgtctgtgtttttttctggaagtgtgcagtgactaatcagttttgtatg

SEQ ID NO: 15731 - DNA, 201 bp, Homo sapiens
ccttgcttttgggtgccttctttctcttgataattaataattgttatttttataagagacacgatagaggaggcacaagctttaaagggcagtggacccgrttagcattttcaaatgattgactgtgattttatggccttttcttattcattaaactgagaatggccaaccctgtattagaaacagctctacactctcttc

SEQ ID NO: 15732 - DNA, 201 bp, Homo sapiens
gcaacctcttggaaggccacagtaaactatggtggaaatttaaatgttcaaagaacatttaggaatgaaaggacagaaatgtcaggctgtgagcttattcratggttctctaagttagaaaccaaattgcttgacagaatgtgctttttagggcatctgcacttgctagaggaagcagtcacattattcatttcaatgggt

SEQ ID NO: 15733 - DNA, 201 bp, Homo sapiens
gatataaatttgaaattagtgaggtcaaaatgccacatgcacttttaggtgctagggacacaggtgcttaggatacaacagcgaaagagtccctgtgctcytaaaaacaaatgcaaatgaataaatcagaatggcttcagctcacgagtagtgctaggaaaaaaataaagctaataggataatgagtgagagactgtggcc

SEQ ID NO: 15734 - DNA, 201 bp, Homo sapiens
cgggacacaattcttcaacatttaagcatttgcttgaatgaatgaaaaaggatcaatgttcagcaaatgtttaaaagtcattgatgtttctgtatctgaaytaattggtgatattcctttatcatagacatggcgagggcaaaagtcaatctgtgtttttgttactgtagtcatatcacattcttgcatccttacagcttt

SEQ ID NO: 15735 - DNA, 201 bp, Homo sapiens
tggaattaaccgtatatagcctttctattttcagaatagccatagcatgaacatttgaagccttttcaaactggctttttttttttttttttttttttttktggtggggtcttgctttgtctctcaggctggaatgcagtggcacgatctctgctcactgcaacctctgccttccaggttcaagtgattctcctacctcag

SEQ ID NO: 15736 - DNA, 201 bp, Homo sapiens
cagtatcatacagaacagttgcaccccctataaatatctcctgtgctttatccatttacccccctccgtttattttcttttcttttttcttttttttttttgagacggagtcttggtttgtcacccaggctgggtgcagtggtgtgatctgagctcactgcaacctctgcctcctgggttcaagtgattcttctgcctcag

SEQ ID NO: 15737 - DNA, 201 bp, Homo sapiens
tacctttctcagaatgtcatatctttggaattaaccgtatatagcctttctattttcagaatagccatagcatgaacatttgaagccttttcaaactggctttttttttttttttttttttttttgtggtggggtcttgctttgtctctcaggctggaatgcagtggcacgatctctgctcactgcaacctctgccttcca

SEQ ID NO: 15738 - DNA, 201 bp, Homo sapiens
aaaaagaaaagaaaagaaaccaagataagggatgccaagtgtacttgttgctactgaaatgtaattgtttctaagatctctcacatgacagcaagaaaatmtatgtgtgtattcttattggcgtatacatatctacaaatatttccatttgtaaccatcagcatctatatcaagctaaacatcagctcatttgatgtcttc

SEQ ID NO: 15739 - DNA, 201 bp, Homo sapiens
ttacctttctcagaatgtcatatctttggaattaaccgtatatagcctttctattttcagaatagccatagcatgaacatttgaagccttttcaaactggctttttttttttttttttttttttttgtggtggggtcttgctttgtctctcaggctggaatgcagtggcacgatctctgctcactgcaacctctgccttcc

SEQ ID NO: 15740 - DNA, 201 bp, Homo sapiens
ggtttattgtgggcctcagaatagaagcttcttggcctgaaaatgaagttctttggaagtgccatctgacacttctcctggtgggcagagttgctgaaacyggaagcagggggtttgaggggtgctgtaactgatgtggggagaccgactggggacaaagaatgaggatagtaacaggagatgactcctcctccccaggag

SEQ ID NO: 15741 - DNA, 201 bp, Homo sapiens
tccctgagtcccacccactgtcttttcctttgctcctaacgtgcccctgctacactagttctgcctgctgttctcatctctgtgggtacatgtttgctttkgctgtcttctgtttgtccttttcctctcagcctaaaacaacctggcagcccctggtctccctcgcctagcccacagctctctgtcaagaagtctctttct

SEQ ID NO: 15742 - DNA, 201 bp, Homo sapiens
gagcgagactccgtctcagaaaaaaaaagaaaaaagaaaacaatattatatgtatatatttaaattaatgtaatactaatacatctgaaccccccccccccaaaaaaaattctgaggcttattttaaaaaggtaacagtgactttctccacctttcaggcccttttcctattttatattatatttatgtattgtatttcta

SEQ ID NO: 15743 - DNA, 201 bp, Homo sapiens
agactctacttatttctagttacttaggtcagtacccttttcccctatccccttcagtgaggttgttgcatacatttgtaatatagatagattgttttgtyacattctgcattccatcctgggatcccccaatctcctaaatgactttttaaatttgcttacattgtacattaagattcattctttgtgtagtcagtccta

SEQ ID NO: 15744 - DNA, 201 bp, Homo sapiens
agagcgagactccgtctcagaaaaaaaaagaaaaaagaaaacaatattatatgtatatatttaaattaatgtaatactaatacatctgaaccccccccccccaaaaaaaattctgaggcttattttaaaaaggtaacagtgactttctccacctttcaggcccttttcctattttatattatatttatgtattgtatttct

SEQ ID NO: 15745 - DNA, 201 bp, Homo sapiens
cagaatggtgagaaatatatttctgttgtttaaaccaccagtctgtggtagtctgttaaagcagcccaaactgactaagacaggagaccttgtatgtttgkctctatatagattctagtgagtatgttctaatattaggtagagcctttctgtcttgctcactatactccatcttcatttcctggcagtggcccctgtgct

SEQ ID NO: 15746 - DNA, 201 bp, Homo sapiens
aagaccaacctggtcaacatggcgagatctcgtcttttaagaaaaaaaaattggcctgtcgcggtggctcatgcctgtgatcacagcactttggggggccragacgggtggatcacgaggtcaggagatcgaggccatcctggctaacacggtgaaaccccgtctctactaaaaatacaaaaaattagccgggtgtggtgg

SEQ ID NO: 15747 - DNA, 201 bp, Homo sapiens
atctatagcatggtaaaaggatctttcagggccactgctgctcagatttctcacgtctccacacagaatctgtgattgacgcacacatttgaaagttaagkgattttcttcaggctgcaaactgggactggaatttcgtctctttctcttgttcttctctaattttattctcatgcaaacagcctgatttctgatttcata

SEQ ID NO: 15748 - DNA, 201 bp, Homo sapiens
tagcttgcacctgttcttagcctggtacttggcagtgccttcccaggagcttctctgatccatctcctgctgtcaggctggctctgtggcctttccagggyccctctttctgtaatcctgtctcccaccctcactgcagcctcctgaaggcagaatcttgtacctttgcagccctggtgactctcacacacctggctgcac

SEQ ID NO: 15749 - DNA, 201 bp, Homo sapiens
acggggtttgccacattggccaggctgttctcaaactcctgacctcaagtgatccgcccgccttggcctcccaaagtgctgggattacaggtgtgagccastgcacccggcccagagtctctccctttctttgctgaagaatttatgttatgtattcatcacctatctataaagtggttatagctgggaaccctttgcaga

SEQ ID NO: 15750 - DNA, 201 bp, Homo sapiens
cccgacggtgtctccataattccgccctgcattatcagagctgcacacgttgtgctttgttgaagccgtagtttttcctctctaagctcagttactcccaytgatgggcgcagaatgagcatctggggcaacctcgacgggtgcctcggtggaagggcgggagccctgcggggggcctgcgggatcccgggatctgtcagc

SEQ ID NO: 15751 - DNA, 201 bp, Homo sapiens
aggctgttctcaaactcctgacctcaagtgatccgcccgccttggcctcccaaagtgctgggattacaggtgtgagccactgcacccggcccagagtctcyccctttctttgctgaagaatttatgttatgtattcatcacctatctataaagtggttatagctgggaaccctttgcagatgggtaattcatcattagacg

SEQ ID NO: 15752 - DNA, 201 bp, Homo sapiens
ttgggagtgctctcccttccctctaaacctgttcaaatcctgtcattccgcaaggtcagttcacctcctccctcctgtgtgcaacttccctgcctgcccctggcggagttttctctctccctgaatcactaaagcgcttcaggtttgtctgtggctttggggccattgcatgtcattgtgtttgtcagagctgtgtttaga

SEQ ID NO: 15753 - DNA, 201 bp, Homo sapiens
ctcctgcttctgcctcctgagtagctggggctgcagatgcgtgccaccatgcccggctaatttttgtatttttagtagagacagggtttcactatgttggycaggctggtctcgaactcctgatctcatgatccgactgcctcagcctcccaaagtgctgggattacaggcatgagccaccgcgcccagccaaccctggtg

SEQ ID NO: 15754 - DNA, 201 bp, Homo sapiens
cctttctcgctgagccttaccctgtcactgcctgacttaaaattccagcccccatactccctgtctcccctgcctaatttttctgcaaaatatttatcaayctttgccactgtacgtattgtacttatttgtttattgtctgtcttcccccattagagtttaatccccacgagagcaaatatttttgtcaattgtttattc

SEQ ID NO: 15755 - DNA, 201 bp, Homo sapiens
cagtggggctatcacggctcattgcatcgttgaccacccaggctcaagtgatcctcccacctaatttttttttttctttttttttttttttttttttttgkggagacaaggtttcactgtgttggccaggctggtctcgaattcctgggcttaagtgatccgtcagcctcagccttccaaagtgttaggattacaggtgtg

SEQ ID NO: 15756 - DNA, 201 bp, Homo sapiens
tcctcacttccctcagtgggcggcaggcgctgctgtgcacagttgtcccagcccaagattacgtggcatgcttatctcttgcctcctccttgctgtcacamccaggagtcacaaagtcttgttgatgctcctacagctctggaatatgagtccccactggtccctgccactgccttaatccagctccttgtaacttctcac

SEQ ID NO: 15757 - DNA, 201 bp, Homo sapiens
aatcctgtattataccagtgggggttaacacattcaaccaaattcatcaactaaggttaactgcagttgacatcaattactttaagcagatttttaaacasagaattttaatagtgaccctcatattaacttcttctgatctcttttaggaatttatcaaagagctgctttctcggataagaggcatgaggaaactgagcc

SEQ ID NO: 15758 - DNA, 201 bp, Homo sapiens
tgggtgtggtggcaggcacctgtaatctcagctacttgggaggctgagcaggagaatcccttgaacttgggaggtggagattgcagtgagccgagatagcrccactacactccatcctgggcgacagaatgagcctccgtctcaaaaaaaaaaaaaaataatggaaataaaaaagaaaaagaaatatatatatcatgctac

SEQ ID NO: 15759 - DNA, 201 bp, Homo sapiens
gagtcacaaagtcttgttgatgctcctacagctctggaatatgagtccccactggtccctgccactgccttaatccagctccttgtaacttctcacctgtrtaatagcaatggtcactgtagtccagtttctttcaaattacggcaaccactctttctgctactgcaccctccaccactgctgctattgtttctactactg

SEQ ID NO: 15760 - DNA, 201 bp, Homo sapiens
actggcaacttccctggtgggtgggaaagagaaacctgcctggtgggtgggttcaggacctagaaaagacctcctcagcctagttccttgttgctttgccrccgcccccaggcagttcagcctgggcttagtcagtgtctagcagcctcactgaacttctgggaccaacagcccctgggtacttctcttaccacctggtct

SEQ ID NO: 15761 - DNA, 201 bp, Homo sapiens
aagggatacagagtatatattttatcttacatatttgaaagcagcagatattatcattgacatggtagaagtaatgctttttctaaatacaatgtaaaaaactattaattacttggtttgcttatgctaaatgatgttttcactcaagtccttagctactgccgccaatcatctgttaatatttttctcttatatttgtat

SEQ ID NO: 15762 - DNA, 201 bp, Homo sapiens
tatcagctgagtccctaaggcagctcagcaggagcccctctgccataatcacctccaccccctcccctgcccccactccctagctgtctagcttgcacctsttcttagcctggtacttggcagtgccttcccaggagcttctctgatccatctcctgctgtcaggctggctctgtggcctttccagggcccctctttctgt

SEQ ID NO: 15763 - DNA, 201 bp, Homo sapiens
gagagatttgggggcacgaactaagcctgccctgggtgccagtgatactggcaacttccctggtgggtgggaaagagaaacctgcctggtgggtgggttcmggacctagaaaagacctcctcagcctagttccttgttgctttgccgccgcccccaggcagttcagcctgggcttagtcagtgtctagcagcctcactgaa

SEQ ID NO: 15764 - DNA, 201 bp, Homo sapiens
gtcctgtgatgtgattaatgcccttaaaaggggaggaaggggccagagctcgctctcactgccatgcaagggcacagcgtgaaagcacagcaagaagatgraagacggccacctgtagaccaggaggaggatgctggcaccctgatctcagacctccagcctctagaactgtgagacagaaatgcttgttgttgagccact

SEQ ID NO: 15765 - DNA, 201 bp, Homo sapiens
agagatagtgtctccatgcagagcaaagctgtctattataaaagatatgggttccctaagtgtcgagcccctttcctgggatgcgacccactgcatgcacrggcgtcatctgtccttctttgcaacaccctaggagaactggggctcgagaagtgccactactctagccactgctattgctgtaactgtccttcctctctg

SEQ ID NO: 15766 - DNA, 201 bp, Homo sapiens
agccaaacttcaaaggaaattgtgaaagggtttggaatcattttagtaaaagttttaggtttataactggtttatatattctattggtttattggtatgtwttttttttttttttttttgagacggagtctcgctctgttgcgcaggttggagtgcagtggtgtgatctcggctcactgcaacctccgcctcctgagttca

SEQ ID NO: 15767 - DNA, 201 bp, Homo sapiens
tgttagtatattccacacagttatttcgtacatagtggctgcatatttctttactcaaagtctgtgttcaggaaaggatatgataaattcactgacattakattgcaaatgactaaaaacaacttacttatctttcattttaataggaagtcagatcttaagtaagagaaagtaatctcttaagggctgggcttcaggaat

SEQ ID NO: 15768 - DNA, 201 bp, Homo sapiens
ctgaggtcctgtcaccatttgttgagtttgcacaacgtgcgtgggcatgattgtgcccgatttctatccagccccgagaattagctagcagtccccatttyacaggtgtgggaactaagggttaggggatgcgttaccctgccccagctctcacgggttgtcagaggcagagatgaaactgaaacctgggtctgcttctct

SEQ ID NO: 15769 - DNA, 201 bp, Homo sapiens
gattaataacttttttttttaaatcatcttttcctcctctgaaacctctccttaactattggctttcaagttaagtttggaatctgacagcacagacactyacagccaccatagctgctttttctttgcatttaattgggttaacttttaagaaatggcatgtttgacttaagatttttaggcatataacctataatattg

SEQ ID NO: 15770 - DNA, 201 bp, Homo sapiens
ggtgaagctcttttgtaaagctgtgtttttgtgtgtgtgtgttaatgcaccagaccattcctggcctactgtgcaaggccctgtggtgcaggtggggaggmgggtagagatagagagcgaggtacagctgagtgcagatccccagctctgagcatcactgggtgtgtgacttactcaattcatcatttagctattgagagc

SEQ ID NO: 15771 - DNA, 201 bp, Homo sapiens
cccttgaacttgggaggtggagattgcagtgagccgagatagcaccactacactccatcctgggcgacagaatgagcctccgtctcaaaaaaaaaaaaaaataatggaaataaaaaagaaaaagaaatatatatatcatgctactccctagttaaagccagtgtcatctcttcccagcttatttctgtggcctcttaactg

SEQ ID NO: 15772 - DNA, 201 bp, Homo sapiens
gtctcagccgtcacttattttcactcgtcttacgaggaccaacctgccgactttctcgtcacgggggcattgttaacaaccagctgtgcgtgtttagtgtkcataagcagagcaaagtgtgattgtctccaggaagctctgcatctgggtttttttgctgacattttcttttctttttttctctttgaacgctgtggtttt

SEQ ID NO: 15773 - DNA, 201 bp, Homo sapiens
ctctcccttccggggatcttcatgtaggtgctgcacggggaaagaagggccctgagaagagaggctgctgtcggcacaggagccgtgagggtggcggccgyctggccactgtgtccagtgctttcaaggtgttctcagtgtcctcgtttatgccacggcttagaagattgtccttgccatctttagcaactgtctcagccg

SEQ ID NO: 15774 - DNA, 201 bp, Homo sapiens
tctggaatcatccgaagactggactgggctggttttccacgatggttccttcacctacaggtctggcttcttgccctctctgtttccacacagtgtctcayctttcagggcctctcatcttttgggactggtactagtccatggcctgggtcttgggacccctgtgctagaggatgacatggcacagtcacacatttggct

SEQ ID NO: 15775 - DNA, 201 bp, Homo sapiens
tcccttgaacttgggaggtggagattgcagtgagccgagatagcaccactacactccatcctgggcgacagaatgagcctccgtctcaaaaaaaaaaaaaaataatggaaataaaaaagaaaaagaaatatatatatcatgctactccctagttaaagccagtgtcatctcttcccagcttatttctgtggcctcttaact

SEQ ID NO: 15776 - DNA, 201 bp, Homo sapiens
gacaagtcaaaagaaaatgagtaattgatttggtgctaaaacatgattatgcttgctataatgaaagcaccctagaaatattaaaactaaaaaacaacacrtactatctctgttagacaagtgccttttgttatgttaagatattccatttcttcttcatgcgagatggttcagcatttactaatcttataccagaagcag

SEQ ID NO: 15777 - DNA, 201 bp, Homo sapiens
agtgatccgcccgccttggcctcccaaagtgctgggattacaggtgtgagccactgcacccggcccagagtctctccctttctttgctgaagaatttatgytatgtattcatcacctatctataaagtggttatagctgggaaccctttgcagatgggtaattcatcattagacgggttatagataatctctctattcatt

SEQ ID NO: 15778 - DNA, 201 bp, Homo sapiens
atcccttgaacttgggaggtggagattgcagtgagccgagatagcaccactacactccatcctgggcgacagaatgagcctccgtctcaaaaaaaaaaaaaaataatggaaataaaaaagaaaaagaaatatatatatcatgctactccctagttaaagccagtgtcatctcttcccagcttatttctgtggcctcttaac

SEQ ID NO: 15779 - DNA, 201 bp, Homo sapiens
tctgttgtttttttaattctatctttcatgattgctatggcaaattagacttttcatatttgaaggggatttttttttttttagtgagttatctcggactrttagcaagcaattctggctgatgttagtcataaagtttacttgaattttctttagtacaatcatccctgaaattataaagaggaaatgagttggtcaaaa

SEQ ID NO: 15780 - DNA, 201 bp, Homo sapiens; identical to SEQ ID NO: 2542

SEQ ID NO: 15781 - DNA, 201 bp, Homo sapiens
ctcccattgcaggaggaagtggcctcttgagccctttgagatcaaggctgggcatagaacacaacctctgctccaactcagagtcttttttttttttttttgttaaactgtgtctggagcactttgataatctctccagagatagtcatttttgctaaaatgaattgctaaatgtaggggagagatttgggggcacgaact

SEQ ID NO: 15782 - DNA, 201 bp, Homo sapiens; identical to SEQ ID NO: 2543

SEQ ID NO: 15783 - DNA, 201 bp, Homo sapiens
cctcccattgcaggaggaagtggcctcttgagccctttgagatcaaggctgggcatagaacacaacctctgctccaactcagagtcttttttttttttttttgttaaactgtgtctggagcactttgataatctctccagagatagtcatttttgctaaaatgaattgctaaatgtaggggagagatttgggggcacgaac

SEQ ID NO: 15784 - DNA, 201 bp, Homo sapiens; identical to SEQ ID NO: 2544

SEQ ID NO: 15785 - DNA, 201 bp, Homo sapiens
cctggccgccacggtggaggagggcctggatgcccggctttgtgtgcccctgcccgtcacggtggaggagggcctggatgcccggctttgtgtgcccctgsccgccacggtggaggagggcctggatgcccggctttgtgtgcccctggccgccacggtggaggagggcctggatgcccggctttgtgtgcccctggccgc

SEQ ID NO: 15786 - DNA, 201 bp, Homo sapiens
ttatacatgggggctaaaaaaataaatgaaatgcagttcctgccctcaaggagctcttagtttgctagtggagacaactgatacacatctggattgacatkttttgtttttgagatagagtgtcgctattgcccaggctagaaagcagtggtgctatctcggctcactgcaacctctgcctcctgggctcaagctatcctc

SEQ ID NO: 15787 - DNA, 201 bp, Homo sapiens
gcttgaacccgggaggcggaggttgcggtgagctgagatcatgccactgcactgcagcctgggcgaccgagggagattctgtctcaaaaaaaaaaaaaaaagtagtgaagaggatgtttcttttttgctctcatatttgaaacatatgatcaattggcttgaacattgtttatgataccactatgacatttaatccgtgtt

SEQ ID NO: 15788 - DNA, 201 bp, Homo sapiens
cggggtccgaattactcgcctctctgggacagctcccttttctccctcccttgtgatcttgcatccaacccttccttaaccaagtctgcagacttaggttygtcctcaccctaaggtgaaccagccagctcctgttctcagtctggggagtgctccttttccactgctgagcagagactggagcaggagacacagtgatgc

SEQ ID NO: 15789 - DNA, 201 bp, Homo sapiens
cctcccttgtgatcttgcatccaacccttccttaaccaagtctgcagacttaggttcgtcctcaccctaaggtgaaccagccagctcctgttctcagtctrgggagtgctccttttccactgctgagcagagactggagcaggagacacagtgatgcgtctcatggccctgcccctggctctcttccctttggacacaccc

SEQ ID NO: 15790 - DNA, 201 bp, Homo sapiens
tctgcccacctgggcctcccaaagtgctgggattataggcgtgagccaccgtgccaggccaacctctgccatttcttcctgaaccactgatctctttcctrttgctatcgttttgccttttccagtatgtcatataattgaaatcatacagtatacagcattttcagactaacttctttcactacacaatatacatttaag

SEQ ID NO: 15791 - DNA, 201 bp, Homo sapiens
gcctgaaaatgaagttctttggaagtgccatctgacacttctcctggtgggcagagttgctgaaactggaagcagggggtttgaggggtgctgtaactgaygtggggagaccgactggggacaaagaatgaggatagtaacaggagatgactcctcctccccaggaggccagatgcatccagaggcctcacatggctggat

SEQ ID NO: 15792 - DNA, 201 bp, Homo sapiens
caggctcttctctgggagggtccccatggtgccctcccacacagcctggcctggtctcagggctgaagctgaggacctgggtgtgcctcagttggctgaasgtcattgtatgactcacacctggaccttttgcccagccctcggctgtaagaagaaccagcagagccagtcacaggaaggcctggccctcaccttcctggg

SEQ ID NO: 15793 - DNA, 201 bp, Homo sapiens
tctccctcccccccacccccgagatttgttaaggtattattgaaaaataataattatatatacttgcagtgtacagacatgatgctttgataggtgcataygttgtgaaatgattaaatcaagctaattagcatattcatcacctcacatacttaccattttctaaattgtgagaacacttactaacttacccatacttct

SEQ ID NO: 15794 - DNA, 201 bp, Homo sapiens
tgactagttagtaatttcctttgtaaaatattacttcaacaataaaagtgaactcttgagcatggggctggtgagggcatttccaaatgcaaggaagttaytttgacatctccctggtggtgcccaggtacagacggtgggtaattaccagaactgttgctttgtatgatttccctagtcaaaggcttaatcatttgacag

SEQ ID NO: 15795 - DNA, 201 bp, Homo sapiens
tggtgagggcatttccaaatgcaaggaagttactttgacatctccctggtggtgcccaggtacagacggtgggtaattaccagaactgttgctttgtatgmtttccctagtcaaaggcttaatcatttgacagtatctaacccagtgttattggataacataacccatggctcttgactgtgctaggtatgaggctggtgt

SEQ ID NO: 15796 - DNA, 201 bp, Homo sapiens
gagtgtggtcccctgagtgtgtgaaagctgtcgtcatcctctaagtttccatggagtttcctgggctccagctggctgtggataccagggcttgaatgtgytgggtgcctggagccgcatgtctgaagggctctgctctcctcccttgctgctccaaaagtcacggaagtcaaaagggagaaatcattccccagccatgct

SEQ ID NO: 15797 - DNA, 201 bp, Homo sapiens
catttccaaatgcaaggaagttactttgacatctccctggtggtgcccaggtacagacggtgggtaattaccagaactgttgctttgtatgatttccctartcaaaggcttaatcatttgacagtatctaacccagtgttattggataacataacccatggctcttgactgtgctaggtatgaggctggtgttttctcagc

SEQ ID NO: 15798 - DNA, 201 bp, Homo sapiens
aattgatttggtgctaaaacatgattatgcttgctataatgaaagcaccctagaaatattaaaactaaaaaacaacacgtactatctctgttagacaagtrccttttgttatgttaagatattccatttcttcttcatgcgagatggttcagcatttactaatcttataccagaagcagtttacatggagagatatttaga

SEQ ID NO: 15799 - DNA, 201 bp, Homo sapiens
ctctatagatcccgagtttgggaactggctggagtctctgttgaaggactggagaaggttacaaggattgtctctgcccctgcctacctcaggcctcccasaggtgggggatgagggagtctgtggaagaggaaagaactaagggaggagcccagtgtgagaggctctgctcccgcctgcggcacttccctgcacctgcca

SEQ ID NO: 15800 - DNA, 201 bp, Homo sapiens
ttcttttcacatcctttatgccctgattgagaggatgtcttagtccattttgtgttgctgtagcagaatacctgagactgggtgatttatcaagaaagagscttatttggctcatgattctggaggctggggagtcccagaagcatggcactgcatccgttggcttctgggcttctagggagaatctcatgccatgtcata

SEQ ID NO: 15801 - DNA, 201 bp, Homo sapiens
agcaaggcatccaattcttgaatctagtttctcttctaaggactttttttttttttgaatctctaaggttgttttgagtatgttctcctcaatccaaattkttccctgctcaggagaaaataaagctctggggagaggcttaaccatttaatcatgtaccatttaacacctctttctgggaatggaaacatagatcagcat

SEQ ID NO: 15802 - DNA, 201 bp, Homo sapiens
cgatggggacactcaaaccatagcagagacattgccttctaagatagaccctcccaccttcctgggctgggggagctggcttggtctatctagaaggatgmgcaggctgcccactacctacctttattaagagtgatttcagtcatcatacttggctaactttaatttccacttttaaattatctaatcctttcacagaaa

SEQ ID NO: 15803 - DNA, 201 bp, Homo sapiens
aactcttttttcatagggtatcttttatatgtacctagaaaagagatttggatgatacatgataactatcagtagtgctttttagtatcattatgggtaayttattttgtttatctgttttgtgcaatgcacatgtatttctcctataagagaataacttcaaagttgttttttagaaggggtgggcatgagtatcccact

SEQ ID NO: 15804 - DNA, 201 bp, Homo sapiens
cctgtatgaccatcttcaaatctgtctcaatttcaagaggaggttactcatgcaattatgtgggttactcttattcttaacttgaacatttcagaaaatgmgttttatggtagttttaagcctaagcattttacatggcagagagctccggtttattcactcaataacaaattgcagtatatgtgtgtgtgtggataccat

SEQ ID NO: 15805 - DNA, 201 bp, Homo sapiens
tttattaaaccaccttggcttctgactactcctaactcacctcgcctttagcacaaacagttctgtccttggtgaatctgataaaatgatttgcttgttcwgctataaaacgtaaaagaggctcttataatttgttgcatagtttaagaccctgttttgtttgaccactgcttgggggttgatgtttgttattctttagca

SEQ ID NO: 15806 - DNA, 201 bp, Homo sapiens
tgcttgaacccgggaggcggaggttgcggtgagctgagatcatgccactgcactgcagcctgggcgaccgagggagattctgtctcaaaaaaaaaaaaaaaagtagtgaagaggatgtttcttttttgctctcatatttgaaacatatgatcaattggcttgaacattgtttatgataccactatgacatttaatccgtgt

SEQ ID NO: 15807 - DNA, 201 bp, Homo sapiens
gcttatggcatttcaattatgccttaataaagctgctaaaaaaaaaaaaactcactgggaaccttgtagcctctttcccaaccattctactcaaacttctstcatctaagacacactggccctttcttgcccgatccattatatttgtctctgtccttgatttacttaacttctcattgcacttgacttaggtgagcacct

SEQ ID NO: 15808 - DNA, 201 bp, Homo sapiens
tgcagcctccgcgaggccttttgtgcagagccttgcccttgtgtgtgccctcctactccatctgtatcttgtcgtcagttgctggcgccacctcagcaggrtttactgtgacctttcttgggcccatctgggaacagtggtagtaggtctggacctaggggtccagtgggtctttcccacaacctagcctgtgtaagaggc

SEQ ID NO: 15809 - DNA, 201 bp, Homo sapiens
cctaagtatgatagcttttatgcagggaagtgatatggtcttattattttttatgactataaaattaacttttatttaacatttttttacaaaatacattwaaaaaattttaaatctgttttttagagcagttttagattcacagtaaaattgagaggaaggtacctttcctatgtactctctgcccagtcccccaacaca

SEQ ID NO: 15810 - DNA, 201 bp, Homo sapiens
aggcccctggggacagtggacgctggctctgtgggccgaccaaggagcgagaccagctggagcatgtcaggggatggtgggtgtgattggagaggagggcrgtcacagcaggtgaggttgtgtccctctcctaatatgcagggccagcctttgaagttcatttcttcagttcaggtaaagtcaatacgattgatttctaga

SEQ ID NO: 15811 - DNA, 201 bp, Homo sapiens
ctccaacagagacaaacctgtggttcccaccatccgtatccattcccttaattgttcagttgtagtatatatgtacagcaatatcagaattgttaactcaacccctatgggaaacaactttatcaactagaagatggcgcttatatgcactccttttacatttgattttaacagactctacttatttctagttacttaggt

SEQ ID NO: 15812 - DNA, 201 bp, Homo sapiens
ctctggagaaggaaaactaatctggagtgacagaaaacaggtcaattttttcctgggaatgggaggagggagattgcacagaagcatgaagaagaaacttytggaggtgttggatgtttccatgatgttagatcatgcagatagtatgcttgtggttgttgtctgccttaaatacgttcagcttatggcatttcaattatg

SEQ ID NO: 15813 - DNA, 201 bp, Homo sapiens
actcccagccattacaactgtcatgatgacataaaatactgcatcagaaatagtaaccagggtctttatactgttgtttatttcattacttggaatgaaartgacaatctaaggtgaagagatggacttggtttgtctgaaatagggaaacatctaggtgtagattttcagatctcacaggggacaaatttcttcatctgc

SEQ ID NO: 15814 - DNA, 201 bp, Homo sapiens
actccaacagagacaaacctgtggttcccaccatccgtatccattcccttaattgttcagttgtagtatatatgtacagcaatatcagaattgttaactcaacccctatgggaaacaactttatcaactagaagatggcgcttatatgcactccttttacatttgattttaacagactctacttatttctagttacttagg

SEQ ID NO: 15815 - DNA, 201 bp, Homo sapiens
tactccaacagagacaaacctgtggttcccaccatccgtatccattcccttaattgttcagttgtagtatatatgtacagcaatatcagaattgttaactcaacccctatgggaaacaactttatcaactagaagatggcgcttatatgcactccttttacatttgattttaacagactctacttatttctagttacttag

SEQ ID NO: 15816 - DNA, 201 bp, Homo sapiens
agcatatgtatgtgctgggagaggggcccagagagggcacgagagctccatgctccttccctcaagccctgacctgtgtgtctcttcatctgctgttcatytgtatcctttatcacatcctttattaatgtaataagtaaatataagtgtttccctgagttctgggagttgctctagcaaattattgtaccctcagagagg

SEQ ID NO: 15817 - DNA, 201 bp, Homo sapiens
ctactccaacagagacaaacctgtggttcccaccatccgtatccattcccttaattgttcagttgtagtatatatgtacagcaatatcagaattgttaactcaacccctatgggaaacaactttatcaactagaagatggcgcttatatgcactccttttacatttgattttaacagactctacttatttctagttactta

SEQ ID NO: 15818 - DNA, 201 bp, Homo sapiens
ccctgtgcagatgaaggctaggcctgtgaccagtctgattgtttgcgggagaggacctatcagaagtactttccatttttcatctgcaatgcagaaagtgrggagggttggaaagagaacagcctctgatccttttgttacctgagtgtggaaagttagggttttccttttgattcacttctagtcagtctgtgcaaacca

SEQ ID NO: 15819 - DNA, 201 bp, Homo sapiens
cgccccacagactgggagtgggctggagcaagtggctcaagagtgctggttacagaaacctctaggggtttcccattggttacttggttagaccctatgtwaatgaagtagtggcctgcaaccagtctgattggttgcagaaggtgaccaatcagaggctgaagtgaattttcaaagttacacccctgtgcagatgaaggc

SEQ ID NO: 15820 - DNA, 201 bp, Homo sapiens
ggcctgggaagttcaaggtcgaggggtcatatctggttggcttctggtgacagcgttcatcccgtgtaatagcatggcagaaaactggaagggcaggcaakcgcttgaaaaaagagatggggcaaagggggctgatccactttataacaaccagcgcctcatgagaaccaactcagtctctagagaacagtgttaatgcac

SEQ ID NO: 15821 - DNA, 201 bp, Homo sapiens
gcatggcagaaaactggaagggcaggcaagcgcttgaaaaaagagatggggcaaagggggctgatccactttataacaaccagcgcctcatgagaaccaaytcagtctctagagaacagtgttaatgcacgcatgagggtgtgcccccatgacctaatcacctctgaaggttcccattacctctcactcagtactgttgcc

SEQ ID NO: 15822 - DNA, 201 bp, Homo sapiens
cccaggtacagacggtgggtaattaccagaactgttgctttgtatgatttccctagtcaaaggcttaatcatttgacagtatctaacccagtgttattggrtaacataacccatggctcttgactgtgctaggtatgaggctggtgttttctcagcagaaccagttaaaataaaacctagatgtcatatcccaatctggcc

SEQ ID NO: 15823 - DNA, 201 bp, Homo sapiens
ttattggataacataacccatggctcttgactgtgctaggtatgaggctggtgttttctcagcagaaccagttaaaataaaacctagatgtcatatcccartctggcctgtttgggaaaatgcagtttgaaccacaagcgcaatctacccgtggtgttttataacactgtttgcttggccagtcttcttcagcaggccctg

SEQ ID NO: 15824 - DNA, 201 bp, Homo sapiens
ctctccctggtaacaggatctctaaaccggccacacctgtcataagtgactctactaaaggagaattcagaattccactggggatacttagaacagtgagstgatgtgatcttgtgttattttccctttcttgggggttatcccttgattaattacctgtctgttggagagagagtgttcttataattggggtgaacagga

SEQ ID NO: 15825 - DNA, 201 bp, Homo sapiens
gtgatcttgtgttattttccctttcttgggggttatcccttgattaattacctgtctgttggagagagagtgttcttataattggggtgaacaggagggcyctagtgggcaccccggggtgagggagtgtggggcattgcagtagaacctaggcagcgcttggagccagccctactggctatctgggcaggccagccctgg

SEQ ID NO: 15826 - DNA, 201 bp, Homo sapiens
ggctctagtgggcaccccggggtgagggagtgtggggcattgcagtagaacctaggcagcgcttggagccagccctactggctatctgggcaggccagccytggaaggattcccatcttctcaacgggagtgcccgtggcttccatgagttaccaagctgggaattgcttctaacaatcgagttggaggcggggtgcccgt

SEQ ID NO: 15827 - DNA, 201 bp, Homo sapiens
tctgtgatgtttgcacaatgacagaatcacctatggatgcatttctcagaacatatcccttttgtcccctcccccaccccatcctcttcatggccacatgktgtgttttgtcgttactatacctatatcttggagacagcactttttaagcatattttggacttctctctgccaaaaatgcggacaagtggcctctctttt

SEQ ID NO: 15828 - DNA, 201 bp, Homo sapiens
cagaaatagtaaccagggtctttatactgttgtttatttcattacttggaatgaaaatgacaatctaaggtgaagagatggacttggtttgtctgaaatasggaaacatctaggtgtagattttcagatctcacaggggacaaatttcttcatctgcagaggaggaaataaacaggatctgtgtagctcttggatgaccag

SEQ ID NO: 15829 - DNA, 201 bp, Homo sapiens
cactttgggaggccaagctaggggcgctgcttgagcccaggagttcagtaccagctgggacaacatagcaagaccctatctctatacaaaataaaaatttrccaggtgtggtggtgctagctactcaggaggctgaggcaggaggtttgctggaatacaagggttcaaggctgcgatgagctataattgcaccactgcact

SEQ ID NO: 15830 - DNA, 201 bp, Homo sapiens
gagaaagagagagagagagaaagaaaggagggagggagggagggagggtcggccatgaagactttatctatatagcgagggtaacagacagcccaggtgtrgagagtccagataagtgtctcgatttttccacgttggcctatgtttttaaatggaaacgaactctgcagacctgcccttcattagaatctgaatccccaa

SEQ ID NO: 15831 - DNA, 201 bp, Homo sapiens
cttcgcgttttgaacaaagaattggacaaaacacacaaagcaatgaaagaatgaagcaatgaaagcacagatttgctgaaacgaaggtacgccccacagastgggagtgggctggagcaagtggctcaagagtgctggttacagaaacctctaggggtttcccattggttacttggttagaccctatgtaaatgaagtagt

SEQ ID NO: 15832 - DNA, 201 bp, Homo sapiens
ttttcattgcttctcaaatttgccttgaaatagaattacttactgcagtaaatgatttgcagtatgtttatccccttcttcttcgtccgtagcagctgctrgttgaagtgggaaataggattcagtggtggaataagaattagttttttttggatatgccaaatttcaaattgactatatagctaactaacttgtgtgtaa

SEQ ID NO: 15833 - DNA, 201 bp, Homo sapiens
atggaaataaggagagaagacacattactaacattaggaatgagagaggtgacatcactacagattctatagatattatgcacaagcttgtgccagtaaakccaacaacttagttgaaataggcctgatattgttaccagtggagaatgtccaggttcttcgcgttttgaacaaagaattggacaaaacacacaaagcaat

SEQ ID NO: 15834 - DNA, 201 bp, Homo sapiens
gaacagctttagtctgtgtagtggtcatgggcatgcactctgtatccagacctgccggctttgaatctggcctccctatttccaagctgtgtaccgtgagrcaaattattcaacctctctgttttaattgcctcaggctgctataacaaaataccatagcctgggtagcttgaacaatatagatgtgtttctcacagttct

SEQ ID NO: 15835 - DNA, 201 bp, Homo sapiens
ctcccaaaatgctgggattacaggcgtgagccaccgtgcccggcccaaactgggacatttcttaagatgagcaagtgaaacaaaagtttcagtggtttatrtagaatctcatgttgatgtatatttataagcatgtttattttaaacatctgagagaaacagcagagacttgctatggtgtaacgcttactttccgacagt

SEQ ID NO: 15836 - DNA, 201 bp, Homo sapiens
gaggcagagaccgtagtgagccaagatcgcaccattgcactccagcctgggtgacagagtgagactctgtctcaaaaaaaaaaaaaaaaaaaaaaaaaaaagaaagaaagaaaaagaaaaattcaaatccattatctctgaagtagacaccccagtgagtgagctacttctttctttctttgccaggtttgcatgagccgt

SEQ ID NO: 15837 - DNA, 201 bp, Homo sapiens
cagggagttcctcattgatcctcacccatcctattagccagggactgaaacttcaaaaaagaatggattccctttttagaatattgcaaaagatcatgtcygttgtggttaaagaattgccttaaataacatatcattttcacttgaatatcctgcaacaggggaacactcgtgttcatcctttctttcagcatgtccaat

SEQ ID NO: 15838 - DNA, 201 bp, Homo sapiens
tttatatagaatctcatgttgatgtatatttataagcatgtttattttaaacatctgagagaaacagcagagacttgctatggtgtaacgcttactttccracagttcacatatttcccaagttttaaggagttcctattgatggtaggtgagtgattcttttggtttttgaagaaggattagttgtgacaaccccgtgag

SEQ ID NO: 15839 - DNA, 201 bp, Homo sapiens
ccgctccgtctttctccttccctttctgggtttttcctcttttgcctgctcttcagtgatgacatttctctgtcttcgggccctggctctctgttttttttgttgtttgttttgttttgtttttttttccttcactcctgcgtgctgtttttggatgataagacccttcctgtggctttaattgctgtccatatgcggaca

SEQ ID NO: 15840 - DNA, 201 bp, Homo sapiens
gtgtcttctttcccagctggcctgggagctcctggaaggcagggcctctgccaccttctgctctgcatctcagcacttgagtagagtctggcatagactcyacttagattagagcatgggctcagtacatacttatcaaattcagttggcatcaagaagcctggattcaaacatttgcttggtgatcgtaggcagtgactt

SEQ ID NO: 15841 - DNA, 201 bp, Homo sapiens
aactatcctctatttctgatgtagtagcattctcacttcctgcttttcagtttgactgggttgcaacgggtccattatttactcaacttctttctttatcratttcctcatctataacatgtcaacaatggtattgcctctcttacagggtagttgtgaggatgaaggggttaaatgcaggtgaaacccttagagaagtgc

SEQ ID NO: 15842 - DNA, 201 bp, Homo sapiens
agtcaatctgtgtttttgttactgtagtcatatcacattcttgcatccttacagctttatgtcagtgctgttggaaaatacacctttcttcattgacttaacttgctccaaacaggaactgaaaggtggtaatggtagccaattgactttgaagtttaggttgacagaattcttttgcaaatgtgatcttccctgagtccc

SEQ ID NO: 15843 - DNA, 201 bp, Homo sapiens
attcatttctaagtggtgcagaaggatttgaacccaagtcatctgactctagagtccctctcgtaggcatgtggctacactgcttcttaccatgtgtggtrtgtattgggtgactcctttctggcaggaacaagcccattaggttttttttaggcatctgtttcaaagggttcttctatatttgtaagccaaacctttttc

SEQ ID NO: 15844 - DNA, 201 bp, Homo sapiens
tctcatgaaagtcacacagacctgcaaggctcctgcaatctgccctttactctttgcccttcccagctacctcatcgatttcctgactgctcgtcttgccrtggggaccatccttgcattaaccacaggaatttccagcaacagtccactaccatattcctagcactgagcatagagtctgacagatgatgtgtgtgattg

SEQ ID NO: 15845 - DNA, 201 bp, Homo sapiens
tggccctgtcattcagtgggtatatgtgattaggcaatttccttcacccctctgagcctcactttctccatacatatgtgtgtgtgtgtgtgtgtgtgtgkatgtgtgtgtatatttcagacagtctgactcctgttgcccaggctagctagagtgcagtggggctatcacggctcattgcatcgttgaccacccaggctc

SEQ ID NO: 15846 - DNA, 201 bp, Homo sapiens
cagtgccttgcactctgcggactctgggttctcaacaaatgtacgacaagaaagatgtgtagaggtgatccagggcctcgtgctatgggtaccaacaggarggcctctcactaatgtggggcagggagtagctgataactttccccagcagctgtgaagacagttgtttcactttttgtcaccagagccactgtttaggga

SEQ ID NO: 15847 - DNA, 201 bp, Homo sapiens
attacaggcgtgagccaccatgcctggcccagagtagcatattcttgatttgaatttgtagactggaaagttcagtgtagtctgatgatgatgatgataaygatgatgacagtatcaagcacttgtacagcacttactactctttaagcacttttccaaacatgtaacatacagtaattcatctcatcatttaatccttac

SEQ ID NO: 15848 - DNA, 201 bp, Homo sapiens
ttttcagctaggaatttgattataatgtaaccattagactaaatctacatctacatccacatttaaggatttctgtttaaagaccttttttttttttttttaatctcttccaaaccctggtgggttttttttgttttgttttgtttttgtttttttgagatgaagtctttctctgtggcctaggctagagtgcagtggcgc

SEQ ID NO: 15849 - DNA, 201 bp, Homo sapiens
ggagtgttgctctgttacccaggctggagtgcaatggtgtgatctcagctcactgcaacctccacctcctgggttcaagtgattctcctgcttcagcctcyggagtagctgggattacaggcatgtgccaccatgccctgctaattttgtgtttttagtagagacagggtttcaccatattggtcacgatggtctcgaact

SEQ ID NO: 15850 - DNA, 201 bp, Homo sapiens
gcttcaagtatttcagcctctggtttgtgaatcaagaaggacgcaccctagcttacagctccgaacttcatgcatacgaagattaggaaatgtcctttttrtacttaaaagtggtaattctttcaaatgtttagcccatgaaagtgacacagccaatttcccagccttcaaacctcaaacctgccaaaggcttgagttatc

SEQ ID NO: 15851 - DNA, 201 bp, Homo sapiens
gtgtcttaactattcttgaatatttgtatttgactagaattgcattaaatttataggttaatttggcgagagaagagatctcgatgatgatttgttcaggrcacacaaaaatggacactgtaacttcctgaagggcagggacaggttgtaggaacagatgggtaacagtgagttagttcacttttggtcatttgagactga

SEQ ID NO: 15852 - DNA, 201 bp, Homo sapiens
tacccctgcattttgtctcaattactagggctttagaataagttcttaataaaggtccaataagtctacaattccttattcaaagtgtcttaactattctygaatatttgtatttgactagaattgcattaaatttataggttaatttggcgagagaagagatctcgatgatgatttgttcagggcacacaaaaatggaca

SEQ ID NO: 15853 - DNA, 201 bp, Homo sapiens
agcagcctagattctcccaccggatcccgctgctgatctttgatcaggatgagaagggcaaggccagggacttcttcacagggaggaagcggaaagtcggyggtagcatcattcacaaggcttcaaatgtcatgcacatcgagtccaagcaagtggtgggattccaactggtaagatttcaccttctcattctttcactgc

SEQ ID NO: 15854 - DNA, 201 bp, Homo sapiens
tctccctgacttttcctccccaccttggcaggtacagcaccgttcgccaccttctagctgacttggaacaggagaccagagaggccctgaagtccctgtayggctttccagagtcccggaagcgccgagaggcggagtcctggaactccgtctcagagggaaagcagcctagattctcccaccggatcccgctgctgatct

SEQ ID NO: 15855 - DNA, 201 bp, Homo sapiens
catgagcctttccccatttgccagagccaggggtcactttggatgggtcaagtcatgaaaggcgtggtctcctctgccaaggagttgggaaaggtgggcaygaggctgacacgtgttgatggaaaacagcctggaggagcaccagagttctgccagggccgcctcccctctccctgacttttcctccccaccttggcaggt

SEQ ID NO: 15856 - DNA, 201 bp, Homo sapiens
ggggaacctaaactcaggtaatttggctaaacccaggggtttctattctcaattgctatgctctgctgcctatgcctagagcaagtgggagaaaggagagwggagagagttaagaggaggctggaaccatttgatttgtgaaaattaaaagatggtatattgtgcttcacgcaggcaactcctttataactattttgtgtt

SEQ ID NO: 15857 - DNA, 201 bp, Homo sapiens
gcaggtcagaatcaggcagactttgtcagagcaggggtggggagaagggaagaagaacaggggagaaagattatcaaacgaaactaacttgtccagaatcrtcagtgagttggtgcaaagctcaaaatcaagatcaagtctaagactctctctccgccctccatgtcttcctcttctttctttctccctccctccttctct

SEQ ID NO: 15858 - DNA, 201 bp, Homo sapiens
tcccgtggaaaaggggccaaggattcagaatgcaaagtgcctaagccacagaggaacagaggaaggaggtctctaagggcgcatggactggtgtttcccaractgtggtctccagggacacactagccggctagtgcctgccagctcacctgcttctcttctttgcccctccagcacgcccgtcctcagagtcccgtcctc

SEQ ID NO: 15859 - DNA, 201 bp, Homo sapiens
cctgaccttgtgatccgcccgcctcagcctcccgaagtgctgggattacaggcgtgagccacagcgcctggcccataatgacgtttttctttacctgtttrtgggtggggagaaagaaacaaaatctccttgtggactatacatttgttcatgcctttatttaaatccaaccttaatatccccaattaaacttcctagctt

SEQ ID NO: 15860 - DNA, 201 bp, Homo sapiens
ttgtagaagtggttgctgcctgttctcacttgggaccaaggccggcaagtaaacaaaaagctcaacaagtaagttacctctaccctgttcctctgtctctkcccaccacagcccccagccttctcacttgcttctgtatgtgtatggccaaatcctctttttttttttttttttttttatggagtcttactctgtcaccca

SEQ ID NO: 15861 - DNA, 201 bp, Homo sapiens
tgatcaggatgagaagggcaaggccagggacttcttcacagggaggaagcggaaagtcggcggtagcatcattcacaaggcttcaaatgtcatgcacatcragtccaagcaagtggtgggattccaactggtaagatttcaccttctcattctttcactgcttaggggcatgggatgggctgggtccaggactcttctcct

SEQ ID NO: 15862 - DNA, 201 bp, Homo sapiens
tcatgaagttgatattattataaagaaagcaaagcatctgagaggttaagtaacttgcatgatgccaaacagcagaaaaatagcaaagattggatttgacytgagtagcctgccttcaggaactctgccattagcttttatgctataagctccatggatattgtggtagcttatgatccatgaagatccaacatggagggg

SEQ ID NO: 15863 - DNA, 201 bp, Homo sapiens
ttgcatgatgccaaacagcagaaaaatagcaaagattggatttgacctgagtagcctgccttcaggaactctgccattagcttttatgctataagctccayggatattgtggtagcttatgatccatgaagatccaacatggaggggttgggcttgagaataggaacacagggactgtgtttatttctctctgtttcttga

SEQ ID NO: 15864 - DNA, 201 bp, Homo sapiens
tagcctgccttcaggaactctgccattagcttttatgctataagctccatggatattgtggtagcttatgatccatgaagatccaacatggaggggttggrcttgagaataggaacacagggactgtgtttatttctctctgtttcttgacaactcctctaattttcccacttatctttgtgttggcacccacatgatgga

SEQ ID NO: 15865 - DNA, 201 bp, Homo sapiens
ttactaccaactgcatcgagcctttgtccaggaagagctgggctgccagtctgtgtgcaaggaagcctgcaggtatgtggaccccaaggggtgagacgggyggctgggttgggttgggctgcctacactcatgctgtcccctcctcccttagctttaaagagtggacactaaccacaagcctggcacaatggccatctgtg

SEQ ID NO: 15866 - DNA, 201 bp, Homo sapiens
cacttagaagaggcctggaacgaactaaccccctctgcacactccccatatcaagcccaaattagccaacccccatctgcatctgcacccctggctctccragctcacatgttcactctgcctgcagcataagtgagctcaaggctgactcagaagtgacacccaggtgacttctgtaagcacctcagctgccccaaaccc

SEQ ID NO: 15867 - DNA, 201 bp, Homo sapiens
gtatgtaccaagttttcagaccatcagtgacttgttttttttcttttctttttccttttttgagatggagtttcgctcttgttgcccaggctgggatgcartggtgcgatctcggctcactgcaacctccacctcccaggttctaacaatcctcccgagtagctgggactacaggggtgtaccacagcgccaggctaattt

SEQ ID NO: 15868 - DNA, 201 bp, Homo sapiens
ctggtgtttcccagactgtggtctccagggacacactagccggctagtgcctgccagctcacctgcttctcttctttgcccctccagcacgcccgtcctcrgagtcccgtcctcaaagtcccatcctcgccatggcacccggagagaagatcaaagccaaaatcaagaagaatctgcccgtgacgggccctcaggcgccga

SEQ ID NO: 15869 - DNA, 201 bp, Homo sapiens
ctctaagggcgcatggactggtgtttcccagactgtggtctccagggacacactagccggctagtgcctgccagctcacctgcttctcttctttgcccctscagcacgcccgtcctcagagtcccgtcctcaaagtcccatcctcgccatggcacccggagagaagatcaaagccaaaatcaagaagaatctgcccgtgac

SEQ ID NO: 15870 - DNA, 201 bp, Homo sapiens
agctgatggggctgcttccagagttcctgcccaggaacccggggaaaggtcctgcagcctgtccagccagcgcttcgcaggttgcacctcacccagccccygcacggctaggcctgggggccgtaagagaagtaggcagcttctctggcagctgtggtggccaaaaacaaacgtcccgtggaaaaggggccaaggattcag

SEQ ID NO: 15871 - DNA, 201 bp, Homo sapiens
catgatctaaggtggctgccgggaaattttcttggcagatttcatctgtcagttacaatctgccgagcactgctctgtgccagacactgtgctaggaaccrgggggcataatgagataggaatgctgcccttgaggaaggcgggctactggaggtgataaggcacgggtacccctgcctgataagagagctgatggggctg

SEQ ID NO: 15872 - DNA, 201 bp, Homo sapiens
acctctctgagcccatttttctcctctgtaacatggatataataatagcatgcctacttcatggaattattgaaacacaaaaggaaatatatgtaggctaygtgtatatttatagagagagacaaatttacttatgagactaatgagactatatattataaacatgaaatgagtttttatgtagtatattagttcatttct

SEQ ID NO: 15873 - DNA, 201 bp, Homo sapiens
gcccatatttcatgggttcagggtgggaaaaaaagacataactctgcaggttccgaatactgcctaaaaatcttgatggggcacatcgaagtcacagacaygggtcctctctggtcctggggaccaccctgtatgccctaggatatgtcctaatttgcctttgtcactgtagaaggcataggacgacacagttttcatata

SEQ ID NO: 15874 - DNA, 201 bp, Homo sapiens
ccagcttccaattttagcccatatttcatgggttcagggtgggaaaaaaagacataactctgcaggttccgaatactgcctaaaaatcttgatggggcacrtcgaagtcacagacatgggtcctctctggtcctggggaccaccctgtatgccctaggatatgtcctaatttgcctttgtcactgtagaaggcataggacg

SEQ ID NO: 15875 - DNA, 201 bp, Homo sapiens
tccagtttccctaccctatttcattaaacaccatccagatttatccaaaatatcttgtttatttatttgcttgctgaccatttgtttaccccactggaagstatgttccaggagagcagggaacttatctatcttgatcattgctgatttcagtgtctaccacagtaccaggcacctaataggttctcactaacttttcat

SEQ ID NO: 15876 - DNA, 201 bp, Homo sapiens
tatcaatctatggagggtttagagcagtttgtctgctctggacatctcacctccatgcccagcactccatttcctttccatctgaggccttaaacccactmgcatcataagcttggaagcctcctagctttgccccagcttccaattttagcccatatttcatgggttcagggtgggaaaaaaagacataactctgcaggt

SEQ ID NO: 15877 - DNA, 201 bp, Homo sapiens
ccttaatatccccaattaaacttcctagcttttatccttcacaaacatatcctccagagaagtggtttccaaacctggttgattatcagactcaaagccaytgaatcagaatctctagaagatgagcccaaggatctatatttttaccaagttgtagtggttattctaagaggcagcacccttgggagtcttggcttgacc

SEQ ID NO: 15878 - DNA, 201 bp, Homo sapiens
ggaacatctacaacgctgcctactcgctccaggtaacagattggcgggggcacccagccctgggtttatggcccggacccaggagacaaagttatatctargctggggtgtggcttgcaccaggaactctggtgaggatccctggggttcatccagagacctcaagaacaaatgatgccggctggttccagtcctctgcag

SEQ ID NO: 15879 - DNA, 201 bp, Homo sapiens
agtttccctaccctatttcattaaacaccatccagatttatccaaaatatcttgtttatttatttgcttgctgaccatttgtttaccccactggaagctaygttccaggagagcagggaacttatctatcttgatcattgctgatttcagtgtctaccacagtaccaggcacctaataggttctcactaacttttcattaa

SEQ ID NO: 15880 - DNA, 201 bp, Homo sapiens
ccacgctaagccaacaggtccctttttcggaaataccttccctaatcactctatgggaaaaactgcccatctgctcttaacgcctccagtttccctacccyatttcattaaacaccatccagatttatccaaaatatcttgtttatttatttgcttgctgaccatttgtttaccccactggaagctatgttccaggagagc

SEQ ID NO: 15881 - DNA, 201 bp, Homo sapiens
agcattcattagatgctatggacctggagttaaggagaaaaccttggggggtaattgtagacatggaaataaatgccatcacccaagacctgagacagaamcctaaacatgcaaatgtttaagggctgagcagaaagtaaaaggagaaagagaggcagataagtaggaacagaagccagaaagagttggcatcagataaat

SEQ ID NO: 15882 - DNA, 201 bp, Homo sapiens
tggaggacaccgtccctgtcctgagagagtctagagtccagcagagaggattgagtaataaaccagaaataatacaaatgattcattataattgccataastgctatgaagaagaaatgtaagaccatatgagtgcatattatgacacgactgacctggggctcattttcaatggggaagatgaggttcaaggaaggcttt

SEQ ID NO: 15883 - DNA, 201 bp, Homo sapiens
agctgggattacaggcatgcaccaccatgcttggctaagtttttgtatctttagtaaagactgggtttcaccatgttggtcaggctggtctcgaaccctcsacctcaggtggtccccctaccttggcctcccaaactgctgagattacaggcgtgagccaccgcacctggcctgaggggctcttgagaaatgccattcact

SEQ ID NO: 15884 - DNA, 201 bp, Homo sapiens
aatcatgccatgtgaactcacatttctctaagccatcactatctccctcatgcgcactgctgggcctgcctgccatgagagccaatctggccaatcttgcktccaacattcatagagcaccccctaggtgccaggtgctgtgtgaggtgctgggggaaccaggacaatcaagcagacatagtctctgtcccccgaggtact

SEQ ID NO: 15885 - DNA, 201 bp, Homo sapiens
gagtcttactctgtcacccaggctggagtgcagtggtgtgatctcagctcactgtaacttctgcctcctgggtttcagcaatcctcctgcctcagcctccyaagtagctgggattataggtgcgcaacatcacatctggctaattttatatttttagcagagatggggtttcaccatattggccaggctggtctcgaactc

SEQ ID NO: 15886 - DNA, 201 bp, Homo sapiens
aagcctggcttaaattatactttgcaactgaccaccttagtcaactccaggaggtaggaacggtggatattaccttttcacagaatagataaccaaggccsagaaaggctaagtggcttgcccaaggtcacacagccagaaaggaacagagctggatccaaaccaagggtggtctgaccttcaactcacatcctcaaccgc

SEQ ID NO: 15887 - DNA, 201 bp, Homo sapiens
ggacttttgggccaggcatggtagctcatgcctataatcccagcactttgggagacaaaggtaggaagatcacttgagcccaggagtttgagaccagcctkggcaacatagcaagaccttgcctctaaaaaaaaaaaatttgttttaattacctgggcatactggtgcacacctgtaatctcagctataagggaggctgag

SEQ ID NO: 15888 - DNA, 201 bp, Homo sapiens
tgacttttcaacacttaagtgagatgatctgttctgcctcctctcacattctgggaatttatagttcacctcctaccaggataccccagagagtccatgaraatcatcccagcagaacaaaaggaccagaaaccttcagcactgagtcttccaacttagataagagctgagctgagaggtggtgtagacactgagtaaaag

SEQ ID NO: 15889 - DNA, 201 bp, Homo sapiens
acagcatagtcttggacaagttccttaaccaatctgcatctcagtttccacatctgcgaaatgaggatgatgaaaatatacatacctgcctcatagggctgttggtagaattcaatgagttagttcacataaagttcttacgacagtgcttggcaacacaggaagtgccccataaatgcttgttgccattgtgcctattat

SEQ ID NO: 15890 - DNA, 201 bp, Homo sapiens
aagaattaccttgtggaggctgggggacaagttggggagcctgaggcgggaggctggccctagcctctcaggcaccctcaggcccacgctttctctctccrttgtagaagtggttgctgcctgttctcacttgggaccaaggccggcaagtaaacaaaaagctcaacaagtaagttacctctaccctgttcctctgtctct

SEQ ID NO: 15891 - DNA, 201 bp, Homo sapiens
taagtaggccttggcaagggaggaacaggaaagaagcggtctgggagagacactggctgaagggtcaagagcatggcttccgggcctgctggtgcccctckctggatgatggccttgggccagctgggttcccctcagcaaccacaaggggaggtgggattggatcaggggctgctaatttgcagctcccagtcgccttcc

SEQ ID NO: 15892 - DNA, 201 bp, Homo sapiens
aaacaattttcccacctcagcctcccaagtagcttggactacaagaatgcatcaccacacctggataatttttctattttttatggagatggggtttagcygtgttgcccgggctggtctcgaattcctggcctcaatcagtcttcccactacaaccttccaaagcattaggattacaggcatgagccactgcaaccagcc

SEQ ID NO: 15893 - DNA, 201 bp, Homo sapiens
aagctgagtgagccctacagtcagtgcacggaggacgggagtgacgtgccaatcaggaacatctacaacgctgcctactcgctccaggtaacagattggcrggggcacccagccctgggtttatggcccggacccaggagacaaagttatatctaggctggggtgtggcttgcaccaggaactctggtgaggatccctggg

SEQ ID NO: 15894 - DNA, 201 bp, Homo sapiens
ttacataaaaagatggtgggcaattagggcttggatatccgcctgtcatttatccattcaattgacattttctgagcaccttctatgtgctagacatgggrcacctcagtgtggaggacaccgtccctgtcctgagagagtctagagtccagcagagaggattgagtaataaaccagaaataatacaaatgattcattata

SEQ ID NO: 15895 - DNA, 201 bp, Homo sapiens
tccattcaattgacattttctgagcaccttctatgtgctagacatggggcacctcagtgtggaggacaccgtccctgtcctgagagagtctagagtccagsagagaggattgagtaataaaccagaaataatacaaatgattcattataattgccataagtgctatgaagaagaaatgtaagaccatatgagtgcatatta

SEQ ID NO: 15896 - DNA, 201 bp, Homo sapiens
aaattatattcctcttgcccagaggctactagcatcattttgatggtgttcttcatcccagcaaaatcatatcaatctatggagggtttagagcagtttgkctgctctggacatctcacctccatgcccagcactccatttcctttccatctgaggccttaaacccactagcatcataagcttggaagcctcctagctttg

SEQ ID NO: 15897 - DNA, 201 bp, Homo sapiens
tccagatgtcttgacttttgatatgataggaaatgggaaaggttgttaggaacgtagtagcatcaatcggatgaaacctaggtgcctagggaccctgaagagctggttttgcttcttccttggtgggcaagtagtgcagagttgcaggagtaggactctgtgtcctttctcactcagcccctttttggtccttgaggcttg

SEQ ID NO: 15898 - DNA, 201 bp, Homo sapiens
gcttccagaatcacagcttctgttgaacattcacagaggagggctgcagttttatttgacaagcaattgaacctggacctagattttaaaaacaaactctygctaatttttttctttctttccttcttctttatttcattttttatttttttggattgtagtgagggaggaggtaaggataggcaatattttaagtgataa

SEQ ID NO: 15899 - DNA, 201 bp, Homo sapiens
atagcgagaccccgtctctactaaaaatacaaaacttagccaggcatggtggtgcatgcctgtagtcccagctattcaggagactgaggcagaagaatcgyttgaacccgggaggcggaggttgcaataagccaagattgcactactgcactcaagcctgggctgcagagtgagactcttgtctcaaaaaaaaaaaaaaaa

SEQ ID NO: 15900 - DNA, 201 bp, Homo sapiens
gcgcacccgcacgagccttggaccctttggaaccgaaaggtgagttcagccgggttgggtcggaccagctcgggggttctgggcactggagcggatgccgrgcgccagggcgtcggacgccgtcagcgcggtgggtggccgagccagcatcagccggtggcggcttcccggtgcccgggatgctgggacaccttgcccggg

SEQ ID NO: 15901 - DNA, 201 bp, Homo sapiens
cattggggtcaaggtcggttctggggaaggggctgatggggcagaggtacccctgagagctggggataggagcttccagaatcacagcttctgttgaacaytcacagaggagggctgcagttttatttgacaagcaattgaacctggacctagattttaaaaacaaactctcgctaatttttttctttctttccttcttct

SEQ ID NO: 15902 - DNA, 201 bp, Homo sapiens
ttgggtcggaccagctcgggggttctgggcactggagcggatgccgggcgccagggcgtcggacgccgtcagcgcggtgggtggccgagccagcatcagcsggtggcggcttcccggtgcccgggatgctgggacaccttgcccgggcggtagcggccagctctcccgggtctacccacgccgtggcccggagcacgaagc

SEQ ID NO: 15903 - DNA, 201 bp, Homo sapiens
gccttggcaagggaggaacaggaaagaagcggtctgggagagacactggctgaagggtcaagagcatggcttccgggcctgctggtgcccctcgctggatratggccttgggccagctgggttcccctcagcaaccacaaggggaggtgggattggatcaggggctgctaatttgcagctcccagtcgccttccaggtggc

SEQ ID NO: 15904 - DNA, 201 bp, Homo sapiens
tgggtcggaccagctcgggggttctgggcactggagcggatgccgggcgccagggcgtcggacgccgtcagcgcggtgggtggccgagccagcatcagccrgtggcggcttcccggtgcccgggatgctgggacaccttgcccgggcggtagcggccagctctcccgggtctacccacgccgtggcccggagcacgaagcc

SEQ ID NO: 15905 - DNA, 201 bp, Homo sapiens
taatttttctattttttatggagatggggtttagccgtgttgcccgggctggtctcgaattcctggcctcaatcagtcttcccactacaaccttccaaagyattaggattacaggcatgagccactgcaaccagccaaaatcagttgacatctgtccatttagaaaagtttccaagctttgtgtgataagaacatttggaa

SEQ ID NO: 15906 - DNA, 201 bp, Homo sapiens
actatatattataaacatgaaatgagtttttatgtagtatattagttcatttctaaaattatttctcattgtaaagtttgtatagttgagatgcatcgtgyacattgatgaatgtgataatttgccttccaatactggtactctcccccaaagctgttattaaatcaagggcattctctaaattaatggtatcttagaatc

SEQ ID NO: 15907 - DNA, 201 bp, Homo sapiens
atatttcctgcaggataaacagtgggtgtagctaccccaataaatgaagcaggtgttctctggctcccacagttttcactacccctccagtatgtcacttmcatcactgtctcctgtagacatctgacttttcaacacttaagtgagatgatctgttctgcctcctctcacattctgggaatttatagttcacctcctacc

SEQ ID NO: 15908 - DNA, 201 bp, Homo sapiens; identical to SEQ ID NO: 2563

SEQ ID NO: 15909 - DNA, 201 bp, Homo sapiens
tggcatacctggtttttcaagagcctggatggtgttcgaaagtcaaggaatttcacaagaaaatccagattcccagcctctcgaaaaaatgaaacgatacrgcaacattgagcccatatttcctgcaggataaacagtgggtgtagctaccccaataaatgaagcaggtgttctctggctcccacagttttcactacccct

SEQ ID NO: 15910 - DNA, 201 bp, Homo sapiens
taatttgcagctcccagtcgccttccaggtggcatacctggtttttcaagagcctggatggtgttcgaaagtcaaggaatttcacaagaaaatccagattyccagcctctcgaaaaaatgaaacgatacggcaacattgagcccatatttcctgcaggataaacagtgggtgtagctaccccaataaatgaagcaggtgtt

SEQ ID NO: 15911 - DNA, 201 bp, Homo sapiens
gaaggtccattgagcccgggaggtagaggctgtagtgacccttgattgtgccactgcactccaccctgggtgacagagtgagaccctcatctctaaaaaamaaaagcaaaaaaaattattgaataaggattttgaattttgagtgacaatgctgtttacctcctctcatgatcagggtagcattctactctgttgagcttt

SEQ ID NO: 15912 - DNA, 201 bp, Homo sapiens
cagcagatgaaatgcaatacaaacagaaagggattataccagttgagatggctagtttccacctgcctcaaacctcttaattccttccccctctacccgtkttcattctttcttcaaagagaaaataattttcttccctcccacaaatctgccattctttttctctttacccccatctccccaaccaaaaaaataaaaaca

SEQ ID NO: 15913 - DNA, 201 bp, Homo sapiens
tacacccgggaggtggaggttgcagtgagctgagatcatgccactgcactccagcctgggcaacagagtgaggctccatctccaagaaaaaaaaaaaaaaagtccctcccaggtctgcacaggttcaagaagaaaaccatccacctgttccatccccagcctggccatccctgctgtcccctccctggcagaagcagcagc

SEQ ID NO: 15914 - DNA, 201 bp, Homo sapiens
tggcaagaactgtgacagtaatactgtgtttgaacccctgttttgggctaagctgtgggggcacagcagagagcaagtcaggcatgcattccaatctcacrgagcttccagtctagccctcgtccacctgtcacttgctagaaatacctggtcttgggtttgaagctcctgaagcagtgggagaggtggtttacccccagg

SEQ ID NO: 15915 - DNA, 201 bp, Homo sapiens
aatggggaagatgaggttcaaggaaggctttcctgaggaggtgctatttaagctgagacagcgagatgatgaaccggaatggaagtatgacagatgaaatstggggcttcactgcctcatggtgccccatgaaaaggacaacactggacaagggaaaccatcaaaatggtctttctgggcccccagatgctctcaggaggc

SEQ ID NO: 15916 - DNA, 201 bp, Homo sapiens
agcaatatgagagtagctatttccccacactctaaccaacataatgtattaatgtttaatctttgctaatctgtcaagagaaaaatggtatctgttatcattttaatttcattctttcataatgatgtttttcttttcttttcttttctttttttttttttttttttttttttgagacagagtgtcactctgtcacccagg

SEQ ID NO: 15917 - DNA, 201 bp, Homo sapiens
cagcaatatgagagtagctatttccccacactctaaccaacataatgtattaatgtttaatctttgctaatctgtcaagagaaaaatggtatctgttatcattttaatttcattctttcataatgatgtttttcttttcttttcttttctttttttttttttttttttttttttgagacagagtgtcactctgtcacccag

SEQ ID NO: 15918 - DNA, 201 bp, Homo sapiens
ccagcaatatgagagtagctatttccccacactctaaccaacataatgtattaatgtttaatctttgctaatctgtcaagagaaaaatggtatctgttatcattttaatttcattctttcataatgatgtttttcttttcttttcttttctttttttttttttttttttttttttgagacagagtgtcactctgtcaccca

SEQ ID NO: 15919 - DNA, 201 bp, Homo sapiens
ctggggttcatccagagacctcaagaacaaatgatgccggctggttccagtcctctgcagttcgtctgtaaccagagcttaattgatacaccgaggtttcygtggaactcaatgtacagctgagacagacccacctcctaagtaggccttggcaagggaggaacaggaaagaagcggtctgggagagacactggctgaagg

SEQ ID NO: 15920 - DNA, 201 bp, Homo sapiens
ccgggaccatgcccagcccagttggcataaggggcaggttcatgtggttggccaaggttaagggaggctgaccccctgggctgagggatgtgcaggaaacyccctgacatccctgagcaaagacatgaatggcattcctgggtctcctctttcagatctgccttcattcatgcttccagacaaagatggtggagaaatgtg

SEQ ID NO: 15921 - DNA, 201 bp, Homo sapiens
tgaggcagaaaacaattcagccataacacataccaagcacacaataagtgctagttgctattgttattactgctattattaccgttactagcattgctacsagtctaccaccattgctgctgctgctactaccctcaaaataataccactgcaatttccagcactactattccactatgattacatttctagggaaggtag

SEQ ID NO: 15922 - DNA, 201 bp, Homo sapiens
ggtgccttggacagtagacatttatttatcacagttttggagactagaaagtctaagatcaaggcacaggcagactcggttctggtgaggcttctctcttwgggttgcagaaggctggctgtcttctctccatgtcctcagatggcctttcctctgtggtgtgtcaacagagagaggcctgtgatgtctcttcctcttctg

SEQ ID NO: 15923 - DNA, 201 bp, Homo sapiens
agaccattctcagcacctccatggggggcagcgaatatggtaaggaaacctgtgccaaggagatcttgaggccctccaatagtggacatgggggcagcagsacagtggggatgcgggagccctctggaaaagcgggatctctcccacttggccagaaaccagggatgcccctttttctatcagtgtttccatcagtgttca

SEQ ID NO: 15924 - DNA, 201 bp, Homo sapiens; identical to SEQ ID NO: 2564

SEQ ID NO: 15925 - DNA, 201 bp, Homo sapiens; identical to SEQ ID NO: 2565

SEQ ID NO: 15926 - DNA, 201 bp, Homo sapiens; identical to SEQ ID NO: 2568

SEQ ID NO: 15927 - DNA, 201 bp, Homo sapiens; identical to SEQ ID NO: 2569

SEQ ID NO: 15928 - DNA, 201 bp, Homo sapiens; identical to SEQ ID NO: 2553

SEQ ID NO: 15929 - DNA, 201 bp, Homo sapiens; identical to SEQ ID NO: 2554

SEQ ID NO: 15930 - DNA, 201 bp, Homo sapiens; identical to SEQ ID NO: 2556

SEQ ID NO: 15931 - DNA, 201 bp, Homo sapiens; identical to SEQ ID NO: 2557

SEQ ID NO: 15932 - DNA, 201 bp, Homo sapiens; identical to SEQ ID NO: 2559

SEQ ID NO: 15933 - DNA, 201 bp, Homo sapiens
aaagcagcctagattctcccaccggatcccgctgctgatctttgatcaggatgagaagggcaaggccagggacttcttcacagggaggaagcggaaagtcrgcggtagcatcattcacaaggcttcaaatgtcatgcacatcgagtccaagcaagtggtgggattccaactggtaagatttcaccttctcattctttcact

SEQ ID NO: 15934 - DNA, 201 bp, Homo sapiens
gagaatctctcactcaaacaaagtcttacccagaaatgtacacaatggaaacagaaatgcaggatgaatgtagctgagcctgggaaaccagcctgcttacygcccaccccgctgtgatgggccctaaaacagggtgcagacagaacagaatttgcaaacctctaagctgtggcaagacaggcaatctttctgagaaggtga

SEQ ID NO: 15935 - DNA, 201 bp, Homo sapiens; identical to SEQ ID NO: 2561

SEQ ID NO: 15936 - DNA, 201 bp, Homo sapiens
gagatttcaaagtcttcttgggtcctttcatgggatatctgcaaggctcttcttgataccaaaatcaactctttatatagatgtttgtttgtttgttttaraaacaagatttcactctgtcactcaggtgggagtggtgcaatcatagctcactgcagcctagaactcctgggctcaaacaattttcccacctcagcctcc

SEQ ID NO: 15937 - DNA, 201 bp, Homo sapiens
ggctctgctgccatctgggctttcccccttagcactgtttataccttaaagaatgagcttgctgggtgcagcgccccatacctataatcctagcactttgrgaggctgaggtgggaagattacctgagcccaggaggtcaaggctgccatgagccatgattgcaccattgcactccagcctgggtgacagatcgagaccct

SEQ ID NO: 15938 - DNA, 201 bp, Homo sapiens
acgactgtacttcagcctgggtgagagaacaagaccctgtctttaaaaataaaaaaagtgagctcatcagaaagatacttctggatgacatttagtgagarctaccatgcacacacacaccttacatgtatcaattcatttcatgctcacaacttcatgaagttgatattattataaagaaagcaaagcatctgagaggtt

SEQ ID NO: 15939 - DNA, 201 bp, Homo sapiens
ctgcctcaaacctcttaattccttccccctctacccgttttcattctttcttcaaagagaaaataattttcttccctcccacaaatctgccattctttttstctttacccccatctccccaaccaaaaaaataaaaacaattatacatgggcacgtggatgcacacagcacacaaacacacagttgtaataaactggtcac

SEQ ID NO: 15940 - DNA, 201 bp, Homo sapiens; identical to SEQ ID NO: 2562

SEQ ID NO: 15941 - DNA, 201 bp, Homo sapiens
gctcacaacttcatgaagttgatattattataaagaaagcaaagcatctgagaggttaagtaacttgcatgatgccaaacagcagaaaaatagcaaagatkggatttgacctgagtagcctgccttcaggaactctgccattagcttttatgctataagctccatggatattgtggtagcttatgatccatgaagatccaa

SEQ ID NO: 15942 - DNA, 201 bp, Homo sapiens
atgtgacgtgtatttgcccagttacttcctagaagtttgtcaaacaggacatgtgtttgccagattgtcccccaatgaggatatagcaattgagaaccacmccagcaatatgagagtagctatttccccacactctaaccaacataatgtattaatgtttaatctttgctaatctgtcaagagaaaaatggtatctgttat

SEQ ID NO: 15943 - DNA, 201 bp, Homo sapiens
caatgtgacgtgtatttgcccagttacttcctagaagtttgtcaaacaggacatgtgtttgccagattgtcccccaatgaggatatagcaattgagaaccmcaccagcaatatgagagtagctatttccccacactctaaccaacataatgtattaatgtttaatctttgctaatctgtcaagagaaaaatggtatctgtt

SEQ ID NO: 15944 - DNA, 201 bp, Homo sapiens
tcaaaagtggaggaatttggggacagacatggcacaaagaatgtcaagtcaggatagagatgaaggtgagaagattccgagagaaaacagaaggcagagagtctagttctatgtccatgtgtgtcaaccaggatgaggggccttgtttgtcatttgatcaggagcaagatggggaaaatgagtcacatctctcacacattc

SEQ ID NO: 15945 - DNA, 201 bp, Homo sapiens
ttcaaaagtggaggaatttggggacagacatggcacaaagaatgtcaagtcaggatagagatgaaggtgagaagattccgagagaaaacagaaggcagagagtctagttctatgtccatgtgtgtcaaccaggatgaggggccttgtttgtcatttgatcaggagcaagatggggaaaatgagtcacatctctcacacatt

SEQ ID NO: 15946 - DNA, 201 bp, Homo sapiens
aaatgatgccggctggttccagtcctctgcagttcgtctgtaaccagagcttaattgatacaccgaggtttccgtggaactcaatgtacagctgagacagrcccacctcctaagtaggccttggcaagggaggaacaggaaagaagcggtctgggagagacactggctgaagggtcaagagcatggcttccgggcctgctg

SEQ ID NO: 15947 - DNA, 201 bp, Homo sapiens
aggttgaggctgcagtgagccataattgcgccactgcacttcagcctgggcaaaagagcaagaccctatctcagaaataaaaatacaatacaatacaatamaataaaacactaagcctctttcacctatctgtatatgttagcagacagattggttcttgtgaaaagtaaataactggaatcatgtctccctaagagttgg

SEQ ID NO: 15948 - DNA, 201 bp, Homo sapiens
aatcaactctttatatagatgtttgtttgtttgttttagaaacaagatttcactctgtcactcaggtgggagtggtgcaatcatagctcactgcagcctakaactcctgggctcaaacaattttcccacctcagcctcccaagtagcttggactacaagaatgcatcaccacacctggataatttttctattttttatgga

SEQ ID NO: 15949 - DNA, 201 bp, Homo sapiens
gaggccttaaacccactagcatcataagcttggaagcctcctagctttgccccagcttccaattttagcccatatttcatgggttcagggtgggaaaaaaagacataactctgcaggttccgaatactgcctaaaaatcttgatggggcacatcgaagtcacagacatgggtcctctctggtcctggggaccaccctgtat

SEQ ID NO: 15950 - DNA, 201 bp, Homo sapiens
tagctacagtcttgttttgctttgaagttgaaatattatttatatgaatattttatctgttttgcaaagagcaagatcagttcccttccttcacttgggggctcctctgacattgtcgactgatccattggggtcaaggtcggttctggggaaggggctgatggggcagaggtacccctgagagctggggataggagcttc

SEQ ID NO: 15951 - DNA, 201 bp, Homo sapiens
atttcaccttctcattctttcactgcttaggggcatgggatgggctgggtccaggactcttctccttgaccactagcccctgtggtccaactggaagaaayacacccagctggggtcagacacagtgactcatgcttgtaatcccagcgctttgggaggccaaggcgggcgaatcacctgaggtcaggagttcgagaccag

SEQ ID NO: 15952 - DNA, 201 bp, Homo sapiens; identical to SEQ ID NO: 2567

SEQ ID NO: 15953 - DNA, 201 bp, Homo sapiens
ctagaaactgtggtcttaagttctagtattttcctccttcccattcaatttttaagtaataaaatcaaacacaagctagcagtcagtactatgcagttatycccgtttacattatattattttccatttctctttaagagaaacttatagctgaaaggatatgaaaattgtgaacaaaaccatagtgacagatcaagtaga

SEQ ID NO: 15954 - DNA, 201 bp, Homo sapiens
ttctggtagttctctgaagaactttattcagttctgttgatcagtaaagctgtgaggccagatgcaaattctggtcatctgtatgacagtgtagtagtctmcccttctccgtggttttgctttcacttacccatagtcaatcctggtccaaaaagattaaatgggaagttccatacgtaaacaattcttaagttttaaatt

SEQ ID NO: 15955 - DNA, 201 bp, Homo sapiens
gatactggaatgagttatctatgctttcatggagctaacaatgtgatttgacttctcatcacatcctatttgactcctgtcattttaaatgataaagtaarccttagcgatgcatatcagatagtttttggcaattgttcaatacaaatgtcaggaaatttcaaagttagctttcactgaaaaccattatctaaccacatt

SEQ ID NO: 15956 - DNA, 201 bp, Homo sapiens
gctggactgtactgctgccatctcggctcactgcaacctccctgcctgattctcctgcctcagcctgctgagtgcctgggattgcaggcgcgtgccgccaygcctgactggttttcgtattttggtggagacggggtttcgctgtgttggccgggctggtctccagctcctaaccgcgagtgatctgccagcctcggcctc

SEQ ID NO: 15957 - DNA, 201 bp, Homo sapiens
cagtataatatggctggggtcaggacagaagattcggtaagatattttgaagatgggatggaggtagaatccacaccaacagttgctggacagtttgaggytgcagatgttgatcactgaaaatgatttatgcaggtataagattctgctcctaattgtaggagagaacttggtgcctcttccactctgaagcaaagttga

SEQ ID NO: 15958 - DNA, 201 bp, Homo sapiens
ccattctcccatccaggctcagtcacctttcccggttgccttgatccaaggcctgatatgggatatccaggaagagtcgacggtcacagagaaggccgtgccaatgggcagaggtctgggaggtaaggcggaagtgaaagtctaactgtactgggtcctggtggagcagggggtcagtagccagcaccgtcaagttcccag

SEQ ID NO: 15959 - DNA, 201 bp, Homo sapiens
tatgagaatagtgtggtgagttgccatagggacagggctggggtttaatgaaaagaaggcatatctttttcattgtactcttcctttccctgtggagcaaytacttttctttcttcctcctgcaattctgtttatgagcctaccactttgtaactctctgcctttctcctcctccccacatacagcctgaagacttgactg

SEQ ID NO: 15960 - DNA, 201 bp, Homo sapiens
agggtataagccccacccctatcagcagtaacccctacaatcttttgccaggtgaccagtgggaagaggaagctttggatgagtttgatagactcactcaytgtgctgactggaagcctctggtagccaagatctctagctatgtccagactgggatctcaacttggccaaagatctacttatatgatactagcaatggga

SEQ ID NO: 15961 - DNA, 201 bp, Homo sapiens
gataaactagaaaatttaaaactagcacataaggatgccttacacaggtcttttttttaaatttagggattagtaacgtctacctctatactacatggcarctatattttctcacaaccacaattctcaaaatttattttctcagaaaaatctcagtattagccaggcaccggtggctcacacctataatcccaacacttt

SEQ ID NO: 15962 - DNA, 201 bp, Homo sapiens
cttttctcattcagtctttccagagtagggaggttaattgaaggcttggttcctagtcaggtcattgagtaccaagaggtccatttttcttttgagcctcrctggcattgcctgctagaatagggcagtgtctaactttctccttcttatttatcttcaatagaagctgcttccatgtctggtgatgataaccttgaagat

SEQ ID NO: 15963 - DNA, 201 bp, Homo sapiens
ccagctatttctctgtaacctttagttaaaatataagtagaaaggagacaggaggctcaggaaattttctaaattgctagtataatatctatatgtatacmcacatatacacccgtggagagagaggaagagtatacagtcctgtttgaatcatttggaggatttttttgctgaataaagttctcaagaaaattttctaaa

SEQ ID NO: 15964 - DNA, 201 bp, Homo sapiens
gcgttctttcagcaaatatttattgctcatcacctgccaggtattgtgatggaagctagtgcggaagatcccccaatgaccaggatcgcccgacccctgtycccagggtgagcccctagcgcggagcggggacagggtggaccgagtagggcgcagtgctggtctcgcgaggctccctgccccacggaggcagtagcagga

SEQ ID NO: 15965 - DNA, 201 bp, Homo sapiens
aaccaagaggatatttgtagtttattatttaccccaaactttctgtgtctgggtaccctctgagtaggcctataattcctgccttcactgtatgcattttmtgtaagctagcagacctatgtggtgagaatgcacaggagcttggaggtataaatagacagggtgggaaagagagagctcctttcgccatgttttaccagc

SEQ ID NO: 15966 - DNA, 201 bp, Homo sapiens
cagagatgcccatgtttgaaagtatgtaacaaagagggagcccattaatcattgaagatagaaatactggcttagatattggagagattagaaggaatgcyttctcagtctgagcagccagtataatatggctggggtcaggacagaagattcggtaagatattttgaagatgggatggaggtagaatccacaccaacagt

SEQ ID NO: 15967 - DNA, 201 bp, Homo sapiens
ctgcctgtcaagatcttccttgccagacaggaaactccatgaaggcagctgccaaatctatcttgactgttgtgtcccgagggtcaagcacacatcagaaytcgatatttattggcttgaataaatgtccatttagtgcagttcattcatgtagtataggtttgcggaagaaaagtgagttgtattttaatgagatgattt

SEQ ID NO: 15968 - DNA, 201 bp, Homo sapiens
atgattttcaactatacaccatctaagaaataaaccttaaggttctagctactttcaactgtcgcattgaccaagaatttatacagttgtccctcccttcrttatttgcaggggattggttccaggaaccctgcagaacccaaatccatagatgctcatgtcccttgtataagatgcatattatttgtatataacctacac

SEQ ID NO: 15969 - DNA, 201 bp, Homo sapiens
gtaactgtatctgaggaagatgctccagtcacccgcttacgccacaacggacccggtgcgggagcgtttgtgtttgccctgagtcagttcagactcttccrctgggcctttttgagactgagagctgccatccgtatatcactttgcctttaactttccccagctttttctttagttatcgctaataggatggctgtttac

SEQ ID NO: 15970 - DNA, 201 bp, Homo sapiens
tagcatctagcacatagtacttactccagctcttgtgttgagaataaactgaatggacaatggcaaaggcaggaacgtaattaagcaatgcagtaatctarggaaaagataatggtgttttagagcagggtcatagaactgcaaagagaaaaagtggtcagattctggatgatttgaaggtagagcaaataagatttgttg

SEQ ID NO: 15971 - DNA, 201 bp, Homo sapiens
aggaacgtaattaagcaatgcagtaatctagggaaaagataatggtgttttagagcagggtcatagaactgcaaagagaaaaagtggtcagattctggatratttgaaggtagagcaaataagatttgttgacaggctaggtgtgcagtgtgagagagaggatgactaagggagtaagagaatgcagtcgaggcagagcac

SEQ ID NO: 15972 - DNA, 201 bp, Homo sapiens
ccatagggtggtgagctgttggcagttgtcagggggatttggaagggaacctgtttacagagagcagatggttatcgtctcatgttagttggttctttctkaaagcagcaatgtaagaagatgtttttggccccaggattctaattttagtttcttttacttcaggagtgacttcctaagccttccatttcaagcaataga

SEQ ID NO: 15973 - DNA, 201 bp, Homo sapiens
atgccacttttccttgttgttatggttgagatcctcactttatctcttggatcagtgtctctttgacagccagattctggggaggactggtagttatactrgctttgggtgttatctaagtctgatctgatgaacaatgatctgtgcagaagagcggctgacatttgttggggaagatgacattgagatagagatgcgggt

SEQ ID NO: 15974 - DNA, 201 bp, Homo sapiens
agatctacttatatgatactagcaatgggaaggtaagactggcattcactcactgcttgccatatcttcagtatatttatagcctaatttactttttcttyctcagaaacccttatctgatattactcttactgtaagatccttctcaccatctcaccaaaggaatgtctttaaagtatcagtccttctgccttgtttcct

SEQ ID NO: 15975 - DNA, 201 bp, Homo sapiens
aacagttctggtgagtagttcaggtactcttggaggaatctttaaggagcttccatttatttgatgtttcagatgttgcctgcaatgaactcgctgaagcrtgctcagccctggaactggtgctaccagagttccgtagggaacctttactctttagaggttccctgatataaatcattcataagacttcctaccctggaa

SEQ ID NO: 15976 - DNA, 201 bp, Homo sapiens
ttcagtatatttatagcctaatttactttttcttcctcagaaacccttatctgatattactcttactgtaagatccttctcaccatctcaccaaaggaatrtctttaaagtatcagtccttctgccttgtttcctcaaatttgcccttgcttactgagagaacatcattcccttttcatttttcttctcagaaacttgata

SEQ ID NO: 15977 - DNA, 201 bp, Homo sapiens
tagtctggcttgctgtggaccaaattaatattctcctcccatcagactacaaaaaaattggactaccacgctacaagtgtgtctcccccattccacctcckgatccctccccaaccctccagtgtttgaatactgctgtgttacttccaggccgttcaacgtcaggctcagtcccctctaccagtcatgattcacattact

SEQ ID NO: 15978 - DNA, 201 bp, Homo sapiens
tgactctggttaaggaaagcttttgagtggtgaactcaaagactccagttgaatcaggaggcaaaggcaaaaattagcataattatatttaaaagcctcargaagtgggaagagaatactgcctcccagcctcaattgctgatatgttattggagacaggcttttgaaactgctccagctatttctctgtaacctttagtt

SEQ ID NO: 15979 - DNA, 201 bp, Homo sapiens
gtatcatcgtgggggttggctggagacccctatttcaaagactgacttttagaccctttccttgttttgagagaaaggggttgacacttttttttttctcstgaatttaaaataaacgtaccaaggatgagaacattgagctgcttcgattcaagcatgtcaccatgttgtaggttctttgtaggttctggttattaggag

SEQ ID NO: 15980 - DNA, 201 bp, Homo sapiens
actgtccatgtaaagattgctgtccatatacctttttactgatccatgctgtagctagcatatggaggtttaccttctgtataattggtgaccgatttgamtatgtagcacatgacaaagaatgtaagctgttattactcagttacatggaaaggtacaaaggatagcttagtatctttctttaggatattcttgtttgat

SEQ ID NO: 15981 - DNA, 201 bp, Homo sapiens
tttttaaaccccttgagacaaattctcgctctgttgcccagggtggagtgcagtggtgtcatcagtttactgcagcttccacctcctgggctcaagccatytcccacctcggcctcctgagtagctggaactacaggtgtgcaacaccacgcctagctaatttttttttttttttttttttttttttttttgtagaaacag

SEQ ID NO: 15982 - DNA, 201 bp, Homo sapiens
aagcagtcctcctaccttagcctctcaaagtgctgggattaacaggcatgagccactgtgcccagcctgttttggtgtttatgtttcctagactatgaatrtttccaagtagaaattcttcttcctccttctgtccccaacgtgctcagcacacaagaaagagctagcactatttaaccaagatgcattaataatggaaac

SEQ ID NO: 15983 - DNA, 201 bp, Homo sapiens
ctcctgggttcaagtgattctcctgcctcagcctcccgagtagctgggattacaggcacccgccaccacgcccagcgaatttttggtatttttagtggagmcgaggtttcgtcatgttggccaggctgatctcgaactcctgacctcaggtgatccgcctgcctcggcctcccagagtgctgggattacaggtgtgagcca

SEQ ID NO: 15984 - DNA, 201 bp, Homo sapiens
caggcttttgaaactgctccagctatttctctgtaacctttagttaaaatataagtagaaaggagacaggaggctcaggaaattttctaaattgctagtawaatatctatatgtatacacacatatacacccgtggagagagaggaagagtatacagtcctgtttgaatcatttggaggatttttttgctgaataaagttc

SEQ ID NO: 15985 - DNA, 201 bp, Homo sapiens
aagccagcttgctttgttctactagattgtaatatctggaaatacagatatttagttttcagttttttatcacctatctttagttttttagtcttcagtgyttttttaaccacctacagtactttctaccagtattaattttgaattgaatatgttgatcaaaataaagaataaaaatacaggtgctgttaccctaagagc

SEQ ID NO: 15986 - DNA, 201 bp, Homo sapiens
ggtgattgtcagcatggtataacttgaattatcctttttttttttttttttgagacagagtctggctctgtcacccaggctggaatgcagtggcatgatcytggctcactgcaagctccgcctcccatgttcacatcattctcctgcctcagcctcccaagtagctgggactacaggtgcccgccaccactcccagctaat

SEQ ID NO: 15987 - DNA, 201 bp, Homo sapiens
tatgttattggagacaggcttttgaaactgctccagctatttctctgtaacctttagttaaaatataagtagaaaggagacaggaggctcaggaaattttytaaattgctagtataatatctatatgtatacacacatatacacccgtggagagagaggaagagtatacagtcctgtttgaatcatttggaggattttttt

SEQ ID NO: 15988 - DNA, 201 bp, Homo sapiens
agcctgtccaccattcagaaaatagccctgggccttgggatcccagccagtgcaacagttgcctatatcctataccgcaggtatagggaaagcagaggtasgtgaaccctatgactgtgtgtgtgaaaatgttcagacatgctcctgccttgttaaattgaaaaaaactctttccttgccaggtattgtgtgtgttttgtt

SEQ ID NO: 15989 - DNA, 201 bp, Homo sapiens
cccaggaggctgtgaaactcatcattggccggcaaggagccaatattaaacaggtaagtgtgtgagtaggcagtctgctttcccaaggattgattctgttyattgatttcttgtttccttccactgaccccatatcacaaaacattcacatgctctgtgtgtgtgtgtatgtgtgtgtgtatatataaaatatatatatat

SEQ ID NO: 15990 - DNA, 201 bp, Homo sapiens
attgcctttttcattactgtttttaaaaatcatcactattgaaaaggctgtgagctttctcttctgtacataggttttggcgtgggcaaagaggacctggrttcccaagaagctcacagacttgtccagggtcatgtaaagagtcagtggtagaatgggatctggaacaggtccatgtccgtcactgtccatgtaaagatt

SEQ ID NO: 15991 - DNA, 201 bp, Homo sapiens; identical to SEQ ID NO: 2606

SEQ ID NO: 15992 - DNA, 201 bp, Homo sapiens
ataccccagtgtctgagcagctttcagttccccagagatctgtgggcagaatcataggtaccactggatggcttcctctattgtttcctttattctttacytttgcccctctttcacaccttcccagggttttttctggcctagttccccttcaccatgtgaggggaaaaaaagggacattgagaccagaggtttactgtt

SEQ ID NO: 15993 - DNA, 201 bp, Homo sapiens
aattctcagccagattttatattgcctttttcattactgtttttaaaaatcatcactattgaaaaggctgtgagctttctcttctgtacataggttttggygtgggcaaagaggacctggattcccaagaagctcacagacttgtccagggtcatgtaaagagtcagtggtagaatgggatctggaacaggtccatgtccg

SEQ ID NO: 15994 - DNA, 201 bp, Homo sapiens
agtcttcctctgtctcccaggctggagtgcaatggtgcattctcggctcactgcaacctccgcctcccaggttcgagtgattctcatgcctcagcctcccragtagatgagaccacaggtgcacaccaccacatccgactgatttttgtattttttagtagagatggggtttcaccatgttggacaggctggactcgaact

SEQ ID NO: 15995 - DNA, 201 bp, Homo sapiens
caaattcatttgtaatgtttgaagaggagttagtgaaatttaccttttgcttcaaatagaagtcggccaaaaccgcacctataatctcagctacgccggaygactgcgggagttcaaggctgcagtgagctattatcattcactgcattccatcctgggtgacagaccaaggctctgtctctaaataaacaacaacaaact

SEQ ID NO: 15996 - DNA, 201 bp, Homo sapiens
tgttataacctcttaggttatattctttaatttccaaccttttaggttagtttctgtaacagaacaaatgagtctgggataaagtcctcaaagtacttcaratggtaattgttttgtttttgtaacggcttaacaaataacctaggttttctgtttaaaaaaaaaagaaatactggcttagggcatggtggcgcaacctgt

SEQ ID NO: 15997 - DNA, 201 bp, Homo sapiens
catgtaaagagtcagtggtagaatgggatctggaacaggtccatgtccgtcactgtccatgtaaagattgctgtccatatacctttttactgatccatgcygtagctagcatatggaggtttaccttctgtataattggtgaccgatttgactatgtagcacatgacaaagaatgtaagctgttattactcagttacatgg

SEQ ID NO: 15998 - DNA, 201 bp, Homo sapiens
cactgtatgcattttatgtaagctagcagacctatgtggtgagaatgcacaggagcttggaggtataaatagacagggtgggaaagagagagctcctttcrccatgttttaccagcccgctctgttataacctcttaggttatattctttaatttccaaccttttaggttagtttctgtaacagaacaaatgagtctggga

SEQ ID NO: 15999 - DNA, 201 bp, Homo sapiens; identical to SEQ ID NO: 2607

SEQ ID NO: 16000 - DNA, 201 bp, Homo sapiens
tggccatcaaaacagacttatttctattgcacactgtattgtgtagaaatgactaatgagctgtgtgatcttagatcaatccttttctatcccttagccgyagtttcccaaattgcaacgttattaatggaatcaaataagttctgtagtcccttctagttataaaatcttgtgatttctatgccccataagcatcaatta

SEQ ID NO: 16001 - DNA, 201 bp, Homo sapiens
atcatgaggtcagcagttcgagaccatcctggccaatatggtgaaaccctgtctctactaaaaatacataaattagctgggcatggtggcaggtgcctgtmgtcccagctactcattaggctgaggcagaagaatcgcttgaacccgggaggcagaggttgcagtgagctgagatcgtgccactgcactccagcctgggca

SEQ ID NO: 16002 - DNA, 201 bp, Homo sapiens
atcttgatagtgtcagaactggaaaacaaaagtgctgctagtcctttgggcctctgtaaagaggtgtgattatgactggccatcaaaacagacttatttcyattgcacactgtattgtgtagaaatgactaatgagctgtgtgatcttagatcaatccttttctatcccttagccgcagtttcccaaattgcaacgttatt

SEQ ID NO: 16003 - DNA, 201 bp, Homo sapiens
gctgaaatgggagaatcacatgagcccaggaagtcgaggctacagtgagctgggattgcaccgttgcactccagcctgggtgacagtgagatcctgtctcaaaaaaaaaaaaaaaaaattaactatttttttaaaaagaaatactggcttagattacccaaaataggaagcaataaaaagtcttttttcatgaatacactt

SEQ ID NO: 16004 - DNA, 201 bp, Homo sapiens
acctgtaatctcagcactttggaaggctgaggttggtggatcacttgagcccaggagtttgagaccagcctgggcaacatggtgaaaccctttctctacaraaaatacaaaaattagccgggcatggtggcatgcacctgtagtctcagctactgggaggctgagagatgggaggattgcttgagtccagaggttgtggct

SEQ ID NO: 16005 - DNA, 201 bp, Homo sapiens
gatatactgaattcactgagtaactaatgacccaaaatagacgacacccttgaaaagaggtacccatcccccacctcgggtagtaaaaggccgttttattwtttgctcaggcttttgagtccgggcaagaaggtggattaaatttgtttaaaaccaggatatagaaaaaatagatttggcaaacttctggtagttctctga

SEQ ID NO: 16006 - DNA, 201 bp, Homo sapiens
tcggtcccagctgctggagcgcagattttcctccaagggttagaagatagaaaactcctcggtaattggcctagaggtggtctgcgaggacgccgggaagyttgtaattggctgtttaattctcagcaggtgcggtctcagttaacaacatctgcttttcctggatcttattggctgacagggtgggcctgctttggattc

SEQ ID NO: 16007 - DNA, 201 bp, Homo sapiens
agaagggtgaaatcccctacctattccctccccattctcccatccaggctcagtcacctttcccggttgccttgatccaaggcctgatatgggatatccargaagagtcgacggtcacagagaaggccgtgccaatgggcagaggtctgggaggtaaggcggaagtgaaagtctaactgtactgggtcctggtggagcagg

SEQ ID NO: 16008 - DNA, 201 bp, Homo sapiens
tccgggcaagaaggtggattaaatttgtttaaaaccaggatatagaaaaaatagatttggcaaacttctggtagttctctgaagaactttattcagttctrttgatcagtaaagctgtgaggccagatgcaaattctggtcatctgtatgacagtgtagtagtctacccttctccgtggttttgctttcacttacccatag

SEQ ID NO: 16009 - DNA, 201 bp, Homo sapiens
aaatcaaacacaagctagcagtcagtactatgcagttatccccgtttacattatattattttccatttctctttaagagaaacttatagctgaaaggataygaaaattgtgaacaaaaccatagtgacagatcaagtagagtctcattttttgagacatcagctgataactcaattagcacaaattcatttgtaatgtttg

SEQ ID NO: 16010 - DNA, 201 bp, Homo sapiens
cgctcccttcctcgcccccacagaaacgccccccgccaccaccccctcccccggcgtaggccttcacgctgtcgcctcgacccgtttcctcgaatccccarggaagggtgggcccctggcgcccctatggcccgccgcccccttaccaccgcggtcggagcccgggtctcactctcctgccgctgtttcgggccacaccgt

SEQ ID NO: 16011 - DNA, 201 bp, Homo sapiens
ctatgttcacctgcagccgggcatgagcctggagggcccggctcagccccagtacagccccgtgcaggccacgtttgaggttcttgatttcatcacgcacmtctatgctggcgccgacgtccacaggcacttggacgtcagaatcctactgaccaatatccgaaccaagagcacctttctccctcccctgcccacctcagt

SEQ ID NO: 16012 - DNA, 201 bp, Homo sapiens
ctgcgcatgcgcgatgcttcgccctgccccacctctcggtcgcggattggcgggcgcgggtcacgtgggcacgccacccgcttcctcgccgcagggggccmgcccgctggcccgtttccggtccggtgggtacaagatgacggagccgggcgcctctcccgaggacccttgggtcaaggcaagccccgtgggcgcgcacgc

SEQ ID NO: 16013 - DNA, 201 bp, Homo sapiens
tggaaatctcgcgagaatcccgcgctgaagcgaagtcgagacgtttgaccttcctccgtttccgtagttccgagttgcggtttctccgttagtgcttccgrgttgcagccagggaagcctccgcggtggtgcaagtggaacccaagccttgaggtttcagtgagtagggggccgacgtgagctttagcgtccccctttagc

SEQ ID NO: 16014 - DNA, 201 bp, Homo sapiens
tcccctgggagcttccctgcccaacgtgggactgtctgttcaccctgggactgtgttctgcctgggagaacgtcggcactgctggcggtgactggggtctycccacaggaaagcgtgtgtgtgtgattgatgccgctgtgttgcttgaagccggctggcagaacctggtccatgaggtgtggactgctgtcatcccagaga

SEQ ID NO: 16015 - DNA, 201 bp, Homo sapiens; identical to SEQ ID NO: 2620

SEQ ID NO: 16016 - DNA, 201 bp, Homo sapiens
gcctcggccgcaggcccttcagtcaccgtcgcctcgtctccctgactgtccgcaggcctgggcagcatggccgtattccggtcgggtctcctggtgctgamgacgccgctggcctccctagcccctcgcctggcctccatcctgacctcggcggcccggctggtgaatcacacactctatgttcacctgcagccgggcatg

SEQ ID NO: 16017 - DNA, 201 bp, Homo sapiens
agaggagggacgccatcaaggtgaacagggaggcctgtgcctcagccagtgcgggagggccctgcatagtttagcttccctgtgccctgacccactcagayagtcccaggcaccctagggggtgggcaggtagtatagtcccaggcacaaacacctcccttgcagccttcccaccccattgagtttgtgagcatagaactt

SEQ ID NO: 16018 - DNA, 201 bp, Homo sapiens
ccagcagcaggacttctccattggctcccaaaagctcagcaaagccatcgttctacaaaagagtatggctagggaaagcactggaggggatggagccaagmggggctgtgaagaggccagtgcctcctacccacccatggctcggccttggtgtggtgattgccatgggatagttggggtctggggtaaggggaacaaagt

SEQ ID NO: 16019 - DNA, 201 bp, Homo sapiens; identical to SEQ ID NO: 2617

SEQ ID NO: 16020 - DNA, 201 bp, Homo sapiens; identical to SEQ ID NO: 2612

SEQ ID NO: 16021 - DNA, 201 bp, Homo sapiens
ctggcctccatcctgacctcggcggcccggctggtgaatcacacactctatgttcacctgcagccgggcatgagcctggagggcccggctcagccccagtmcagccccgtgcaggccacgtttgaggttcttgatttcatcacgcacctctatgctggcgccgacgtccacaggcacttggacgtcagaatcctactgacc

SEQ ID NO: 16022 - DNA, 201 bp, Homo sapiens; identical to SEQ ID NO: 2624

SEQ ID NO: 16023 - DNA, 201 bp, Homo sapiens
tcactccctccttccctctttttaccctttcctctttaccccaggacctggaggaacttgctttgtaccagatccagctgctgaaggacctcagacatacrgagaatgaagaggacaaagtcagctcctccagcttccgccagcgaatgttggggaacctgcttcggcctccatatgtaagctcctctccctccttccctc

SEQ ID NO: 16024 - DNA, 201 bp, Homo sapiens; identical to SEQ ID NO: 2613

SEQ ID NO: 16025 - DNA, 201 bp, Homo sapiens
atcccagagactgaggtatctcgccccaccccccacaccatccctactgcagatcctatcctgtgagctggaattcttcctgacaaatgtctcgtctgtgstcaggctgtaagacgcattgtggagagggatggcctcagtgaagccgcggctcaaagccggctgcagagccagatgagcgggcagcagcttgtggaacag

SEQ ID NO: 16026 - DNA, 201 bp, Homo sapiens; identical to SEQ ID NO: 2616

SEQ ID NO: 16027 - DNA, 201 bp, Homo sapiens
ctgaccaggtcaagttcaacgtgtttcaaggcatcatggattccctgttccagtccttcaatgcctccatctcagtggccagcttccaggagctgtcagcrtgtgtcttcagctggatcgaggagcactgtaagcctcaggtatggggcaacaataggcacagggtctgcggttttctctaccatcaagcaaagtggccca

SEQ ID NO: 16028 - DNA, 201 bp, Homo sapiens
gattacaggcatgtgccaccacacctaatttttgtatttttagtagagacggggtttcactatgttggccaggctggtcttgaaattcaggtgatccaccygccttggcctcccgaagtgctgggattataggcgtgagccaccacacctggcccccggggggctatttttaaagcacttttctaaagtacatggctgatc

SEQ ID NO: 16029 - DNA, 201 bp, Homo sapiens; identical to SEQ ID NO: 2615

SEQ ID NO: 16030 - DNA, 201 bp, Homo sapiens
gcgagtcgggggaacggggcactggggtggagtaggggcggaagggatcatacacaggggaggcactcgcacgccctagcctgtgccagtctcgggggacycattaagctgcccgcgcaccccgggctgtgtgtgtgcaagcgcgcagggtgacagaggcgccttcccggaatggggggcgcgctgtgcgtgcctgcagtg

SEQ ID NO: 16031 - DNA, 201 bp, Homo sapiens
ggaggaggaggtgtccacgttacgcaaggatgtcaccgccctaaagatcatgaaagtgtaagaggggtgctgaatggggggaaccagaacttctgaggcamcttcattgcacaccctcccttgttcaaaggccacatcagttactgctgtacagataatactcttagttcctgagctagccagtaggactgtgtatcccca

SEQ ID NO: 16032 - DNA, 201 bp, Homo sapiens
acaggcctctgcctcggccgcaggcccttcagtcaccgtcgcctcgtctccctgactgtccgcaggcctgggcagcatggccgtattccggtcgggtctcytggtgctgacgacgccgctggcctccctagcccctcgcctggcctccatcctgacctcggcggcccggctggtgaatcacacactctatgttcacctgca

SEQ ID NO: 16033 - DNA, 201 bp, Homo sapiens; identical to SEQ ID NO: 2625

SEQ ID NO: 16034 - DNA, 201 bp, Homo sapiens
gatagtcccgtcattcttcttgggtgggcggagctgctgcagcacctcagccctggcctgcatgcttttaggaactatgagcagattgtgaaggcacaccrggacaacccccatgaaggggaggaccaggtctctgaccaggtcaagttcaacgtgtttcaaggcatcatggattccctgttccagtccttcaatgcctcc

SEQ ID NO: 16035 - DNA, 201 bp, Homo sapiens
gagcacagccccgaggcgccgtctaccaggccccgtcccctcccccggctcctgtcggtcagcactgaaaccccgtccctgctccaggcctccttctctgkggtccaaggtcccatacaggcctctgcctcggccgcaggcccttcagtcaccgtcgcctcgtctccctgactgtccgcaggcctgggcagcatggccgta

SEQ ID NO: 16036 - DNA, 201 bp, Homo sapiens
gcgtgcgcgcccacggggcttgccttgacccaagggtcctcgggagaggcgcccggctccgtcatcttgtacccaccggaccggaaacgggccagcgggckggccccctgcggcgaggaagcgggtggcgtgcccacgtgacccgcgcccgccaatccgcgaccgagaggtggggcagggcgaagcatcgcgcatgcgcag

SEQ ID NO: 16037 - DNA, 201 bp, Homo sapiens
gctctgatgtggaaagacaggaggtgtggggaaggagggggatttcgtgtgtttgcatgagtgtgcgcttcaggccttgggagttggcaagagggagggarggaaggagagcaaaatcttcggaaggtgtttcttgtacctgagggatcctgccctgaatctccatagtctccactgtgaactgaggaggggaggggtgtg

SEQ ID NO: 16038 - DNA, 201 bp, Homo sapiens
gctcagactcctctgattgctccttctctctcctctgccaggtggtggtgaagacgctggagcagctggcgcaacaaggcaagatcaaagagaagatgtayggcaagcagaagatctattttgcggatcaggtgaggagaacttgcgccgattgtcacccatgagagcccgacaacgggtgaatctactcctggtgtgaac

SEQ ID NO: 16039 - DNA, 201 bp, Homo sapiens
tttatcgtcaatataataaattaatcagaagctttcacaaaacaaacaccgcggctccgctgaagataaaatggggctgggaaaaaccaaacaccaagtasaaaccagctgaccagtgtgaggtgttgtagtccagtctcccgggcccagcagttcagtggccacgtagagattcaagggcctcttgttggctgttctcca

SEQ ID NO: 16040 - DNA, 201 bp, Homo sapiens; identical to SEQ ID NO: 2650

SEQ ID NO: 16041 - DNA, 201 bp, Homo sapiens
tgtgactccagaagagaaagagcaggtgagctggaaggctgtaggaccgctgtgcaggtccagagtgaacatcagggctgagccccagagggctgctgtgrttctgaggagttagaggaacttgctttttccttctaggtgtacagagagaggcagaagtactgtaaggagtggaggaagaggaagaggatggtaagtgtg

SEQ ID NO: 16042 - DNA, 201 bp, Homo sapiens
aaggacttccatggagtggggggaaggctgggtaggtttgagttttatcgtcaatataataaattaatcagaagctttcacaaaacaaacaccgcggctcygctgaagataaaatggggctgggaaaaaccaaacaccaagtagaaaccagctgaccagtgtgaggtgttgtagtccagtctcccgggcccagcagttcag

SEQ ID NO: 16043 - DNA, 201 bp, Homo sapiens
cagtacactgtccccacgtttccctttattcctgcttctttaactggctacgcctaagtaagtgttcaacctcacacccacgccacttgtagatggaggargaaagaaaattagaagaataaataatcctgtatggcttagtttccatgtgagatgatagatccagagcaaggtggaacacctcagggagcacccactggg

SEQ ID NO: 16044 - DNA, 201 bp, Homo sapiens
agtatctaacatccagcagatattactcgttaaactgaaccaaaccacttttaaggctgactttcctaaaacaggctgcattgtgttactcatctaaagayaattctctaaaggagggtttggcaaactttttctgcaaatggccagacagtatttttaggatttgtgggccatatgtatctcttgtcatggctgcctgta

SEQ ID NO: 16045 - DNA, 201 bp, Homo sapiens
ccccacgtttccctttattcctgcttctttaactggctacgcctaagtaagtgttcaacctcacacccacgccacttgtagatggaggaagaaagaaaatyagaagaataaataatcctgtatggcttagtttccatgtgagatgatagatccagagcaaggtggaacacctcagggagcacccactgggaaagacagaac

SEQ ID NO: 16046 - DNA, 201 bp, Homo sapiens
gctgcaaaaaacatgtaaaaggcaccggaagacgccccagccagcctctggcctcaccaatcctcattatttttctatccacgaacactagataattctgrtgtgttttactgctctgtcctttgcatgttgtcttccctgtacctgcttctcttcctggccagctctttctttccttgaggatttcacttagacatcacc

SEQ ID NO: 16047 - DNA, 201 bp, Homo sapiens
gaagatctattttgcggatcaggtgaggagaacttgcgccgattgtcacccatgagagcccgacaacgggtgaatctactcctggtgtgaactctttgggracaaggccccccatggaaaactcacctgtcttaggccaccatccttaaatcaaggtgtgtactcctcttgttaggatcccaacttcacgaggtttccaga

SEQ ID NO: 16048 - DNA, 201 bp, Homo sapiens
gccttgggagttggcaagagggagggaaggaaggagagcaaaatcttcggaaggtgtttcttgtacctgagggatcctgccctgaatctccatagtctccmctgtgaactgaggaggggaggggtgtgctggggaataaatcttgtatgagaacaatctttaagagactgatgctgaatggtgtcctacccttgataggtc

SEQ ID NO: 16049 - DNA, 201 bp, Homo sapiens
gtatctgttctgcagcccctagtgaaatcatgtgatgtgagacagaaacctaaacatggtacttgattctaaacctgtgccagtctatagcctctgcctcsccaagcagagctcaagccaaacgcttctgtcctctttccttctgcattaaccctttgctgatcctcaggggccactcccccaacacccctgtacttgggt

SEQ ID NO: 16050 - DNA, 201 bp, Homo sapiens; identical to SEQ ID NO: 2640

SEQ ID NO: 16051 - DNA, 201 bp, Homo sapiens
aaagataattctctaaaggagggtttggcaaactttttctgcaaatggccagacagtatttttaggatttgtgggccatatgtatctcttgtcatggctgsctgtacaactgccacaactactcacctctgccactgtagaacagaagcagctgtagactatgtaaatgaacgggtggggctgtttcaataaaattttgtt

SEQ ID NO: 16052 - DNA, 201 bp, Homo sapiens
taggaccgctgtgcaggtccagagtgaacatcagggctgagccccagagggctgctgtggttctgaggagttagaggaacttgctttttccttctaggtgwacagagagaggcagaagtactgtaaggagtggaggaagaggaagaggatggtaagtgtgtgggagctccgagacaggccctggaggtgcctttgaaaatg

SEQ ID NO: 16053 - DNA, 201 bp, Homo sapiens
aggctggggtcgtgccctttggagccttgggcgttttccacatcactggctggatttccccagacccaggctcagactcctctgattgctccttctctctyctctgccaggtggtggtgaagacgctggagcagctggcgcaacaaggcaagatcaaagagaagatgtacggcaagcagaagatctattttgcggatcagg

SEQ ID NO: 16054 - DNA, 201 bp, Homo sapiens
tgggccactttgcttgatggtagagaaaaccgcagaccctgtgcctattgttgccccatacctgaggcttacagtgctcctcgatccagctgaagacacaygctgacagctcctggaagctggccactgagatggaggcattgaaggactggaacagggaatccatgatgccttgaaacacgttgaacttgacctggtcag

SEQ ID NO: 16055 - DNA, 201 bp, Homo sapiens
gcgcttcaggccttgggagttggcaagagggagggaaggaaggagagcaaaatcttcggaaggtgtttcttgtacctgagggatcctgccctgaatctccwtagtctccactgtgaactgaggaggggaggggtgtgctggggaataaatcttgtatgagaacaatctttaagagactgatgctgaatggtgtcctaccct

SEQ ID NO: 16056 - DNA, 201 bp, Homo sapiens
caagttcagagctctgatgtggaaagacaggaggtgtggggaaggagggggatttcgtgtgtttgcatgagtgtgcgcttcaggccttgggagttggcaaragggagggaaggaaggagagcaaaatcttcggaaggtgtttcttgtacctgagggatcctgccctgaatctccatagtctccactgtgaactgaggaggg

SEQ ID NO: 16057 - DNA, 201 bp, Homo sapiens; identical to SEQ ID NO: 2639

SEQ ID NO: 16058 - DNA, 201 bp, Homo sapiens
ttttaaaggctaaggaggttgtaggtagcagaaggctttaaaaagtagcaccttactcctccactggatggtttgagctgcagggacagctgctctttggycttcagctcacctcagaaactagaaatatttatttcaggctctgtcccattggccactgtggtcaggggtggaaagcacctgccaggtgttgccctgaga

SEQ ID NO: 16059 - DNA, 201 bp, Homo sapiens
tccatgtgagatgatagatccagagcaaggtggaacacctcagggagcacccactgggaaagacagaactccttcctcaggggtagcaagtgaccccaggsggatgtggtttcagagctcaaggaattatctagtgccctgaccacaccagagatgcagaaagaaatccaggagttaaagaaggaatgcgctggctacaga

SEQ ID NO: 16060 - DNA, 201 bp, Homo sapiens
ggaggcattgaaggactggaacagggaatccatgatgccttgaaacacgttgaacttgacctggtcagagacctggtcctccccttcatgggggttgtccyggtgtgccttcacaatctgctcatagttcctaaaagcatgcaggccagggctgaggtgctgcagcagctccgcccacccaagaagaatgacgggactatc

SEQ ID NO: 16061 - DNA, 201 bp, Homo sapiens
gtaagtgttcaacctcacacccacgccacttgtagatggaggaagaaagaaaattagaagaataaataatcctgtatggcttagtttccatgtgagatgayagatccagagcaaggtggaacacctcagggagcacccactgggaaagacagaactccttcctcaggggtagcaagtgaccccagggggatgtggtttcag

SEQ ID NO: 16062 - DNA, 201 bp, Homo sapiens
agagtcttcccctccccattaagaaccctgataagagctggccactgccaggatcaacagacttaaccagaggtgttgggtgctgaaggcacagttgcagrttggacatcagtaaaacatctttaagacatggcagagggtgctggactaggctgtgtagccctgacatgtggcatgctgacggagacgaagcttctccct

SEQ ID NO: 16063 - DNA, 201 bp, Homo sapiens
ggaggctgaatgagccatagtgactgttgctggcggcaggggtgggggggccctgaaatcactctcatgtctagtttttgctctagctcaagaaggatctygagagatcatcaagctaagttgaccttttaatgctggccagagaggctgggagagggccaggtgcctgctgtgtcacagagttcagggcaggcggcaagc

SEQ ID NO: 16064 - DNA, 201 bp, Homo sapiens
ctgcaggtggagtgatggagcctctcagagcctcatctcaggctcccctgcccaccacctctaggtggatgcagctgttcccatttcgcgggctcaggtadcttgtgtgctccagactgggggcctccccgcggtgggcagaggtggcctttgtgtgtagtctcagcggctaaggaccctggctgcacttctgccagctgc

SEQ ID NO: 16065 - DNA, 201 bp, Homo sapiens
actcatgggggcatgatggagtttctggaagtgtggtctcctgggtagctaaatccaaatccctggaatactggctaaagacagctacctgggccgggcgyggtggctcacgcctgtaagcccagcactttgggaggccgaggcaggcggatcacgaggtcaagagatcaagaccatcctggccaacatggtgaaacctcg

SEQ ID NO: 16066 - DNA, 201 bp, Homo sapiens
ggctgcaggtggagtgatggagcctctcagagcctcatctcaggctcccctgcccaccacctctaggtggatgcagctgttcccatttcgcgggctcaggbagcttgtgtgctccagactgggggcctccccgcggtgggcagaggtggcctttgtgtgtagtctcagcggctaaggaccctggctgcacttctgccagct

SEQ ID NO: 16067 - DNA, 201 bp, Homo sapiens
cagagtactctttgaggctgtaactgtgcaggagagacagtgagggacaggccagcgtctgtcccagcgctgcctctcttttggggctgcaggtggagtgrtggagcctctcagagcctcatctcaggctcccctgcccaccacctctaggtggatgcagctgttcccatttcgcgggctcaggtagcttgtgtgctccag

SEQ ID NO: 16068 - DNA, 201 bp, Homo sapiens
caagcatcctccagcagtttctgatgaggaatcctttcattttccagcagcttgcagaggaggccaggggaaaatatggtgaccacagaaggcctggatcrtgagggttgggagtaaagctctcagatgaagttgtcaaagatggcaccatggccttcgttgttggagatgggatatgcctcagtgtgttactagatcctg

SEQ ID NO: 16069 - DNA, 201 bp, Homo sapiens
tgtggaagtctaggcctggttccaaggatgagcaggacctggtgtggaagtctaggctccgttccgaggatgagcaggacctggtgtggaagtctaggccyggttctgaggatgagcaggacctggtgtggaagtcgaggctccgttccgaggatgagcaggacctcgtgtggaagtctaggcccggttctgaggatgagc

SEQ ID NO: 16070 - DNA, 201 bp, Homo sapiens
tagattatggcttcagcaaaggctgtgatgcctccgtgccatgtgtcatggtgtttgtctggttttctgtaggcaaactaggcgtggcaactgctggctgygtgaatgaagttacagagatggagtgcggtcgctctgaaatcgacgagctgatcaaggaggtaagcagaggcagcatttcaggggtctggccctgccagg

SEQ ID NO: 16071 - DNA, 201 bp, Homo sapiens
taaagggaagtttaaagaaggggacaaagctgaaccagccacttggaagacgaggttacgctgtgctttgaataagagcccagattttgaggaagtgacgraccggtcccaactggacatttccgagccatacaaagtttaccgaattgttcctgaggaagagcaaaaatgtaactatcctttatgggcatgaaaccttcc

SEQ ID NO: 16072 - DNA, 201 bp, Homo sapiens
gggcgctgtgaatttgttgagaaaaagattatgtctttattttctttaacttcaggtttaaattgagcatttccttttgttatgaatgtaggcagcagacygcagtgcccttggcagtgcctatgagacggagtattgtcataagaaatgagttgtcgaaacatcgtttgccctcagcttgacgtgtaaattacaacagtt

SEQ ID NO: 16073 - DNA, 201 bp, Homo sapiens
gttcagtgccattattcaaaagggaggttgacaggtgttaggtgttagagagctatcagcaccaaactgaggcttgctttttgaggtaatcagaggttggragaatattgaagatggaataatcttgtgattacatgtatcacccctcccccattattctgtgtgtgccacttttggggaacccctgctttagtttgagtg

SEQ ID NO: 16074 - DNA, 201 bp, Homo sapiens
tgtccatgaagctcttgtctatttcctggcagccctttgagctggggggttgttttcactccggcttcacagatgaggagactgaggctgggaggttcagkatctcatccaggtcgcgcaggcctctggctggagcctgttcttgaggcctccttgtgcccggcagccgccatgctcacagggtctcagttctgggaggcc

SEQ ID NO: 16075 - DNA, 201 bp, Homo sapiens
ctgaggactgcatgggacagttttgtgggtagcagaggtcggtgctcacccaggcaggaaaactgtcgagatggcaatgccctgtccatgaagctcttgtstatttcctggcagccctttgagctggggggttgttttcactccggcttcacagatgaggagactgaggctgggaggttcaggatctcatccaggtcgcgc

SEQ ID NO: 16076 - DNA, 201 bp, Homo sapiens
tggctccacaaggcagcctcgaaccggtctggggtacttagaaggagctgcaaactcactaagctcattgctagcgtatgtaattcttttggtttaaggcrattaaaatgcagatacctccctgcatttacatgttatctgcattcctaccttagattagtgttttccaaactttggtcacttgaggtccagtgtcacaat

SEQ ID NO: 16077 - DNA, 201 bp, Homo sapiens
ggggctgcaggtggagtgatggagcctctcagagcctcatctcaggctcccctgcccaccacctctaggtggatgcagctgttcccatttcgcgggctcasgtagcttgtgtgctccagactgggggcctccccgcggtgggcagaggtggcctttgtgtgtagtctcagcggctaaggaccctggctgcacttctgccag

SEQ ID NO: 16078 - DNA, 201 bp, Homo sapiens
ttcatccgtaaaacagagaaaccaggacttgcgccatggggtcacgagggttaagtgaggcattcatcctttgattctcttttgatgagccactcagaacycccagctgcttgaaatgcccccgcccccgccaggcccaggcttctgcagccggtgaatgtgtttgcttcctccctcggcgtcttccccctagccctacat

SEQ ID NO: 16079 - DNA, 201 bp, Homo sapiens
aggggaggaaatggggcagggatagaagcgtgctggctgaggactgcatgggacagttttgtgggtagcagaggtcggtgctcacccaggcaggaaaactrtcgagatggcaatgccctgtccatgaagctcttgtctatttcctggcagccctttgagctggggggttgttttcactccggcttcacagatgaggagact

SEQ ID NO: 16080 - DNA, 201 bp, Homo sapiens
tgccatctgtcattcctttgggggctgggccgtgtggggggttgtgaacctgcagcagatgtctaaaaatagtctcacctcccttgagagtaatcggttcyccatgcgtggagagacgtgatggagggtttgttctgtgccaggcctggcccacggcttgttttctgctcacatgatcctgtgtggtagatgctgttccca

SEQ ID NO: 16081 - DNA, 201 bp, Homo sapiens
gtactcaaggggctgaggcaggaagatcgcttaagcccaggagttccaggctgccgcgagctatgatggcaccactgcactcctgcctgggtgacagagcwagaccctgtctctaaagaaaaaaaaattgaactcatccccttttaaatccataaacgcacaactgaggttgttggatggggaatttaagaaatcccacct

SEQ ID NO: 16082 - DNA, 201 bp, Homo sapiens
attcatgggaagggaaggatgtgtggggtcctggtcatggtgacggatatttgtgattggagtcggccatgaatttaatgtgcttctgtttctttcttcargcctgggcagtttttaaagggaagtttaaagaaggggacaaagctgaaccagccacttggaagacgaggttacgctgtgctttgaataagagcccagatt

SEQ ID NO: 16083 - DNA, 201 bp, Homo sapiens
ccgagttgctgggactacaggcccgtgccaccacgctcagctaattttttgtatttttagtagagatggggtttcaccatgttggccaggatggtcttgaycttgtgatcctcccagcttggcctcccaaagtactgggattacaggcgtgagccacctcgcccggcagtctgggcagctttgagccctgcatccaggtct

SEQ ID NO: 16084 - DNA, 201 bp, Homo sapiens
tttatcctttaaaagtgttagcagaaacaaccaccaccaccaccaccaccaacttctctcttttgactttgctgatcagatgactgaagcatgggaaaaawattctgtgcctttcccaaaccaatgaagacactcactaacttaacgtttccttaaactcagcatttacagagtagattatggcttcagcaaaggctgtga

SEQ ID NO: 16085 - DNA, 201 bp, Homo sapiens
catcactaaaataaatcccaaagtactgagctgggatctggcctcagaaggcttctcaaagccctgtgctgtgccgctgccatgaattgtagctgatttaygagataaaacctaattaccagcgctggtttagaacatgcttttaacacattgattttcttagccacttgatgaggcttttagaataacccactctggctt

SEQ ID NO: 16086 - DNA, 201 bp, Homo sapiens
atgcctccgtgccatgtgtcatggtgtttgtctggttttctgtaggcaaactaggcgtggcaactgctggctgcgtgaatgaagttacagagatggagtgyggtcgctctgaaatcgacgagctgatcaaggaggtaagcagaggcagcatttcaggggtctggccctgccaggaggagtctcatgtcttctggcagggag

SEQ ID NO: 16087 - DNA, 201 bp, Homo sapiens; identical to SEQ ID NO: 2669

SEQ ID NO: 16088 - DNA, 201 bp, Homo sapiens
tgggtattacaaggtggacatttgcatgactaaacctcgtgcagcctttgcaaaaggttgtgtgtgagtactgcataaattcttcttcttaataacatagmaataatggaatccttaagagtagcttggctgtcagagaatgaagataacagaatgtaacctacccgaacggccttgctcttctgcacaggcagctgccaa

SEQ ID NO: 16089 - DNA, 201 bp, Homo sapiens
acaaaatgtaaactttccttgctgcctgcgcttgtcatgatggcgggtgttgttgtaccagctctcatggctatttgattgcttcctttttaatgtgcagkttttattccttaacggattggaaagctggataaccaagcatgttcacattgcacataaattcctaacaggctacaagggagagcataatcggggcctcct

SEQ ID NO: 16090 - DNA, 201 bp, Homo sapiens
gcgagattcttgaaagcatggcagcctttggccagcatcactgttcactggtgtctcagagcttgtctgcgtgtccagggcgttgagggcaattggataayctggaacactgggtctgcaacaggcaggtcctggaaagggccaggaaacttattagtggcccccaaagagcctagtaatttggccacatggtttgaatgc

SEQ ID NO: 16091 - DNA, 201 bp, Homo sapiens
taacggattggaaagctggataaccaagcatgttcacattgcacataaattcctaacaggctacaagggagagcataatcggggcctccttaggcaagaayacatggcttttgtatacccatttcagctattgggatgcccttttcttctgtctttggcctcttaactatgcttttcatgggtattacaaggtggacattt

SEQ ID NO: 16092 - DNA, 201 bp, Homo sapiens
ctgttacgacattaaggaccccctcagaaccaaagagagcccagggcatttggaggagaggagaactcagaccaggaacaggaagtttgttcagagccctrgatttgaatcccacgctgggaagttacagatcttgagcctcagtttattcatccgtaaaacagagaaaccaggacttgcgccatggggtcacgagggtta

SEQ ID NO: 16093 - DNA, 201 bp, Homo sapiens
aagtgaggcattcatcctttgattctcttttgatgagccactcagaacccccagctgcttgaaatgcccccgcccccgccaggcccaggcttctgcagccsgtgaatgtgtttgcttcctccctcggcgtcttccccctagccctacatcccctgtgggagtctgggaggtggcagctggccccggaggccttgaaggttg

SEQ ID NO: 16094 - DNA, 201 bp, Homo sapiens
gctgcaggaacaccatccggaaagctagcttgcacccccaggctctcccccagagataagccctgggtggtgggtatgcagtccagtggtattctgggggyaagtgcttgaggtgggaaggaaatgtggccccacagtgtcacattgacacatggtcagaaatcccacagcatagaggaagtccccccgacttgccactct

SEQ ID NO: 16095 - DNA, 201 bp, Homo sapiens
accagaaaatccctcattgtctgcaggcatcatcctgaggccggcctcatggtatagatcacagaagagaaattgaaaaaacattgagctcattttgtacsgaccctgagtacactgatgaggccctgatagcaactcatttaatttttaaaaagtactttaccttcttgacatgacgacaaggggggaaaatctagttaa

SEQ ID NO: 16096 - DNA, 201 bp, Homo sapiens
tggagtagccaggcacagaactgagccatctcggtgagatgcagaggcacaatttggggagagcatgtccttgaattagtccagcagggtcatagccactkcctcatgcacagaacatccttctagaagctgtgagctttggtacctctgtccagccccgcccccacctctatgtaaatccatgcttcagtttccttacct

SEQ ID NO: 16097 - DNA, 201 bp, Homo sapiens
agggtcatagccactgcctcatgcacagaacatccttctagaagctgtgagctttggtacctctgtccagccccgcccccacctctatgtaaatccatgcytcagtttccttacctggaaaatgggtataataataatctaccttacagggttaaatgtgctggtaggtcccaagccctgggcacagcacctgatatgagc

SEQ ID NO: 16098 - DNA, 201 bp, Homo sapiens
gggctgcaggtggagtgatggagcctctcagagcctcatctcaggctcccctgcccaccacctctaggtggatgcagctgttcccatttcgcgggctcagvtagcttgtgtgctccagactgggggcctccccgcggtgggcagaggtggcctttgtgtgtagtctcagcggctaaggaccctggctgcacttctgccagc

SEQ ID NO: 16099 - DNA, 201 bp, Homo sapiens
ggatgagcaggacctcgtgtggaagtctaggcccggttctgaggatgagcaggacctggtgtggaagtcgaggccccaatttctcctcctcaccatttggrcaggagctggcgagtggcctcttttgaggccacttttcttggactggaccagcaagtagacagagtactctttgaggctgtaactgtgcaggagagacag

SEQ ID NO: 16100 - DNA, 201 bp, Homo sapiens
ggaaaaacagccagggccataaaggagggccttttgtgacatcatcagaagtggagaagaggtacccagatcccattagcaaagtgcagccgaagagtcawgctaagttcactgtgtcccttgcggcattgccttcctcagtgctggctgccatcatacaaccccatagcttgtgtggcttaaacagcagacatttatttt

SEQ ID NO: 16101 - DNA, 201 bp, Homo sapiens
gtggtggggaaactgttgggttggaagtgggtacagctggcatttaatcccagactgggtggccttgggaaagttacttacctcttggaattgcattttcytgaagtgggtacagctggcatttaatcccagactgggtggccttgggaaagttacttacctcttggaattgcattttcctgaagtgggtacagctggcat

SEQ ID NO: 16102 - DNA, 201 bp, Homo sapiens
taaaggagggccttttgtgacatcatcagaagtggagaagaggtacccagatcccattagcaaagtgcagccgaagagtcatgctaagttcactgtgtccsttgcggcattgccttcctcagtgctggctgccatcatacaaccccatagcttgtgtggcttaaacagcagacatttattttctcagtgttctggaggctg

SEQ ID NO: 16103 - DNA, 201 bp, Homo sapiens
agccagattgcgccactgcattccagactggtgacagagtgagactccgtctcaaaaaaataaaaaaactaaaataaataaaaataaaaaataaaaaaagmcagctaccgagacccaacctcccttccccagtgagaatcttgaggggcaaggcccaggaatctgcattttcacaagcttcccaggggcagggggttggta

SEQ ID NO: 16104 - DNA, 201 bp, Homo sapiens
tgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggtttc

SEQ ID NO: 16105 - DNA, 201 bp, Homo sapiens
ttccagtgtcgttctccctctcccccacttcatttttacaataaatgtcagtgcacacccaggagcgggtggtcccacaggggacatcttaacgcccaccsaggagcggctggtcccacagaggacctcttaacgctgacgctttctggagaaaaggatttgtgatgaaaatttccccaaggggaccttctagcgcctagc

SEQ ID NO: 16106 - DNA, 201 bp, Homo sapiens
ctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggttt

SEQ ID NO: 16107 - DNA, 201 bp, Homo sapiens
gggcgcagctcagtggccacccgtgtccctctctgctttttgcctattttccagccacctaagtccaatctgaatgcccaagtcgttgattgtcgtttgcytgtttccaaagattggtagatagatgcctttttaaaaatctcatttttctttaaatctggtttacatggaaaacgttaggagagctcatataatgaacgg

SEQ ID NO: 16108 - DNA, 201 bp, Homo sapiens
atctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggt

SEQ ID NO: 16109 - DNA, 201 bp, Homo sapiens
gaaggacacacagacgtggctgcacatgtgcagagatcttgtaatgtaactatggcttttctctgcaccatgtgtgaaataagctgccgctggcgttgggrcgccggcctgggttccaacacagtccgctggctgcctcggtatttgccgtgcctctctgggcctcagtttttcctctcttaaataaagaggggactggat

SEQ ID NO: 16110 - DNA, 201 bp, Homo sapiens
cccgacgccaggcggggcgtgggggtggaactacctaccgtaatgtccccgggcgcagctcagtggccacccgtgtccctctctgctttttgcctattttycagccacctaagtccaatctgaatgcccaagtcgttgattgtcgtttgcctgtttccaaagattggtagatagatgcctttttaaaaatctcatttttct

SEQ ID NO: 16111 - DNA, 201 bp, Homo sapiens
tatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtggg

SEQ ID NO: 16112 - DNA, 201 bp, Homo sapiens
gtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgg

SEQ ID NO: 16113 - DNA, 201 bp, Homo sapiens
tgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtg

SEQ ID NO: 16114 - DNA, 201 bp, Homo sapiens
ccagcatcactgttcactggtgtctcagagcttgtctgcgtgtccagggcgttgagggcaattggataacctggaacactgggtctgcaacaggcaggtcstggaaagggccaggaaacttattagtggcccccaaagagcctagtaatttggccacatggtttgaatgctaagcctggtagatttaaggcctagggcctt

SEQ ID NO: 16115 - DNA, 201 bp, Homo sapiens
tcggtagctgcagtttatttcctcactcttgtccctatctttcagttggtcgtaggagttgcccaggaaggaagtttggataataataatgacatctggcrtgtaaggtccaggccctgtctcagttgctttccgtgtagcatctgaattctcttacaaccagtacaggtagtgttttgttagctgcatctgggactgggt

SEQ ID NO: 16116 - DNA, 201 bp, Homo sapiens
tggagctgttcactgtggttgtatctgcctgaaaggaaagggcagatgaaagctggaaggagcacagccagcacagtgggaggggcctgcagggggctgcwggtggctgcaggtggctgcaggtttcccacggagctttcagtttgcactcagggctgtgaggtcatggaggccagcattgccttctcatggcaggtgtcc

SEQ ID NO: 16117 - DNA, 201 bp, Homo sapiens
ttctcatttacttaaaaattaatccagttttttaaaagcaaacattggttcaggagtgctgaatgtgtctcagacatgtacatgagctgatttcacatctyttgaattacggagtcacttttgtggtcgcttgtattctgatgaggagatcgaaggctcttttcttctcttttctgctgcttccttttcctgatgagccaa

SEQ ID NO: 16118 - DNA, 201 bp, Homo sapiens
tgtcggagtcagctccttccagactggtgggcgcagcagcccagcacaggtgagggtgggtggcctagaattgtcaccaggcatggcctgaagggtttacrgcattccaccagccagggacggagtgggggtggttgttgctatcatgatccatgtctcattaaaggtagctcagccctgagaggtgaagaacgatggccc

SEQ ID NO: 16119 - DNA, 201 bp, Homo sapiens
tagctgatcaacagagatttcttgccattacacctagattcagacagaggaaccaggaattagggcagcccagctctgcagaccagctgggctatcgaatsccttgtgggtcatcagagtcctgtgtgggcatctctaaggctccagatgtccaggtttcacctctgggagattcggagcccaaggtcaaggtcaagctag

SEQ ID NO: 16120 - DNA, 201 bp, Homo sapiens
taaatgtgctggtaggtcccaagccctgggcacagcacctgatatgagctgtgtagaccatagtctgtggtttataacttcaggagtcttgtctgtgtagrtaagcatttgtcctgttacccagtttctttaactggtgcttacctgtgccgagcacaaatacaagctccgataatcctcacagcagcccagtgaggtgga

SEQ ID NO: 16121 - DNA, 201 bp, Homo sapiens
gcccagtgaggtggatgctgtttttatctctactttgctgatgaaaagctgaggcacagagtggggaagcggcttgccccaggtcatccagctgggcagcrgctgggctgggaccgcacgtcaggcaggtgggctgcagggtctgtgctgcgggtgtctttgttgctgcctctgtggtcaggccgttccccagcaaggctg

SEQ ID NO: 16122 - DNA, 201 bp, Homo sapiens
gtgaccttgcgaaagttacttacctcttggaattgcattttcctgaatgggatcgggatgtccctacagatctcctatcattttaggctggaggacactgyctgatttttcctgaaaccgaagataattctcatctgactgtggttacctcctagttggtgtgtctgtattccaattttgcaagcttaaaatctgtccatt

SEQ ID NO: 16123 - DNA, 201 bp, Homo sapiens
gaatgacttattcgctctctgcgtttgtgcaagggcaaggatggccacgtcccagctctatccagcccctggcccagtgcctggggttcggtggcgctcakttcacgcttgcagagcgagcggcggtgagtggatgcggtggggtcgggctgtggtggtaaaggtggccgtgaacaggaggggccactagagcacacagac

SEQ ID NO: 16124 - DNA, 201 bp, Homo sapiens
gtctttccacatctggtccccagatgtgaaaagactcaagacatctgattggagtctctttgggtcctgaaattgaatgagagttgatggccaacaaagaytcatgggaagggaaggatgtgtggggtcctggtcatggtgacggatatttgtgattggagtcggccatgaatttaatgtgcttctgtttctttcttcagg

SEQ ID NO: 16125 - DNA, 201 bp, Homo sapiens
ccaccaacttctctcttttgactttgctgatcagatgactgaagcatgggaaaaaaattctgtgcctttcccaaaccaatgaagacactcactaacttaaygtttccttaaactcagcatttacagagtagattatggcttcagcaaaggctgtgatgcctccgtgccatgtgtcatggtgtttgtctggttttctgtagg

SEQ ID NO: 16126 - DNA, 201 bp, Homo sapiens
gattaaagcaggacagcaaaaacatgccgcaccctggtcctacatcactaaaataaatcccaaagtactgagctgggatctggcctcagaaggcttctcaragccctgtgctgtgccgctgccatgaattgtagctgatttatgagataaaacctaattaccagcgctggtttagaacatgcttttaacacattgattttc

SEQ ID NO: 16127 - DNA, 201 bp, Homo sapiens
tcagtaccctcatcaggtgattgtcgggagggtaaaggaacttaacctcatgtaccttggagtatgttccaaggatggtccctgagcgctggctagagacrcagagtctgaggccctgctccagccacaagatccgaacctgcatcttagcaaggtccctggggatctgtgtacaggttttgagacacgctgactttccgc

SEQ ID NO: 16128 - DNA, 201 bp, Homo sapiens
cactcgcctctaacctcagtggtttgcaggctccatggtgggcgccccacctgctccctacttccccatcagtagcttctcagtgaattctttaatctatygaaatggaatcaaaattcagccgggaggaaacagtgggtaaattctgtaggtcactgggaataatgaatttttgtaagtgttggttgtgatacgtctcac

SEQ ID NO: 16129 - DNA, 201 bp, Homo sapiens
acacgctgactttccgcacactaagtgctcaggatggcagctgcacacactaagtgctgcctgttagctttcgttacgctgtagggaggatgtgtaggatmccagcctgggtgtctcctggagggttaggatggcgtctcccttctccacgtccccatgctctctgctcctctccctgtagcagcacagcccgagatagtg

SEQ ID NO: 16130 - DNA, 201 bp, Homo sapiens
tagggaggatgtgtaggataccagcctgggtgtctcctggagggttaggatggcgtctcccttctccacgtccccatgctctctgctcctctccctgtagyagcacagcccgagatagtgtcaggtctcagctgccactggcctgagaactgccagaggaggggcctggaagggcgggtgcaggggtatgtgtgagctcag

SEQ ID NO: 16131 - DNA, 201 bp, Homo sapiens
tatgtgtgagctcaggggcataagccctgaggaatccccctagtgaggaggtgtgaggccgcggttatcacccctgagcaggcagagcggcacagaagtgygtcctgcaatgtacattcccgggcctacctcacatcctctgattccatgggtctgaggcggggcccaagattctacatttctaatgagctcccagggaag

SEQ ID NO: 16132 - DNA, 201 bp, Homo sapiens
tcggggttgccaactcagttgcctccaagggccaggcaggtaagagcaatgcacgaattgagagataagagagagcactgggcagctgtgcccatggagakgcgttcaaacgaggcattaaaatcccggcaacaacctggaatggccaaacgaacagctccttgcttggaatttggcccaagggccaccagtttgagatcc

SEQ ID NO: 16133 - DNA, 201 bp, Homo sapiens
ctgccgacaggtcaacccctcacgccagatccctccttcatccctagggctgggcctgagctgccggttatgtgtcagtgaagttccttccagctccaaastgttcgaacactttggacagcagtcttttaaatggcatcgtgaattcccttgccttcctagcaggctacagagaacaaaatgtaaactttccttgctgcc

SEQ ID NO: 16134 - DNA, 201 bp, Homo sapiens
gctccaaactcattctcgtgcaggtaagtatgggcagcttttttttttttttttttttttttgagatggagtcttgctctgttgcccaggctggtgtgcartggcgtgaccttggctcactgcaacctccgcctcccgggttcaagtgattctcctgcctcagcctcccgagttgctgggactacaggcccgtgccaccac

SEQ ID NO: 16135 - DNA, 201 bp, Homo sapiens
cccaggctggtgtgcaatggcgtgaccttggctcactgcaacctccgcctcccgggttcaagtgattctcctgcctcagcctcccgagttgctgggactayaggcccgtgccaccacgctcagctaattttttgtatttttagtagagatggggtttcaccatgttggccaggatggtcttgatcttgtgatcctcccagc

SEQ ID NO: 16136 - DNA, 201 bp, Homo sapiens
ttgcaggctccatggtgggcgccccacctgctccctacttccccatcagtagcttctcagtgaattctttaatctatcgaaatggaatcaaaattcagccrggaggaaacagtgggtaaattctgtaggtcactgggaataatgaatttttgtaagtgttggttgtgatacgtctcacactgataaacttcataaggtaag

SEQ ID NO: 16137 - DNA, 201 bp, Homo sapiens
cctcagcctcccgagttgctgggactacaggcccgtgccaccacgctcagctaattttttgtatttttagtagagatggggtttcaccatgttggccaggrtggtcttgatcttgtgatcctcccagcttggcctcccaaagtactgggattacaggcgtgagccacctcgcccggcagtctgggcagctttgagccctgc

SEQ ID NO: 16138 - DNA, 201 bp, Homo sapiens
aaggccaaaaagagatttcctgccaactggcaatacaaaaaagaccccaacctgccaacacgttttgccaggaaatcggtgagtgttttcaaatgccctgkcttataaatgtaaccttcttaagttagcaaatgcttgctgtaaagtatatctgatacagactcattttggatctcagaaaatagaagaaagagaccaaag

SEQ ID NO: 16139 - DNA, 201 bp, Homo sapiens
cgggagttggaggtcatctcggccttgcttgcaaacaccctctgcctgtgtcattccagagctgcagcagttctataacagccagggccggcttcctgacrgcagggtggtgctgtgctttggggaagagtttccggatatggcccccttgcgctccaaactcattctcgtgcaggtaagtatgggcagcttttttttttt

SEQ ID NO: 16140 - DNA, 201 bp, Homo sapiens
ttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgt

SEQ ID NO: 16141 - DNA, 201 bp, Homo sapiens
agtcttttaaatggcatcgtgaattcccttgccttcctagcaggctacagagaacaaaatgtaaactttccttgctgcctgcgcttgtcatgatggcgggkgttgttgtaccagctctcatggctatttgattgcttcctttttaatgtgcagtttttattccttaacggattggaaagctggataaccaagcatgttcac

SEQ ID NO: 16142 - DNA, 201 bp, Homo sapiens
ggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatct

SEQ ID NO: 16143 - DNA, 201 bp, Homo sapiens
agtgagataatcggattgccacaccggggtcacaagaaaagcaatttcaaaacatttcataattggatttatcagcctcctttaaggaatgggccagagaytgaacatctgcatgtggctcgttgagcgagattcttgaaagcatggcagcctttggccagcatcactgttcactggtgtctcagagcttgtctgcgtgtc

SEQ ID NO: 16144 - DNA, 201 bp, Homo sapiens
tggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatc

SEQ ID NO: 16145 - DNA, 201 bp, Homo sapiens
ctgcagggggctgctggtggctgcaggtggctgcaggtttcccacggagctttcagtttgcactcagggctgtgaggtcatggaggccagcattgccttckcatggcaggtgtcccggagtccctgaatctgtgggtttcccccaagccagcacctttgctgcaaacctctgagtttcctgttagcagtttttgggttgct

SEQ ID NO: 16146 - DNA, 201 bp, Homo sapiens
gtggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaat

SEQ ID NO: 16147 - DNA, 201 bp, Homo sapiens
cactgtggttgtatctgcctgaaaggaaagggcagatgaaagctggaaggagcacagccagcacagtgggaggggcctgcagggggctgctggtggctgcwggtggctgcaggtttcccacggagctttcagtttgcactcagggctgtgaggtcatggaggccagcattgccttctcatggcaggtgtcccggagtccct

SEQ ID NO: 16148 - DNA, 201 bp, Homo sapiens
gctctgcgcaccgcccgtcccccccacgaccctttttaaggccgcgcgaccgctggcgcatcgcctggagcgcggcagcaagcgtgggaacgcgggcggcragacggcggcaggacggcggcaggtaggcacagtgggcgggtagggcgcccgtgtcccgcgcggtccggtcccgcggggtccccgacgccaggcggggcg

SEQ ID NO: 16149 - DNA, 201 bp, Homo sapiens
ctctgcgcaccgcccgtcccccccacgaccctttttaaggccgcgcgaccgctggcgcatcgcctggagcgcggcagcaagcgtgggaacgcgggcggcgrgacggcggcaggacggcggcaggtaggcacagtgggcgggtagggcgcccgtgtcccgcgcggtccggtcccgcggggtccccgacgccaggcggggcgt

SEQ ID NO: 16150 - DNA, 201 bp, Homo sapiens
tgatgcacatgtgtatatttggaaaggccaaaaagagatttcctgccaactggcaatacaaaaaagaccccaacctgccaacacgttttgccaggaaatckgtgagtgttttcaaatgccctggcttataaatgtaaccttcttaagttagcaaatgcttgctgtaaagtatatctgatacagactcattttggatctcag

SEQ ID NO: 16151 - DNA, 201 bp, Homo sapiens
agcaaccccctatcttgaaacgcgctctatcatcccactgaaattctaccacgtggaataatgcttggagggtcagagttgtggaactgcccaataaccartcgttactgagggttagtttgtgaaggaggggacagactgcttctaaaattctgtttaatgacagtcaattaagatttctgagtctggcttgagggcctt

SEQ ID NO: 16152 - DNA, 201 bp, Homo sapiens
taactgtagtagaatctcaggcttttgatgttacttagaatcttggaggagaccacgaaggacacacagacgtggctgcacatgtgcagagatcttgtaaygtaactatggcttttctctgcaccatgtgtgaaataagctgccgctggcgttggggcgccggcctgggttccaacacagtccgctggctgcctcggtatt

SEQ ID NO: 16153 - DNA, 201 bp, Homo sapiens
aaagtgctgtctttatcctttaaaagtgttagcagaaacaaccaccaccaccaccaccaccaacttctctcttttgactttgctgatcagatgactgaagyatgggaaaaaaattctgtgcctttcccaaaccaatgaagacactcactaacttaacgtttccttaaactcagcatttacagagtagattatggcttcagc

SEQ ID NO: 16154 - DNA, 201 bp, Homo sapiens
agggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgtt

SEQ ID NO: 16155 - DNA, 201 bp, Homo sapiens
tgaggctgggaggttcaggatctcatccaggtcgcgcaggcctctggctggagcctgttcttgaggcctccttgtgcccggcagccgccatgctcacaggrtctcagttctgggaggcctgggtcatgaggctaagcctccgggctcgccagccactgggctatggcctgggagtctgctgaccagtgctttccgggggct

SEQ ID NO: 16156 - DNA, 201 bp, Homo sapiens; identical to SEQ ID NO: 2654

SEQ ID NO: 16157 - DNA, 201 bp, Homo sapiens
cactgggctatggcctgggagtctgctgaccagtgctttccgggggctgtggagtagccaggcacagaactgagccatctcggtgagatgcagaggcacartttggggagagcatgtccttgaattagtccagcagggtcatagccactgcctcatgcacagaacatccttctagaagctgtgagctttggtacctctgtc

SEQ ID NO: 16158 - DNA, 201 bp, Homo sapiens; identical to SEQ ID NO: 2655

SEQ ID NO: 16159 - DNA, 201 bp, Homo sapiens
gaactgacttttgagatgctgaccccacactggccagttagctctgggccctggagggaagctggtggggatgggctgacgggacatcctgaaaaacaagycatctccactcttggtagtttaaaaatgttttaagaagttaaggtatttcaacaattcctttctgagtgattgccacttagttcattaacttttgcaaaa

SEQ ID NO: 16160 - DNA, 201 bp, Homo sapiens; identical to SEQ ID NO: 2656

SEQ ID NO: 16161 - DNA, 201 bp, Homo sapiens
agtttgagatcccatggtgccctggcctaaatgctacaagccctgggcctcctgatcccccagccctgctgctgcgggagttggaggtcatctcggccttscttgcaaacaccctctgcctgtgtcattccagagctgcagcagttctataacagccagggccggcttcctgacggcagggtggtgctgtgctttggggaa

SEQ ID NO: 16162 - DNA, 201 bp, Homo sapiens
ctcccatctagattgagcagctgtatgtccggcaactggcagaagaggctgggaagagctgtggagccggctctgtgatgcaggcccccgaggagccgccrccagaccaggtcttccggatgtttccagatatttgtgcctcacaccagagatcatttttcagagaaaaccaacagatcaccgtctaagtgcgtcgcttgg

SEQ ID NO: 16163 - DNA, 201 bp, Homo sapiens
aggtgacgcggaagctgttcgggcacctggagcgcggggtgctgctgcacagcagccggcagggcgtgttcgtcaagcggctgtgccagggccgcgtgttytgcagcggcaacgccgtggtgtgcaaaggcaggcccaacaagctggagcgtgatgaggtggtccaggtcttcgacaccagccagttcttccgaggtctgt

SEQ ID NO: 16164 - DNA, 201 bp, Homo sapiens
gcaccgtcatcgtgtccctcttgtccacagcattctcccagatggtgatcagcttctactatgggggcaagctggtgggccaggccaccaccacctgcccygagggctgccgcctgtccctgagccagcctgggctgcccggcaccaagctgtatgggcccgagggcctggagctggtgcgcttcccgccggccgacgcca

SEQ ID NO: 16165 - DNA, 201 bp, Homo sapiens
tttggagaaggagcgattggggttactccctgtacaccacacctgggtggctctgagcttgcttttctgtttctcctgcaggcgtgccgctggtgacgggrtacaccacctacgacgcgcaccattcaggtacggggtggtccgggctgagaggggcgtgggcactgtttgaagacaaagcccagataacccaagcagggt

SEQ ID NO: 16166 - DNA, 201 bp, Homo sapiens
tcactggtgtctcagagcttgtctgcgtgtccagggcgttgagggcaattggataacctggaacactgggtctgcaacaggcaggtcctggaaagggccargaaacttattagtggcccccaaagagcctagtaatttggccacatggtttgaatgctaagcctggtagatttaaggcctagggcctttcaggttgcaaag

SEQ ID NO: 16167 - DNA, 201 bp, Homo sapiens
gccaggaaacttattagtggcccccaaagagcctagtaatttggccacatggtttgaatgctaagcctggtagatttaaggcctagggcctttcaggttgyaaagtgaaacttgacttttgtctcctgagataaaggtgacaatatggttttacttacacatgaactgttcatttttacaaacactggagccccaggtggg

SEQ ID NO: 16168 - DNA, 201 bp, Homo sapiens
gaaattgaaaaaacattgagctcattttgtaccgaccctgagtacactgatgaggccctgatagcaactcatttaatttttaaaaagtactttaccttctwgacatgacgacaaggggggaaaatctagttaagtgaggattatgattcatggttattccaggcatcgtaacagtcctgaatgagttaaagctcacttagt

SEQ ID NO: 16169 - DNA, 201 bp, Homo sapiens
ttttttttttttttttgagatggagtcttgctctgttgcccaggctggtgtgcaatggcgtgaccttggctcactgcaacctccgcctcccgggttcaagygattctcctgcctcagcctcccgagttgctgggactacaggcccgtgccaccacgctcagctaattttttgtatttttagtagagatggggtttcaccat

SEQ ID NO: 16170 - DNA, 201 bp, Homo sapiens
gaggaatcctttcattttccagcagcttgcagaggaggccaggggaaaatatggtgaccacagaaggcctggatcatgagggttgggagtaaagctctcasatgaagttgtcaaagatggcaccatggccttcgttgttggagatgggatatgcctcagtgtgttactagatcctgattgttatttgggaactccgggatg

SEQ ID NO: 16171 - DNA, 201 bp, Homo sapiens
ggctggagatgatgacccctgggtccaagcatcctcaggatccggtgggtcctagaaatcctgggaaaatcttcctgaaagggcttcaccgggcagccacscatgcctgccacagggacactttctctccataaagaagcagctgtgggaatcaggaagaaatgactcctgtgcatgattcagactctccataatagaaag

SEQ ID NO: 16172 - DNA, 201 bp, Homo sapiens
tcatggtgtttgtctggttttctgtaggcaaactaggcgtggcaactgctggctgcgtgaatgaagttacagagatggagtgcggtcgctctgaaatcgaygagctgatcaaggaggtaagcagaggcagcatttcaggggtctggccctgccaggaggagtctcatgtcttctggcagggaggggcaccgttcttgctgt

SEQ ID NO: 16173 - DNA, 201 bp, Homo sapiens
tgagctcattttgtaccgaccctgagtacactgatgaggccctgatagcaactcatttaatttttaaaaagtactttaccttcttgacatgacgacaaggrgggaaaatctagttaagtgaggattatgattcatggttattccaggcatcgtaacagtcctgaatgagttaaagctcacttagtagcacagatatttctc

SEQ ID NO: 16174 - DNA, 201 bp, Homo sapiens
catcgtttgccctcagcttgacgtgtaaattacaacagttaccagaccttctctagaccttgtatttaaagagtcagtgaagaagtacagagaacactgtkgtagttaatatgttcagtcattggtttccttagtcattctgtgtatttattcatgcatataaaaacattacttctacaagcagtacatggatttccccag

SEQ ID NO: 16175 - DNA, 201 bp, Homo sapiens
tcactaagctcattgctagcgtatgtaattcttttggtttaaggcaattaaaatgcagatacctccctgcatttacatgttatctgcattcctaccttagwttagtgttttccaaactttggtcacttgaggtccagtgtcacaattggttttcacagcctggactgttactaacatcatgtttttcctcaaatcttaatc

SEQ ID NO: 16176 - DNA, 201 bp, Homo sapiens
aacttcaggtttaaattgagcatttccttttgttatgaatgtaggcagcagaccgcagtgcccttggcagtgcctatgagacggagtattgtcataagaartgagttgtcgaaacatcgtttgccctcagcttgacgtgtaaattacaacagttaccagaccttctctagaccttgtatttaaagagtcagtgaagaagta

SEQ ID NO: 16177 - DNA, 201 bp, Homo sapiens
ggaggaaatggggcagggatagaagcgtgctggctgaggactgcatgggacagttttgtgggtagcagaggtcggtgctcacccaggcaggaaaactgtcsagatggcaatgccctgtccatgaagctcttgtctatttcctggcagccctttgagctggggggttgttttcactccggcttcacagatgaggagactgag

SEQ ID NO: 16178 - DNA, 201 bp, Homo sapiens
ggtctgggcaattctttgttgtaagggttccctatgccttgtgggatgtttagtggcatctctgacctctacccaccagatgccagtagcatcccctcccytactgtcacaatcaaaaatgtcttggacattgccaaatatctcctggtggggcagagtcttcccctccccattaagaaccctgataagagctggccactg

SEQ ID NO: 16179 - DNA, 201 bp, Homo sapiens
gattgtttcaaactcgtttgcccaaagaggtcacattttaatcagaagaacaaaaatgctatttttttttttttttgggtgggcgtctatccagctgtctyggggatttccagcactgttcttggaaatgttggctctaagtcgataggtcatgctagttctctctctctttctctgtgctgttggggaagctgtctgctt

SEQ ID NO: 16180 - DNA, 201 bp, Homo sapiens
agagtcccattcagtcggttgggaactctgcattatagataaccccaaaagccggaatttctctgcctcgccactgttgatgtctgggtctgggcaattckttgttgtaagggttccctatgccttgtgggatgtttagtggcatctctgacctctacccaccagatgccagtagcatcccctcccctactgtcacaatca

SEQ ID NO: 16181 - DNA, 201 bp, Homo sapiens
tcagggaatgtggggccagctgggcatctggtagcccagttggttcttcggataatgggctgctcagtgaaggaacctggtgctgtaaaagtgattccccytctccttccagtcttgggctaaaactggagctgttcactgtggttgtatctgcctgaaaggaaagggcagatgaaagctggaaggagcacagccagcaca

SEQ ID NO: 16182 - DNA, 201 bp, Homo sapiens
gtgctgaatgtgtctcagacatgtacatgagctgatttcacatctcttgaattacggagtcacttttgtggtcgcttgtattctgatgaggagatcgaagsctcttttcttctcttttctgctgcttccttttcctgatgagccaagtgggagaaaatacttcgagaccttcacgctaagacctttccccacgggcttcca

SEQ ID NO: 16183 - DNA, 201 bp, Homo sapiens
accagatgccagtagcatcccctcccctactgtcacaatcaaaaatgtcttggacattgccaaatatctcctggtggggcagagtcttcccctccccattragaaccctgataagagctggccactgccaggatcaacagacttaaccagaggtgttgggtgctgaaggcacagttgcaggttggacatcagtaaaacatc

SEQ ID NO: 16184 - DNA, 201 bp, Homo sapiens
gcttcatgtactcaaaaatggactttctttcccaattatttcccaacaccatagtagtctgctgggaaggaatgaggtattcagcagcaagaacatgttgygtttgtcctctttatttgggtttgttctgttcgaggtcgtgccatagacccagtacagcatgtagcctctgaaatccggtgtgaatatctgttcttagaa

SEQ ID NO: 16185 - DNA, 201 bp, Homo sapiens; identical to SEQ ID NO: 2676

SEQ ID NO: 16186 - DNA, 201 bp, Homo sapiens
gctctctctaggcatgagtgtcggtgcactggtgagctttcagtcaataagctaaacatcttgtgtttggttttatcgggtgacaggttccagatgtgacractgtgcctcaggatactttggcaatccatcagaagttggggggtcgtgtcagccttgccagtgtcacaacaacattgacacgacagacccagaagcctg

SEQ ID NO: 16187 - DNA, 201 bp, Homo sapiens
cctgagccattggtcaattgttgtcgatggttgacaccttcccattttcacagtgaagtgagtattctaaatgccacatcttgtcactgaggttcatgatyaagtagatcagctagcattgcttattcccttctagcctgtgactgtgaccccaggggcattgagacgccacagtgtgaccagtccacgggccagtgtgtc

SEQ ID NO: 16188 - DNA, 201 bp, Homo sapiens
acttcggtaggcatacacaatcattacatgaatgggaacacacctacatatacacttaccagaaaagtacatttgttatctatgaacagaaattcttacawctcaacattaaaggattcctttaataaatctaaactactccgttagcatggatgctaaaaataagtggagataggttttcaaggaataaaaggactctga

SEQ ID NO: 16189 - DNA, 201 bp, Homo sapiens
aaatacagaataaccattgtttgccatgccctcagggggttagcatagtggagcggcaatatatccaggaccggattccctcctggactggagccggcttygtccgagtgcctgaaggggcttatttggagtttttcattgacaacataccatattccatggagtacgacatcctaattcgctacgagccacaggtaaaga

SEQ ID NO: 16190 - DNA, 201 bp, Homo sapiens
tttcaagtcaccatttcagagccagacgttgactgctgacttttttcctttggaattatcgatgcagagctttgtttttaatttttattttttggatgcaygaaggttgactttcgttgttgtctttcttttttgtttgggggcagatatgtcgtccttcctcggccggtgtgctttgagaagggaacaaactacacggtg

SEQ ID NO: 16191 - DNA, 201 bp, Homo sapiens
aatagaggaagcctactggccacagaacagagagtgtgtttacagatgaaagtcaaattattatggcttgttaaaatgagtatctcatttaaaaaatactrttcttcatcttcatgatttgttcatcttaaagattaggcaacaacttttgctatgtatgctctcctttccaagagaaagtttctgattctctgccaagta

SEQ ID NO: 16192 - DNA, 201 bp, Homo sapiens
tcaaagaagcatttgggttttctacacgtttgcttgcttaaacccatgccatggggcaccactgtaaggatgtttggccgttctcatttcttcacagcttsttctcatgccatactgtaaatcactggacatcttcaccgtgggaggttcaggagatggggtggtcaccaacagtgcctgggaaacctttcagagataccg

SEQ ID NO: 16193 - DNA, 201 bp, Homo sapiens
cctgtgctagacaggcagctcatttctgcaggtaaaattatattcatctcccaactttcattccaaaattgaacctatattactgaggccaaaaagggaaraggataaaagagaatgtcagaaaaaagaaaatcccatgtaagaaataaaaattatttaaattgcccttgcttttagtaaatagaaatgcctaagtaaagt

SEQ ID NO: 16194 - DNA, 201 bp, Homo sapiens
tggaggctcactccgtaatccccagcactttgggaggccaaggcaggtggatcacttgaggtcaggaattcgagactagcctggccaacatggtaaaaccktgtctctactaaaaatataaaaattagctgacatggtggcatatgcctgtaatcccagctactcaggaggctgaggcaggagaatcgcttgaacccagga

SEQ ID NO: 16195 - DNA, 201 bp, Homo sapiens
ccacgtgcagccgcctccacccactgcctggaaaacaccttgttgcccttttaagatccagtttggcccaggcgcgggggctcacacttgtaatcccctcrctttgggaggccaaggcaggtggatcacctgaggtcaggagttctaaaccagcctggccaacatggtgaaaccccatctctactaaaaaatagaaaaatt

SEQ ID NO: 16196 - DNA, 201 bp, Homo sapiens
gagcccgggaggtcaaggctgcagtgaactatgattgtactagtgcactccagcctgggcaacagagcaagactctatctcaaaaaacaaaacaaacaaamaaaaaaaagccacaaaaaactcataggtcttttgtttattataaatttggaggcaactgtgcagcaatggcaggcctgggaaggttgatgactaagcaga

SEQ ID NO: 16197 - DNA, 201 bp, Homo sapiens
gggcaagggtgcaaaggctcatttgtttgttcaggctttcccctgaaagagaagatgttagtatttgttctgagccagtttatttgacagattcttttttyctctggcgttgtttttcattgtggaaatgcatccaaaggtttccccatcagggataggtttttctaagttgtggtataactaacatatgtggtagactct

SEQ ID NO: 16198 - DNA, 201 bp, Homo sapiens
gcctcctgggtttaagcaattctcctgcctcagcctcctgagtagctggaactataggcacatgccaccacacctggctaatttttgtatttttggtagargcaggtttcaccatgttggccaggctggtctcgaactcctaaccgcaagtgatcctcccaccttggcctcccaaagtgctgggattacaggcgtgcctac

SEQ ID NO: 16199 - DNA, 201 bp, Homo sapiens
tccacaaaatgtaacatctttcattttgatcaatcccaaaggaaggggcagaatcatagcccccactcctccccccactgccttccttcatctacagaaartgtcttgatagtaatagtaacactatgaataagcagcaagatgtaattttttcaaagactctgtcaacatggatatgaccccaagtcaaatggttcctcc

SEQ ID NO: 16200 - DNA, 201 bp, Homo sapiens
gactgtttgtttgtttgtttgtttatttttgaggcagagtctccctctttcacctaggctggaatgcaatggcgcaatctcagcttactgcaacctccacstcctgggttcaagtgattctcctgcctcagcctcctgagtagctgggattacaggcacatgtcaccacgcccagctaattttttgtatttttagtagagg

SEQ ID NO: 16201 - DNA, 201 bp, Homo sapiens
ccggcgcctcgtccccagcgaagcgccggtgaccctcgcgcgtgcacgcacacgcactctcgcttcccaagctcacagatctccacgcgcacactcacacygaggatgcgcgggctgccgcgtgcacgcgggttcacgtgcgtgggtgtgtggccctttgggggtcagcctccctgcgccgggctccggacacgtcgaagt

SEQ ID NO: 16202 - DNA, 201 bp, Homo sapiens
tagattggacccacccagatcatccaataatcgctccatcttgatgtccttacccttaatcacatctgcaaagttccttttgccatatgaggtaacatccyacagataacagggatgaggatgtggacatctttgggggccattattctgcctcacacaggccttatttattttatgtccttattctcccttactgattta

SEQ ID NO: 16203 - DNA, 201 bp, Homo sapiens
gatcatgcctgtaaacaaacagtcactgcactccagcctgggaaatatagcaagaccctgtttcttgaaaaaaattgttctgaaaagcaaattagaaaatmattataggtgagatgtggcttgatgatgcaagttaataattggggttctgtttttcaggggccctagggggcaggaagtgttttaggttagtaacaataa

SEQ ID NO: 16204 - DNA, 201 bp, Homo sapiens
aaagtttcataattcagtcctagaaattcttggagctgtgagaatatcctgttcaggaatgtgacttctacaaaagctcccaggaaatttcagaaaaaaahatatataatcttctaattcaaaagttgattgatttgccaaatgacgcagcaagatttgcttctctaaaagcttctgataaggtctgcaagggaagaaatt

SEQ ID NO: 16205 - DNA, 201 bp, Homo sapiens
tttagaatgcatggaaaacttaatgttttttataagaaatatactgtgactaccagatattaaaagtactcattacgaatttttcatagggatctagcacyttgctctaaaaatcctctttatctcttaaaagaagtaatgcaaacataattccattaaattcttttgtttctcagaaagttaatgttttcgttccaattt

SEQ ID NO: 16206 - DNA, 201 bp, Homo sapiens
ataccttccaaaagtttcataattcagtcctagaaattcttggagctgtgagaatatcctgttcaggaatgtgacttctacaaaagctcccaggaaatttmagaaaaaaatatatataatcttctaattcaaaagttgattgatttgccaaatgacgcagcaagatttgcttctctaaaagcttctgataaggtctgcaag

SEQ ID NO: 16207 - DNA, 201 bp, Homo sapiens
gtactgttattcagttaattctatgtaattagacccatccttgaagatcattttaaagaaaaattgagtgctcagtgaaattgattcttttgtcatgggcycaactgcttactttggctagcttttaaaagtcaatgtttattgattctactttgaaaggagatcagatgtggatcctcaccagttgcccagatatttttt

SEQ ID NO: 16208 - DNA, 201 bp, Homo sapiens
tttgtgggtcagaagaaaatttaggcaaccatcaattctatatgttgttaataattaccggatgtgcatgacagactctagctatatcttcacaggatgckccatattccaaagcaagagcagcttcatttaccatttctccagcaccctttaaaataacaagccaagtaaatttgcttccaaggcaaaaactacatgcta

SEQ ID NO: 16209 - DNA, 201 bp, Homo sapiens
gaaaaaaattgttctgaaaagcaaattagaaaataattataggtgagatgtggcttgatgatgcaagttaataattggggttctgtttttcaggggccctrgggggcaggaagtgttttaggttagtaacaataagaaacaaagagaacctctaactaaactgtgttcatgaaagcttatcagaaacaattcactcaaact

SEQ ID NO: 16210 - DNA, 201 bp, Homo sapiens
agtgaggaaatatgtaaataaataataacatgccacagacctttccaagccctgttgcaaaagagcacttagatgctggcatggggctctcgacacctacrattgaagtgggagtcccttttcctagtcaatggagaccttctcaggtaaacagttcattcctacttctaagtggcagctagaaaaaaaagatgacaactg

SEQ ID NO: 16211 - DNA, 201 bp, Homo sapiens
actgtaacgaaagactgaaggtgacggtgtaacagcagagagatgcatgatcctagaagatgggcatgcaccagccagcccgagccagggctaccaaaacrttttcctagagaatcagagctaggccttaaagtgtgaatggaattgtggaaagttggcacaaaagtaagaaatagtgtgagtggaagagagaagagaggg

SEQ ID NO: 16212 - DNA, 201 bp, Homo sapiens
ctgtatatcatttagccagaaataatagacttagtgaggaagtaaggattcattcagaacaaagttcacaatggactaaaatgtgagaatacctgcactgrgaagcaaggctgctagggccaatatttgatcagtaaatatttgctgaagagtatgaggagtgtggctcattggaaagcaaagagtcggcaccagaaagag

SEQ ID NO: 16213 - DNA, 201 bp, Homo sapiens
gatgccttcttctctgtgaagtattcctagctttttttttcttggcagtaaaatatccataacagaaagtttaccattttaaccatttttaagtgtataawtcaatggtgttaggtatagtcacaatgttgagcaaccactaagactgtctatttccagaactttttcatcaccccaaacagaaattctgtggccactgtc

SEQ ID NO: 16214 - DNA, 201 bp, Homo sapiens
gattcatggcatcattgttcgccaacttctttgttcctttcatccagaagaaaggtcagctcattacgtaagaaacttttcatcaggaaaagcaaacaacygataaaaaacagaaactaagtattctgcaaggaaacctggtttaaggagaatgtattgaaactggatatgtctgttcctttttactcctccctttggcat

SEQ ID NO: 16215 - DNA, 201 bp, Homo sapiens
gattttcccccctttccagcccaccccccgcttccgtgggagcgacaggaaatggaagggcgcctcttctctctttgaacatttgccttttttcccctcckttccacctctccagaaaggaagacgggaagaaagggcaggcggctcggcgggcgtcttctccactcctctgccgcgtccccgtggctgcagggagccggc

SEQ ID NO: 16216 - DNA, 201 bp, Homo sapiens
gggagtgtgacaataagtaaatgtgatgttcttttgcagagtgtgtctgtaattacctgggcaccgtgcaagagcactgtaacggctctgactgccagtgygacaaagccactggtcagtgcttgtgtcttcctaatgtgatcgggcagaactgtgaccgctgtgcgcccaatacctggcagctggccagtggcactggct

SEQ ID NO: 16217 - DNA, 201 bp, Homo sapiens
cagtgcatgcctgggtttggaggccgcacctgcagcgagtgccaggaactcttctggggagaccccgacgtggagtgccgaggtgagttgtgggcgttctygcattgacttgatcagagagtggagggaactggggttctacaagagccttctgtaaattataaaacacagtacaaattaacgtgtctataagaacctgta

SEQ ID NO: 16218 - DNA, 201 bp, Homo sapiens
atgttacaaattactgaattggtttgaaattagtaatggatacagtactagtagaaaatatgaaacgtgaaagttctcccttgggtttattttatgtaagyaagcttaactttctctttacaggaaactgattaaagatgttacagaaatgatggctcaagtagaagtgaaattatctgacacaacttcccaaagcaacag

SEQ ID NO: 16219 - DNA, 201 bp, Homo sapiens
gaaagccatggacttggaccaagatgtcctgagtgccctggctgaagtggaacagctctccaagatggtaactcagtggatggcctcagtttttgttatgyatgtttgctttcagctgtggactaaaggatctgaaagggagaaatcaattctaaatgctaactgaaatgaaaagggcatatcacaatcaaatatgaaagt

SEQ ID NO: 16220 - DNA, 201 bp, Homo sapiens
gaagttactaaaacgctagttaatagatcttttctgtcaccatatttactggaggagttaacatggtgctggtgctggtcccaaagatggttcacaatagsttttttttttaaactctaactggttagaaaaaaaggaaggcattccttggcccttgcactggcagaattcaacttgatatagcagatgtttgcatcctgg

SEQ ID NO: 16221 - DNA, 201 bp, Homo sapiens
ttataacacaaagcaggaaagtaagctcgtggaaatctagaaaccctgtggaacacttttctgttattaaacattagaaagattaacttaagttttactcstgcctttctttatccaactcctagcaaaagtatctcaaagctgtgaggttaccaaatagtagtcagaagaaagaaataatatcatccagggaatcacaag

SEQ ID NO: 16222 - DNA, 201 bp, Homo sapiens
ctacaacttttctatagaaaagtaataatcaggagaatgaggacttagccctaaggatttgctgcaactccagaattttttgaaatgttctttaaaatcakgtcaattttgcattcaattccactgtttgaagataaaattttaaattacttaccagtgaatatccttggtggcccttaatccagaatgcatgccatgatt

SEQ ID NO: 16223 - DNA, 201 bp, Homo sapiens
aagcaagtcttcacaaatcctaatttagtcaagatccaaagagcctccacttcttcaatatgggcttctctaatgtctaatctacttttgaaaaatctgcrcttctctatgtaatttgcaatacaattatgctacaacttttctatagaaaagtaataatcaggagaatgaggacttagccctaaggatttgctgcaactc

SEQ ID NO: 16224 - DNA, 201 bp, Homo sapiens
gcatgcagaatacactttattttctgaagctttttgtttttgtaagccagataaatgacttatttagttgtaatttgagatataatggaattataattatyttaaaattattaggctaaatagttgattgtatttatttaaaaactacttttttgtactttttaataacaatacttgtttgggaatattctgttaactcct

SEQ ID NO: 16225 - DNA, 201 bp, Homo sapiens
tacctatgtgaaataatttggagggtattttttatagactaaggtttgtgttctcttagcccagagacacagagaaagttaaagatggaaggtacataggygcagaagagttcaaacttcattacagctttgtcttagtgatgcttcctccctcctctcatcactttctctgaaatagacaaaattggtcacaatataaga

SEQ ID NO: 16226 - DNA, 201 bp, Homo sapiens
tatgggtttccagccttcccctcttctgtttctctgtggtcctcaactaaagaatgaatcatgactattctcccatactgttttagctactcagtgacacygcactgaaacttgatcctttttacactgtggacatttctttaatattttttttcctaagtagagacagggtctcactacattgctcaggctagtcttgaa

SEQ ID NO: 16227 - DNA, 201 bp, Homo sapiens
acccatgcaactgcaatgctgctcattccttcgggccatcttgcaatgaggtgaggggctgctgctggggatgatgcctttatgagctcaggtgtcagccyatggtgactttgccccagttagagcaaggcaccagggcacacagcttgaaacacagcgtggcctggatcttagccctcatttgtaccccttggctgggtc

SEQ ID NO: 16228 - DNA, 201 bp, Homo sapiens
ctgttttgctgcagcagattcactatccgaagtattgtgcctgatccttggcttgttgcagacctgtggaacacccccaggggcctcctgttccgagactkaatgtggcgggccaaactgcagaactgacgaaggagagaggaagtgtggggggcctggctgtggtggtctggttactgttgcacacaacgcctggcagaa

SEQ ID NO: 16229 - DNA, 201 bp, Homo sapiens
aaaaactcagatattcggggtgagcattttttggtgcaaatagtcccagacaatggatttaacgatatgtctaacgttttaatatagcacttttggggaaraaaaaagttttctaataaattttaaaacttttgctcatccagtttctggcacaaatgaggatcaaagtccccattttacaaatgtgggacttgggcacag

SEQ ID NO: 16230 - DNA, 201 bp, Homo sapiens
ctttgtttttaatttttattttttggatgcatgaaggttgactttcgttgttgtctttcttttttgtttgggggcagatatgtcgtccttcctcggccggygtgctttgagaagggaacaaactacacggtgaggttggagctgcctcagtacacctcctctgatagcgacgtggagagcccctacacgctgatcgattct

SEQ ID NO: 16231 - DNA, 201 bp, Homo sapiens
gcaggaggaatgcttgagatcatgagtttgagaccagcaagaccccatctctaaaattttttaaaatcataaataaaataggctgggcacaatggctcacmcctgtaatcccaccactttgggaggctgaggcaggtggatcacttgtcaggagttcaagactagcctggccaacatgatgaaacgccatctctactaaaa

SEQ ID NO: 16232 - DNA, 201 bp, Homo sapiens
gtgtgtttgctatttaggcctgtttataatcagcttctaaagagaaacagtttacttatccagtagggtggggaaaagtatacattttagaggttagacaytttccttgcaagaagagtctctgtggaacagcttgaattatttgaaatccagccacagtctgaaatacaaaccatatgcagttcaagtttgtggcatgca

SEQ ID NO: 16233 - DNA, 201 bp, Homo sapiens
ttcaattcttccgggtgtatacctaataatgtggaattgctcgattttccagcttcttgagttattaatttcttcctcttgcttttccaaagcacattgcrtgcaaccctactatggtgtttgacatagcatattgcaaattattgacacccatatctgcacctcattggactgtgtataacatatacaacatatagtcca

SEQ ID NO: 16234 - DNA, 201 bp, Homo sapiens
taactgtgcacagagtccccatcagacacatccatagcatttcagtagagggtcccagctgcagatgcagactcacttaacaatagacaagggtgtgctayttctcttcagtacctgggcgctgaagcagactcttttcttagcttctcgaaaggaaccaattagccatacccagcattgtaaaaagtgctgttgtttcct

SEQ ID NO: 16235 - DNA, 201 bp, Homo sapiens
tgtctgatgggtgtctccaagtggacatcacacatgtgactaattagcctacaaccaaatgctttcacgcctcttccacgttgtcgtcattggcaacacakctacctggctacccaagttcaggtgcctgtatttctttcctcaccctgccttttccactacaatctaattgatcaccaagtgtaattcaatagagtcttc

SEQ ID NO: 16236 - DNA, 201 bp, Homo sapiens
aagtgatttgccacttagaatagcagtcaagatgaggctcgctttttaaatatggcaggagagagtggggggagcatatttgctctactgaggggtttccrcaaaggtcagttcaagggtttctaaatactccagctgctcttcaagtttgttgtttggcctcttgtcaataggcgcttgtgctcattttgtgcaggagga

SEQ ID NO: 16237 - DNA, 201 bp, Homo sapiens
agtcccacgttgctttgaggcaaggtccacggcagaagaaaaccccattacctgaatcttagggtgtagcagtttctctgtcccaaggcaaatttaagttkccaacaaaaaggaggataatcagcccagtactgagtgaccaatggtatagagtggggagtggacacagagagaacagctgatactgttctgccacttgca

SEQ ID NO: 16238 - DNA, 201 bp, Homo sapiens
ttttacctacaatattatgctaacacttacttgagaggccaggacatcctgtaaatgaatcaccagattctgaaatcagctttgaccaaaatgagaatcasactgtttgtattaaaagcaactggaaagactatcctctcagtgatgatttctatagttcgttactagagaagtttctctaaacatgtagagagcatcaga

SEQ ID NO: 16239 - DNA, 201 bp, Homo sapiens
acaaaaatgtttctaactatcttataataacaatgagaactggagtgctttgataaatcttttcctacctgaatggaattttctcatgttgaaactgacaytaattgctgtgggaagcagatggcattgtgctacttcaaattactgtctgcccgcaggttccagcagtcatgcagctgcgttcttataatttctccactt

SEQ ID NO: 16240 - DNA, 201 bp, Homo sapiens
gtggaccaaaatgttgcttaaaaacttgaaatgttctctccttaggttgtagttattctatagcgttaacactattttggtaacttggatgtcatttaagyggtgggaaatttcaaattttcccttccaaaaatagagacaaaaatgtttctaactatcttataataacaatgagaactggagtgctttgataaatctttt

SEQ ID NO: 16241 - DNA, 201 bp, Homo sapiens
tcaccatattggtcaggctggtctcaaactcctgacctcatgattcacccgcctcggcctcccaaagttctagaattacaggtgtgagccactgtgcctgrccaggactcttaaatttttaaaatgaccgttttctttttttggacacaactacagcaagaaataatacagatcttcaagttggcaactcattcaatatct

SEQ ID NO: 16242 - DNA, 201 bp, Homo sapiens
attaaaaaaagtagagactaccaataaaaaacatcaaatgagatttttgctcctgcctttagacattccgtccagctgctatgctgatagaacgatcgtcygactttgggaaaacctggggtgtgtatagatacttcgcctatgactgtgaggcctcgtttccaggcatttcaactggccccatgaaaaaagtcgatgaca

SEQ ID NO: 16243 - DNA, 201 bp, Homo sapiens
tggtttcctagggatgccataacaaagtgtcacggactgggtggcttaaacaacagaaatgtgtcttctcacagttccataggctaggaatctcagggtawggtgttggcagggttggtttctgctgaggcctctctccttggttcgggatggctgtcttctccctgtgtcttcacatggtcttccctctgtgcatgtgtg

SEQ ID NO: 16244 - DNA, 201 bp, Homo sapiens
tgggagggagttcaggtaagaacaacaatgtgaagcacaaggccgcaaggatgttcttgaaaccatcacagagtccatgctgggaaggattactccaaggytcacttcaaccagtgtattgagagcagtactctgttgggcaccaaggatgtgagtagataagacacagtccctcttctgcaggctgttgtgttgcagggg

SEQ ID NO: 16245 - DNA, 201 bp, Homo sapiens
agtatagactccggagttgcaaagaactgaatcagaattctggcgtggccttttccttgcagtgagacttggggcatgttacataatctctctgatctctsagttcccacatctgtgaaatagtgattattataacacgtatcccatagggttattgtgagagttaaatgggatcattcatataaaacatttctgtttaaa

SEQ ID NO: 16246 - DNA, 201 bp, Homo sapiens
aaaggcctgattgtgtgtgtgttttttaaaactttagttttggaagtgtgcattaaaggtgatttatcctctttttaaaacccttgggtttccccaccccyctctaccgcatcttcacttgagtaaagaggattccagcaatgacaggcgtcttgcaaggtgattccaatcactgaacgaacccgttttcctctcctcatt

SEQ ID NO: 16247 - DNA, 201 bp, Homo sapiens
aactggatacttagaattcctttgggttttgttttgttttgatcatgtttattgcatttcatcaagtatgttttgttgtgagatagagtcaggtacgtaargagcttctcatttgtgatgtatccgatgccaggtggcacattatcaggatgtaacctggattgtttgtacagacatggtctgtggggaaatcctaagtaa

SEQ ID NO: 16248 - DNA, 201 bp, Homo sapiens
gcacagccactgtgctaagtaatctcagccacagctactggccaagaacacattttgtcctgtacggcacgtgattttcctgtgccatttggctttgcatraggtgccaaccctattgggcctgtgagacgctgagactgaatggctcccaagatccctgcttgtagtactggcagtggtcatcacaatggcagacacccc

SEQ ID NO: 16249 - DNA, 201 bp, Homo sapiens
tgcacagctgttttgctgcagcagattcactatccgaagtattgtgcctgatccttggcttgttgcagacctgtggaacacccccaggggcctcctgttcygagactgaatgtggcgggccaaactgcagaactgacgaaggagagaggaagtgtggggggcctggctgtggtggtctggttactgttgcacacaacgcct

SEQ ID NO: 16250 - DNA, 201 bp, Homo sapiens
ttactcttttttttcaacatactatccaaggatacatgttttaggaaccaaagtggccttattttaaaatacgatgttagatttgcttgttttaaaaaaaattgtatcattttatgagacctgagaagaaatgaaagccttctgtgagtcatataattaataaaagcaaagcactgaaaaaagaaactatgtatattagcc

SEQ ID NO: 16251 - DNA, 201 bp, Homo sapiens
tctgacttttcctttgtgactcccagaacacatgttgaatcctttagtaaatgactcctcagttcaaagctgtcatcactcctaaagtccttcttgatgakataaaagtggcatatgcaattccccaaattatgtcataaactcaggaatgtcctatgattcttaaccctaagtaagttttgttcctacactcccttcctc

SEQ ID NO: 16252 - DNA, 201 bp, Homo sapiens
tacagacctagaggattttaaggccagataggacttatgagatcacctagaccaactattggtgatagagcccaaggattaagtaatttactagagagccytaagtaaatgagcagcaggtggaagctcaagcctctcctcactcagccccagggttccttcccctaagctgtggcctcccctcatgaaggctgtgcttat

SEQ ID NO: 16253 - DNA, 201 bp, Homo sapiens
ctaaaacaaattctagtagtactcaattgtctgcagttacttttttgtgtgtgtaggtctcatctcccctcaaaatcccagatagattataaactcttaawcaggaagttagtgtctcttggtgtgtaaccccaccatgctagtccatagtagatgaccagtaagtggttgaatgaatgaaccatctattcttttcacctc

SEQ ID NO: 16254 - DNA, 201 bp, Homo sapiens; identical to SEQ ID NO: 2673

SEQ ID NO: 16255 - DNA, 201 bp, Homo sapiens
tctaaacttcaaatttttgaataatcatgacgttattggcaaatacatataaataaacatataaccggaacacgtttttcccctttatccaatggaaataygatcaagcatcactcttagcagaagactaccagacacttgtagggacacgaaaagtgataataaaaacaatttatttattgaatgcttgctatagaccag

SEQ ID NO: 16256 - DNA, 201 bp, Homo sapiens
agggaggctctcgctgctggacagacctgatgacgtgtgtgggtttctttccgtgtccttctcctttcggagtccctgccttcccagcctctcctgcgctyatctctccattgtcttttctgtgcattttgctttcttccgaatggactgtcctctctccgcacccactcccccgcccccgcttgttcgtttttttcgggc

SEQ ID NO: 16257 - DNA, 201 bp, Homo sapiens
aactggataaaaacaatataaaacagtttttcctgcagaactcttctgagtctgtaatatgctgacacttgtttttaatcttcaagataaggatacagaayttttcatcatgggatagttttttcaaggaacacatcatagaacgtatggtctacggatcaccattaaagttatccatggtttgcctaaacagcttcctga

SEQ ID NO: 16258 - DNA, 201 bp, Homo sapiens
aaactttctaattcccttctttgggctcgggggctcccggagcagggcgagagctcgcgtcgccgggtgaggagaacaaagtggctgcacgattttccccmctttccagcccaccccccgcttccgtgggagcgacaggaaatggaagggcgcctcttctctctttgaacatttgccttttttcccctcctttccacctct

SEQ ID NO: 16259 - DNA, 201 bp, Homo sapiens
tggctgaactggttgttgacttctggagagagccgaagctctgctagctcattggaactcttacccaggctaatttccctcggccagataaagagggaagmcttatctgccttttaagtctttcagggttgggctgttttccccttaaagatgcctatgacagaatgggagcaagacatgtctttggcaacgaaataaatg

SEQ ID NO: 16260 - DNA, 201 bp, Homo sapiens
agtccctgccttcccagcctctcctgcgctcatctctccattgtcttttctgtgcattttgctttcttccgaatggactgtcctctctccgcacccactcscccgcccccgcttgttcgtttttttcgggctccactccctgcttgtgtccccccaactctgttgcctgtccttcccgcagccctgtgcagagcccgagtg

SEQ ID NO: 16261 - DNA, 201 bp, Homo sapiens
tttgaactcaccgtggtgaagccccgaaccctcccttgatgcattgcttctgcatctcttttagcatttattttgctcttatagttgtgttaaaaaggtcyctttggacagagattatgtcatctttgtttttgcatctcacttggcacccagcacggtggacctggcaggtactcaataaatgagggactaaaatttatt

SEQ ID NO: 16262 - DNA, 201 bp, Homo sapiens
ggaaatccctcttcgcacagctgcttatttgtgaatgttctttagccaaagtttgcaggtgtccttaaaatgctttctcaacacatcatgctccttggggrggtggggttttttgtttttttttactgtcagaaaaaattttacatcaatctcagcttagatcatcagaagtactgaaagaatgaagtgaatatatgaaat

SEQ ID NO: 16263 - DNA, 201 bp, Homo sapiens
tggggggagcatatttgctctactgaggggtttccacaaaggtcagttcaagggtttctaaatactccagctgctcttcaagtttgttgtttggcctcttktcaataggcgcttgtgctcattttgtgcaggaggatttgtgcaggagaaaatgttggcgttcataactgccattcagttggggagtaccacggtttctct

SEQ ID NO: 16264 - DNA, 201 bp, Homo sapiens
aaaggactcaaccatctgctccctttaaggtgaaatttgtgggacttggaggatgtgttgtctttataattttgattcttttgtcttttgtggttaaatgrcatcggagaatctttttctatgttacggaagcatgcatgttagctgatcatgcatttgatttactttgtaatcaagggagcaatatctctttagttgtct

SEQ ID NO: 16265 - DNA, 201 bp, Homo sapiens
aactggcttctggcctgaagcctgcttgaccaaggtctgtgttctggccgcagttcacggggcagtgccagtgcatgcctgggtttggaggccgcacctgyagcgagtgccaggaactcttctggggagaccccgacgtggagtgccgaggtgagttgtgggcgttctcgcattgacttgatcagagagtggagggaactg

SEQ ID NO: 16266 - DNA, 201 bp, Homo sapiens
gcgctttcaggctacccagccggcgcagaggatcctaagcctcagcagaggcaaaacctccccaggctgtagcagggcaagtgctgatttggtgaataatkaatgcctcactcacctagaccccaaggctcccgcctgcctcagactcgtgcaggcttacgaactcgtaaagcagctgactctatggtctaatgattaaac

SEQ ID NO: 16267 - DNA, 201 bp, Homo sapiens
gagaggaaaggaaggaaggagagagaggaaagaaaaggaaaagagaggaaggaagatgggagggagttcaggtaagaacaacaatgtgaagcacaaggcckcaaggatgttcttgaaaccatcacagagtccatgctgggaaggattactccaaggttcacttcaaccagtgtattgagagcagtactctgttgggcacca

SEQ ID NO: 16268 - DNA, 201 bp, Homo sapiens
gtcttttctgtgcattttgctttcttccgaatggactgtcctctctccgcacccactcccccgcccccgcttgttcgtttttttcgggctccactccctgyttgtgtccccccaactctgttgcctgtccttcccgcagccctgtgcagagcccgagtgcgcgctcaggaacccgagttcagctacggctgcgcagaaggc

SEQ ID NO: 16269 - DNA, 201 bp, Homo sapiens
tctagagcaaaatggcacagcagacttttaaatcttcctccaaacttgtactcatagtaattccatttcttaaactaatgtcttgctggaaaattgacatrcttttagattgagtctgaaacagcagcttctgaggaaaccttgttcaacgcgtcccagcgcatcagcgagttagagaggaatgtggaagaacttaagcgg

SEQ ID NO: 16270 - DNA, 201 bp, Homo sapiens
ctaaacatcttgtgtttggttttatcgggtgacaggttccagatgtgacgactgtgcctcaggatactttggcaatccatcagaagttggggggtcgtgtsagccttgccagtgtcacaacaacattgacacgacagacccagaagcctgtgacaaggagactgggaggtgtctcaagtgcctgtaccacacggaagggga

SEQ ID NO: 16271 - DNA, 201 bp, Homo sapiens
gaatagcttgaacccgggaagtggaggttgcagtgagccgagatcatgccactgcactccagcctgggagacagagtgagactcttccaaaaaaaaaaaaagtttttcagaggcaaatcacagctattgacccaagagtggctcacacctgtaatctcagcactttgggaggccaaggcaggcagatcacctgaggtcggg

SEQ ID NO: 16272 - DNA, 201 bp, Homo sapiens
agaatagcttgaacccgggaagtggaggttgcagtgagccgagatcatgccactgcactccagcctgggagacagagtgagactcttccaaaaaaaaaaaaagtttttcagaggcaaatcacagctattgacccaagagtggctcacacctgtaatctcagcactttgggaggccaaggcaggcagatcacctgaggtcgg

SEQ ID NO: 16273 - DNA, 201 bp, Homo sapiens
ctcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagagga

SEQ ID NO: 16274 - DNA, 201 bp, Homo sapiens
actcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagagg

SEQ ID NO: 16275 - DNA, 201 bp, Homo sapiens
cctcttttactttagatcttgaatttgcaaggaaggaggaaattattttcaagactattttagactcagcaagttaaaagtgaaagatgtgatacaaatcwcctaagcaattttcacacaattatttttcttgaagctaataggttgatttttgtattaggagcttcatggggtttttttaattaaaaatgtttttaatga

SEQ ID NO: 16276 - DNA, 201 bp, Homo sapiens
cactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagag

SEQ ID NO: 16277 - DNA, 201 bp, Homo sapiens
attaaatactgtgaaagctaaatcttcttatttcattcttagtagatgctattttcttataaaaaataaaaaggctgttggtagaaggaggcccctctgayggaagagaggagtgtatgaaagctgatactggtggctcctgttgtctttgtggcaggctatagggcttcccctctgcatgttccatcttgaaggagatcc

SEQ ID NO: 16278 - DNA, 201 bp, Homo sapiens
ttttactttagatcttgaatttgcaaggaaggaggaaattattttcaagactattttagactcagcaagttaaaagtgaaagatgtgatacaaatctcctragcaattttcacacaattatttttcttgaagctaataggttgatttttgtattaggagcttcatggggtttttttaattaaaaatgtttttaatgagatt

SEQ ID NO: 16279 - DNA, 201 bp, Homo sapiens
accattgtttgccatgccctcagggggttagcatagtggagcggcaatatatccaggaccggattccctcctggactggagccggcttcgtccgagtgcckgaaggggcttatttggagtttttcattgacaacataccatattccatggagtacgacatcctaattcgctacgagccacaggtaaagaaaccacttagtg

SEQ ID NO: 16280 - DNA, 201 bp, Homo sapiens
ccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcaga

SEQ ID NO: 16281 - DNA, 201 bp, Homo sapiens
aataagcccatgggattattatttagtttcagcttcagcttaaggtagaatgcgaggataatttctatggggaacataaaagtaatttaaaaaatagtctsaactattcacagatgtttctatttacagtttcatttattgttttattttttttaaatctcctgtaggtgtggaaaatgtaactatccaactggatttgga

SEQ ID NO: 16282 - DNA, 201 bp, Homo sapiens
gagtacgacatcctaattcgctacgagccacaggtaaagaaaccacttagtggactggtggaggagggaggggagaatcagtagaaaaatagtacttctamtgggtattatatatagttatgaaatatggaggttgcattagaacagatcagattcctatagtctcacctcctccatggaagttaaaataaatgtaccatt

SEQ ID NO: 16283 - DNA, 201 bp, Homo sapiens
aattattatggcttgttaaaatgagtatctcatttaaaaaatactattcttcatcttcatgatttgttcatcttaaagattaggcaacaacttttgctatrtatgctctcctttccaagagaaagtttctgattctctgccaagtaatcccatttcttaaaataagactgctttatctaggtcatttggattctgattcct

SEQ ID NO: 16284 - DNA, 201 bp, Homo sapiens
atcccaacactttgggaggccaaggcgggcggatcacttgaggtcaggagtccgacaccagccggaccaacatggtgaaaccccatctctactaaaaataygaaaattaatcaggtgagatggcgcacacctataatcccagctacttgggaggctgaggcatgagaatcgcttgaacccaggaggcagaggttgcagtga

SEQ ID NO: 16285 - DNA, 201 bp, Homo sapiens
aactctgtttttatattctttctttcctacttgattttcttccctgtttttaattgatcattatggataaaaattttctgtagtttcttaagtgctctttsgtatatttgttgcacatctgaaattataggtctctgttggactcttgaattttttttttttttgagacggagtctcgctctgtcacctaggccggaatgc

SEQ ID NO: 16286 - DNA, 201 bp, Homo sapiens
gcctgtgacaaggagactgggaggtgtctcaagtgcctgtaccacacggaaggggaacactgtcagttctgccggtttggatactatggtgatgccctccrgcaggactgtcgaagtaagatgcacatttattctgcccacttcttagaatgacttccacctttttttcattatcagcagattttattcttcctgtattta

SEQ ID NO: 16287 - DNA, 201 bp, Homo sapiens
ctgctttcaatacccaattctagagaaacctaatagagcacttatagctaaacaatctgttctgtttagaatgcatggaaaacttaatgttttttataagraatatactgtgactaccagatattaaaagtactcattacgaatttttcatagggatctagcaccttgctctaaaaatcctctttatctcttaaaagaagt

SEQ ID NO: 16288 - DNA, 201 bp, Homo sapiens
ccaacctgggtgataaagcaaggccccatgtcttaaaaaaatgtaatccttggattaggatttctacatgaagctatgctttacattgttagtttgctccyaacatgctccacccccatgtgctcagaagctaaagtctcatgtgctaggacctaactgtccacagccgctgtggcctctggggcagttgcaacactgtta

SEQ ID NO: 16289 - DNA, 201 bp, Homo sapiens
atttaaattaattttacatgtggcccagcctgtctctggtctgtaatttactcattcattctcttgtaaaacaaatatttaatagatgtgtccagctctgrgccaatttctgagtgagccatgaggcctttcctgcatgtctcaaagtgcagttatgaaaaacgtccacaagggctctgggacagacaccccctaagtccc

SEQ ID NO: 16290 - DNA, 201 bp, Homo sapiens
ctaacttgctttctaaccttgggtgagttaggatatccagcttctagaaaatttttttgagacggagttttgctcttgttgcccaggctgaagtacagtgstgcaatctcagctcactgcaacctctgactcgcaggttcaagcaattctcctgcctcagcctcccaagtagctgggattacaggctttttgttgttgttg

SEQ ID NO: 16291 - DNA, 201 bp, Homo sapiens
agtccatgaggataaagcatttccataagcagggtagggagaggggaatggaatcagagaagcatcaaatacctgaaatgtatgtttttctctttgaaacrtcagaccatcctctgaaggtcactgggctttggtctaatgtcctgtgatatttgagctttgaaggcaaggggagaaaacattaatgacctcctgcctaga

SEQ ID NO: 16292 - DNA, 201 bp, Homo sapiens
ccaggtggtttataattaataaacagcaatgctttctagaaatcttaatgggatttctctggttttacaatactcactggtccaagaatatgtgctcccartactctgtctgtcgatttctgcccaaggatcttcaccatgccatctgtgtcagcatttgtcttagctctgctgttagcagcaaatgggaatttcccaact

SEQ ID NO: 16293 - DNA, 201 bp, Homo sapiens
ctttaaggcatccatagtttatttaaaagtgaaaaatatattcactttgtcttgagatcatcatagtataaattgctcagactttatatatatatatatcyccacagatttagaaagaaaatatgaagacaatcaaagatacttagaagataaagctcaagaattagcaagactggaaggagaagtccgttcactcctaaa

SEQ ID NO: 16294 - DNA, 201 bp, Homo sapiens
ggaatgtgacttctacaaaagctcccaggaaatttcagaaaaaaatatatataatcttctaattcaaaagttgattgatttgccaaatgacgcagcaagakttgcttctctaaaagcttctgataaggtctgcaagggaagaaatttaaaattaaaatccaaatatttgtgggtcagaagaaaatttaggcaaccatcaat

SEQ ID NO: 16295 - DNA, 201 bp, Homo sapiens
cattagaggccctctccccacctcagcatttgcacaccatggagaatcgtcgagatgagcgttgtggggaagtgcctctcatgagagatttccacttcctkgctgtgtcaactcttccacggcgagatgggaaacggagtcagtaacaataatagtgtcatttgaggaattacctgagctaaagccatcatctggatatag

SEQ ID NO: 16296 - DNA, 201 bp, Homo sapiens
aaggtctgcaagggaagaaatttaaaattaaaatccaaatatttgtgggtcagaagaaaatttaggcaaccatcaattctatatgttgttaataattaccrgatgtgcatgacagactctagctatatcttcacaggatgctccatattccaaagcaagagcagcttcatttaccatttctccagcaccctttaaaataac

SEQ ID NO: 16297 - DNA, 201 bp, Homo sapiens
tgaaaaagggttttaaactttcaattgattatggagaaacgtggctattcatacatctcttcctttgttctctcctgtttttataactttcaaggttcacrgacactgcatgtgcaggcataacaccaagggcttaaactgtgaactctgcatggatttctaccatgatttaccttggagacctgctgaaggccgaaacag

SEQ ID NO: 16298 - DNA, 201 bp, Homo sapiens
ttctacaaaagctcccaggaaatttcagaaaaaaatatatataatcttctaattcaaaagttgattgatttgccaaatgacgcagcaagatttgcttctcyaaaagcttctgataaggtctgcaagggaagaaatttaaaattaaaatccaaatatttgtgggtcagaagaaaatttaggcaaccatcaattctatatgtt

SEQ ID NO: 16299 - DNA, 201 bp, Homo sapiens
aaagcttttcttgacgttgctcttgtcacgcagaatgtaactgcaatgaacattccatctcttgtcactttgacatggctgtttacctggccacggggaaygtcagcggaggcgtgtgtgatgactgtcagcacaacaccatggggcgcaactgtgagcagtgcaagccgttttactaccagcacccagagagggacatcc

SEQ ID NO: 16300 - DNA, 201 bp, Homo sapiens
ttgacatggctgtttacctggccacggggaacgtcagcggaggcgtgtgtgatgactgtcagcacaacaccatggggcgcaactgtgagcagtgcaagccrttttactaccagcacccagagagggacatccgagatcctaatttctgtgaacgtatgttgagaaatgtcactcactgtgtgggacctacttcagattgcc

SEQ ID NO: 16301 - DNA, 201 bp, Homo sapiens
caggagtttgagaccatcctgaccaacatggtgaaaccccgtctctactaaaaatagaaaagttagccaggtatggtggtgcgtgcctgtcgcttgaaccygggaggcagaggttgcagtgagctgagatcacaccattgcactccagtctgggtgacagagcaagactctgtctcaaaaaaaaaaaaaaaaaaaaaaagg

SEQ ID NO: 16302 - DNA, 201 bp, Homo sapiens
ttagtatttttctaatattttgcgagttttcaagtcaccatttcagagccagacgttgactgctgacttttttcctttggaattatcgatgcagagctttstttttaatttttattttttggatgcatgaaggttgactttcgttgttgtctttcttttttgtttgggggcagatatgtcgtccttcctcggccggtgtgc

SEQ ID NO: 16303 - DNA, 201 bp, Homo sapiens
ttacaggcgtgagccaccacacccagtcaaaacgtaccattttcttgaatccagtttctcaaacgtagtgatcttttgtgaggcactcaaccttgctgacractgaggtggtgatgaggatgtatgagatcctctccttccctcacaacctggctgtgcagtgacagactgaagccccgaactgtaacgaaagactgaagg

SEQ ID NO: 16304 - DNA, 201 bp, Homo sapiens
tggcgatagtgagatttcttagatggcttccagcttccaaaaagaggaaacaagctgccagctctctgaaagcttggactcagaagtcctagaaagttcckcaggttctgttggtcacaagtcacaaggattcatggaaaggataacatagtttgcacctcttgatgggtaaggccacacacgggtacatacagatacata

SEQ ID NO: 16305 - DNA, 201 bp, Homo sapiens
tacagaaaactctcaagtgaaagggacttaatcaaaaaggatgtttattatctcacatcttaataagatatccagtagcaggatagcttcctgggtctgcsacccacatacttttcatctttctactctaccatcttaagcatatcagctttgtcctctagctcctcatggttacaaggtagctgccaaagttccagacat

SEQ ID NO: 16306 - DNA, 201 bp, Homo sapiens
atgtgccaccacgcctggctaattttgtatttttagtagggatggggtttcatcatgttggtcaggctggtctcgaactcccgacctcaggtgatccgccygccttggcctcccaaagtgttgggattacaggcgtgagccactgtgcctggcgatagtgagatttcttagatggcttccagcttccaaaaagaggaaaca

SEQ ID NO: 16307 - DNA, 201 bp, Homo sapiens
tgctctgggacagccaagctggagatgttcttcagggagctggatatttgagcctaaatctcaggaaataagcaaaagatgtaacatgccaaagcaagaargtttgggatgtggaaaaccttcatgtgatgcggacggcgtgttagtcaagagagggcaagggaggtaaaaccgagaagaccaggttctcagccacgcttc

SEQ ID NO: 16308 - DNA, 201 bp, Homo sapiens
cagaaagagaagccgttttcagaggatgggttatggaggctgcagaaagccaggcagaggcatcatggcttgatatcataagaaacaattgtgggttttcrtgaaacaatgaaagcagcactgtaggaagatcggttggcccgtggtagacaggatggactaggcagaagaggaagaagaatttgagaggtcagtttagga

SEQ ID NO: 16309 - DNA, 201 bp, Homo sapiens
caccctctttgctcctgttattcctgtcctctctctgcctgtcaagtcctctccaggctttaaggacacctctttcatgacgcctccctcagtcttctcartcagatgaatcatatcttcttctcccttagtgctttgcttgtaactctatcaatgcataggttcttactgcattttgatttgttgcattggttaatttct

SEQ ID NO: 16310 - DNA, 201 bp, Homo sapiens
ttactttaaggcatccatagtttatttaaaagtgaaaaatatattcactttgtcttgagatcatcatagtataaattgctcagactttatatatatatatmtctccacagatttagaaagaaaatatgaagacaatcaaagatacttagaagataaagctcaagaattagcaagactggaaggagaagtccgttcactcct

SEQ ID NO: 16311 - DNA, 201 bp, Homo sapiens
ccatgtctattatattgacaactaacctgaactttggaataattaaagaagtggccaggcgcgttggctcatgcctgtaatcctagcactttgggaggccrgcgcgccagatcacctgaggtcaggagttcaagaccaaccaggccaacatggtgaaaccctgtctctactaaaaatacaaaaattagccaggcgtggtgg

SEQ ID NO: 16312 - DNA, 201 bp, Homo sapiens
tgctgattgagtagaatttaaaaataaaagatttctaagatgttaaaaactagatatgtactccttagagaggcaatctctaaatgtgatcccagacactmcttagttactttgttgagggacagaattaaccataaaaatcactggaagtggtaaaagctttaagatgttttgtatagtgagctaaatggatttttggta

SEQ ID NO: 16313 - DNA, 201 bp, Homo sapiens
ctcctacctcccctctcttgcccctaaacatcccaactccttttgccaaaaaggaacccccaaaacagcacaataagacctaagtgctaaaggacaaaaayagaaaagggtatgaggcatctgtgcttccctagatgctatggttttttcactgcagactcaccatctaggcctgaggggactgcttcacagttaaatcct

SEQ ID NO: 16314 - DNA, 201 bp, Homo sapiens
gtcgaccatgtgactgtgaccttgggggagccttaaacaacaggtaaatggagctctacgtatgctcttgtcctcagtcttccaggaaagtcatgacttayaggaatgggtgacattcagttgtttctcaaaaagacatgcaaaatattttttgtatgtcttgataaatgtgtgtaggtacctctatggactagattccca

SEQ ID NO: 16315 - DNA, 201 bp, Homo sapiens
tctgattggacagtgtttgttagtggaagcctagagaattgaccttctcaaggatcatttatctaccctttctcctacctcccctctcttgcccctaaacwtcccaactccttttgccaaaaaggaacccccaaaacagcacaataagacctaagtgctaaaggacaaaaatagaaaagggtatgaggcatctgtgcttcc

SEQ ID NO: 16316 - DNA, 201 bp, Homo sapiens
tcctgggcagagctcatatagtattttaactcatttgggcagaagatattgatgagttgtaaacttccattgtttccttggaaataagcaggttagtttaytcctaaactctctgctcctctctccattctgtctcccaaacactgttttcaagcacccttgctgaggaccacctacacattctctggggccacccaggcc

SEQ ID NO: 16317 - DNA, 201 bp, Homo sapiens; identical to SEQ ID NO: 2670

SEQ ID NO: 16318 - DNA, 201 bp, Homo sapiens
cctcgggaaacagtctcagctggagagtcatggagagatttggtttcaccagattgtgtgaagccttcggtgctgggccattaagggtagactttgttcartgggcacaggaaggtctggaggaggagagggaaggatgtaaaggaagcaggcaagttaggtctatgtgataaatgggtacatagactatttcccattgtg

SEQ ID NO: 16319 - DNA, 201 bp, Homo sapiens
caggcttacgaactcgtaaagcagctgactctatggtctaatgattaaacttctctgggccttatttcgttacagctaagttaaaaactgaccagctagcygcttaaactcttctcccggaaatgactggaaaacaagccaagtctcctgactggactgacaactaactatactccctgaattccagccacatttgcccag

SEQ ID NO: 16320 - DNA, 201 bp, Homo sapiens
aacttttcagttgtcagaagagggcaagatcagtaggaaatggagtcattagggaagggtttgcagaaaagattagctctagtggccatctacagagaacrtgctgagtgccaagcacttttaggcatattatataagtattcttaattttatccttgcaacaaagaacctatgggggtaagtatcatctccatttcacac

SEQ ID NO: 16321 - DNA, 201 bp, Homo sapiens
tgaggaaatatgtaaataaataataacatgccacagacctttccaagccctgttgcaaaagagcacttagatgctggcatggggctctcgacacctacgaytgaagtgggagtcccttttcctagtcaatggagaccttctcaggtaaacagttcattcctacttctaagtggcagctagaaaaaaaagatgacaactggc

SEQ ID NO: 16322 - DNA, 201 bp, Homo sapiens
atgatccagtcctaactagatgggaagttactaaaacgctagttaatagatcttttctgtcaccatatttactggaggagttaacatggtgctggtgctgktcccaaagatggttcacaataggttttttttttaaactctaactggttagaaaaaaaggaaggcattccttggcccttgcactggcagaattcaacttga

SEQ ID NO: 16323 - DNA, 201 bp, Homo sapiens
tttgtatttttagtagagacggggcttcaccatgttagtcaggctggtctcaaactcctgacctcaagtgatccacctgcctctgcctcccaaagtgcagrgatacaaaagaggcatgagccactgtgctcagcctcttttttgtatttttaataagaaatgaatgatcatttcttgccaaaatttgccactatgaggtga

SEQ ID NO: 16324 - DNA, 201 bp, Homo sapiens
caatgcataaatgtcactggaaaatggaaatgcgattacagtaattcacaaactaatatttaatgctgggttgataattttacctgacttagaggcaggtrcctgaaaaaaaatcagtattctgttagcaagaaaaaaggcatggctaataaggagtcaacagtatttgctaaggatatcttaggtaatattttatggaag

SEQ ID NO: 16325 - DNA, 201 bp, Homo sapiens
ggtttattcacatggttagagttagaccaccaccactatgtcctcacctcaactcgggagaagagggaagacgaggcaagcaaattccatttaaagatgakacatgggccaggcgtggaggctcactccgtaatccccagcactttgggaggccaaggcaggtggatcacttgaggtcaggaattcgagactagcctggcc

SEQ ID NO: 16326 - DNA, 201 bp, Homo sapiens
ggctaatttttgtatttttggtagaggcaggtttcaccatgttggccaggctggtctcgaactcctaaccgcaagtgatcctcccaccttggcctcccaargtgctgggattacaggcgtgcctaccgcgcctggcctgttcccttctgttctgggaactgggataatcttgttgccctggcggatagtgggaacctgaaa

SEQ ID NO: 16327 - DNA, 201 bp, Homo sapiens
agtagagacgggttttcaccatgttggccaggctgggtctcgaactcctgacctcaggtgatccacccgcctcagcctcccaaagtgctgggattacaggygtgaaccagcgcgcctggcccaaataaaagttttgatggtaaacagcagccatggaataagtcttactcagaatctaaatattcagtgctaaatctacct

SEQ ID NO: 16328 - DNA, 201 bp, Homo sapiens
taggaaataaaattcatcaaggaaaacaaaatctggaaggaaatacaccaaaaagttcactgtaataattccaagtaggataattatgagataagtttttwaaaatctgtatttttaataacattgttatactttctaatttagggaggattcactacccccaaattattaccattaaatatgtatatttatatataatct

SEQ ID NO: 16329 - DNA, 201 bp, Homo sapiens
gccagattattatttgaaactcacgtggtctgtgtttctccacttcattttgttttaatacagcttgtgcttgcaatcctctgggaacaattcctggaggraatccttgtgattccgagacaggtcactgctactgcaagcgtctggtgacaggacagcattgtgaccagtgcctggtaagtaaatcctcattacgtggga

SEQ ID NO: 16330 - DNA, 201 bp, Homo sapiens
tgatttggtgaataattaatgcctcactcacctagaccccaaggctcccgcctgcctcagactcgtgcaggcttacgaactcgtaaagcagctgactctayggtctaatgattaaacttctctgggccttatttcgttacagctaagttaaaaactgaccagctagccgcttaaactcttctcccggaaatgactggaaaa

SEQ ID NO: 16331 - DNA, 201 bp, Homo sapiens
tgaaggccgaaacagcaacgcctgtaaaagtaagtctgtgttgaagggacattttaaatccattcaggctctagtatccatttcctaattagaggtactgyaacagtgtactgttttgcagagggtagaaaagttactgtcttttttccagcttcaccctgatactcctagacaaccaacaatctgcattcagttaattaa

SEQ ID NO: 16332 - DNA, 201 bp, Homo sapiens
aactggagttacaggcaagcgccaccacgcccggctaatttttgtatttttagtagagatggggtttcaccatattggtcaggctggtctcaaactcctgwcctcatgattcacccgcctcggcctcccaaagttctagaattacaggtgtgagccactgtgcctggccaggactcttaaatttttaaaatgaccgttttc

SEQ ID NO: 16333 - DNA, 201 bp, Homo sapiens
tgctgagatcgtgccactgcactccagcctgcgcaacagagcgcgactccatctcaaaaacaaacaaaaaaacagccaggtgtggtggtgtgtgcctgtartcccagctacttgggaggctgaggcaggagaatcacttgaacccaaaaaacagaggttacagtgagctgagatagtgccactgcactccagcctgggtga

SEQ ID NO: 16334 - DNA, 201 bp, Homo sapiens
gtatctctttaaccaatgaaacttctaagaaggacctatgcgagtctctctgggtcatttcaggaaggctattctttaaagaaaagaacactgagagtacwtttttcatgttcagcaacaatatactgtctcattattttttactcagcaaaagtgcaacagatgttaaagtcactgcagatatggtaaaggaagctctgg

SEQ ID NO: 16335 - DNA, 201 bp, Homo sapiens
aaattgatttagaggtaacttgtatttgagaaaaaataatttgccccacatcctaatactaagcttatttatgcttatgtcactatataatattgagaaaygtggaaacgttttgtaaaactgggacaaaaaagttgtggaccaaaatgttgcttaaaaacttgaaatgttctctccttaggttgtagttattctatagcg

SEQ ID NO: 16336 - DNA, 201 bp, Homo sapiens
tagatcctgttttagaaactctgcaaagagtgagattcatggcatcattgttcgccaacttctttgttcctttcatccagaagaaaggtcagctcattacrtaagaaacttttcatcaggaaaagcaaacaaccgataaaaaacagaaactaagtattctgcaaggaaacctggtttaaggagaatgtattgaaactggat

SEQ ID NO: 16337 - DNA, 201 bp, Homo sapiens
aagctgagaacagaagtttcactcttgttgcccaggctggagtgcaatggcgtgatctcagctcacctcaacctctgcctcccgggttcaagcgattctcstgcctcagcctcccaagtatctgggattacaggcctgcgccaccacgcccagctaattttgtatttttagtagagatggggtttctccatgttggtgagg

SEQ ID NO: 16338 - DNA, 201 bp, Homo sapiens
gcttgaacctagaaaacagaggttgcagtgaaccaagatcacgccattgcactccagcctaggcaacagagcaagactctgtctcaaagaaaaaaaaaaaataataagacctaattaatttaaataatctaactgaagccaagttaatgaagttttgcctagtagattacctgttttaatgaaaaagaattggcattggtt

SEQ ID NO: 16339 - DNA, 201 bp, Homo sapiens
ctttgggaggctgaggcaggaggattgcttgagcccaggagtaagagaccagcgtgggcaagatggcgagacaccatctctccaaaaaaaaaaaaaaaaaattttacaaaattagtcaggtgtagtgccgcaaacctgtagtcccagctgctgggaaagctgaagtgggagaattccttgagcccggaaattcagggctgc

SEQ ID NO: 16340 - DNA, 201 bp, Homo sapiens
gagggaagacgaggcaagcaaattccatttaaagatgagacatgggccaggcgtggaggctcactccgtaatccccagcactttgggaggccaaggcaggyggatcacttgaggtcaggaattcgagactagcctggccaacatggtaaaaccttgtctctactaaaaatataaaaattagctgacatggtggcatatgcc

SEQ ID NO: 16341 - DNA, 201 bp, Homo sapiens
aaacgctagttaatagatcttttctgtcaccatatttactggaggagttaacatggtgctggtgctggtcccaaagatggttcacaataggttttttttttaaactctaactggttagaaaaaaaggaaggcattccttggcccttgcactggcagaattcaacttgatatagcagatgtttgcatcctgggcagagctca

SEQ ID NO: 16342 - DNA, 201 bp, Homo sapiens
tcatagtgactgcatctgacctattcttggctattttatgtggaatgatccagtcctaactagatgggaagttactaaaacgctagttaatagatcttttmtgtcaccatatttactggaggagttaacatggtgctggtgctggtcccaaagatggttcacaataggttttttttttaaactctaactggttagaaaaaa

SEQ ID NO: 16343 - DNA, 201 bp, Homo sapiens
gacattcacataactcccaagtccagagggaaaaagaggtgttttttgttttttggttgtttgttttttcccaggaattccaacaaaaatcccagagtcaycttatctagaatatatgagtttcatatccatccctgaaccactcactagaaagaggaagatggaaatgcactgaatagcctggagttcatgggggaatta

SEQ ID NO: 16344 - DNA, 201 bp, Homo sapiens
ctgtatttttaataacattgttatactttctaatttagggaggattcactacccccaaattattaccattaaatatgtatatttatatataatcttaatayattcttaaaggagatttctggaagtctaaattgatgagcctggtcaggtgtgatgactcatacttgtaatctcagtgctttgggtggccaaggcaggagg

SEQ ID NO: 16345 - DNA, 201 bp, Homo sapiens
ccccacctctgggaatctattctaatgaaataatcagaaaattggacaaagatttattctccagaagactcattgcatcttttattaatcatagcagaagrcttggaaacaacagtggaaaaatagttaagtgtggggacttctatacaatgtaatatttggttgccactgaaaatgacaataacatcaggaaatgctcat

SEQ ID NO: 16346 - DNA, 201 bp, Homo sapiens
gtgggcatccatattggtttgtacttttgtgaaaagcattttggagatacatatcagtagcttgtagaaatgggcataccctttgacccagtaaccccacytctgggaatctattctaatgaaataatcagaaaattggacaaagatttattctccagaagactcattgcatcttttattaatcatagcagaagacttgga

SEQ ID NO: 16347 - DNA, 201 bp, Homo sapiens
ttgtctactttctttcatagtgactgcatctgacctattcttggctattttatgtggaatgatccagtcctaactagatgggaagttactaaaacgctagktaatagatcttttctgtcaccatatttactggaggagttaacatggtgctggtgctggtcccaaagatggttcacaataggttttttttttaaactctaa

SEQ ID NO: 16348 - DNA, 201 bp, Homo sapiens
catttcagaagcatttttatagctttgtcagtgagcacaaaataaggatcaggaccatgccttcctgagaagagtcatatttaaagctaagtaattctatmactcacaaattggctttggagcattcactgataaggcttttggttggtttaagaaatgtgtctttacaagaaacttttcttctctctacttatgctccaa

SEQ ID NO: 16349 - DNA, 201 bp, Homo sapiens
ctttgacatggctgtttacctggccacggggaacgtcagcggaggcgtgtgtgatgactgtcagcacaacaccatggggcgcaactgtgagcagtgcaagycgttttactaccagcacccagagagggacatccgagatcctaatttctgtgaacgtatgttgagaaatgtcactcactgtgtgggacctacttcagattg

SEQ ID NO: 16350 - DNA, 201 bp, Homo sapiens
gcggacggcgtgttagtcaagagagggcaagggaggtaaaaccgagaagaccaggttctcagccacgcttctggagtttgggattaatccataggcactayttttttccacatatgtattttctgaagaaaacaagaacatgctatgtatttggtcctgtgtactgagtaatggcagctgtagagctgcttctggcgggtt

SEQ ID NO: 16351 - DNA, 201 bp, Homo sapiens
actttctaaagaacaaacacgacaggtcgaccctgtttctaaagggttaacccgccttccccgagcgcaccgcacgagagttttagccgtgggcacgtttrgtgattcacttcttgcgaacgtaaatgcgcgagtccgcggtaggtcccgccggccccctggctgggcaacctgaaaacccacctcggagacgcccccacg

SEQ ID NO: 16352 - DNA, 201 bp, Homo sapiens
aaagtttgggagttttcttgtgtttgaaattcccattttactttgtaattccaaagccagattattatttgaaactcacgtggtctgtgtttctccacttyattttgttttaatacagcttgtgcttgcaatcctctgggaacaattcctggagggaatccttgtgattccgagacaggtcactgctactgcaagcgtctg

SEQ ID NO: 16353 - DNA, 201 bp, Homo sapiens
gcaggaaagcctgggcggaaagtgcccagctgctctcagggtgttttgttgaggggtaatgctgaggccagcgtaagcagaatcattctttcttgcctccrcggttactttgcttatactccaccccatggaaaggatttattccttctaaaaatataaaatgtcttttaaaaaaaacagcatttcactaggcgtagtgac

SEQ ID NO: 16354 - DNA, 201 bp, Homo sapiens
caggagacaaagttatgaagcatgaaatgccaattctctccatctttcccttcagcattgattccttccttacatattgtagttaaaaaaaaaaaatcagytatcacaaacaagttctgtgtgacctacaagaaacagctaagcatgctaaaggatttttgtcttgaaccggaggcatctccgtgggcggcagggagatgc

SEQ ID NO: 16355 - DNA, 201 bp, Homo sapiens
gatatggttgaatacacaagttcttgtcattgtgttacaattgcctatggtattcaatacagtaatatgctgtacaggtttgtagcttaggaacaataggstatactctacagcctgggtgtgtagtaagctataccatctaggtttgtgtaagtacactatgatggtcacacaacaacaaaattggcgaacaacacattt

SEQ ID NO: 16356 - DNA, 201 bp, Homo sapiens
ctgagatgacaggcatgtgccaccacacccagcttggacattccttttttagtttgttctgatttgaattataaaacccatctcagtgtaggaattcagartcattctagaaggggcttccattaaaaattaaagggagcaaaagaattttttcacgggtattagctattatgttcctttgttccagtaactttacctggt

SEQ ID NO: 16357 - DNA, 201 bp, Homo sapiens
gctctactgaggggtttccacaaaggtcagttcaagggtttctaaatactccagctgctcttcaagtttgttgtttggcctcttgtcaataggcgcttgtrctcattttgtgcaggaggatttgtgcaggagaaaatgttggcgttcataactgccattcagttggggagtaccacggtttctctgtttagtttttgattt

SEQ ID NO: 16358 - DNA, 201 bp, Homo sapiens
tttactcattcattctcttgtaaaacaaatatttaatagatgtgtccagctctgcgccaatttctgagtgagccatgaggcctttcctgcatgtctcaaartgcagttatgaaaaacgtccacaagggctctgggacagacaccccctaagtccctaaaaggactcaaccatctgctccctttaaggtgaaatttgtggga

SEQ ID NO: 16359 - DNA, 201 bp, Homo sapiens
accagcacccagagagggacatccgagatcctaatttctgtgaacgtatgttgagaaatgtcactcactgtgtgggacctacttcagattgccttccaaaytgaatagtcagtagtctcagagctcatagtatgagcagtaaagccagcattgttattgtaattgcagttgaagacgctgggagtggaatttacttggtag

SEQ ID NO: 16360 - DNA, 201 bp, Homo sapiens
agtttgggatgtggaaaaccttcatgtgatgcggacggcgtgttagtcaagagagggcaagggaggtaaaaccgagaagaccaggttctcagccacgcttytggagtttgggattaatccataggcactacttttttccacatatgtattttctgaagaaaacaagaacatgctatgtatttggtcctgtgtactgagtaa

SEQ ID NO: 16361 - DNA, 201 bp, Homo sapiens
tcatatacatggatagttctgagttcatctagatccaaaatcctttaggcacatgttttgtagttgaatactcattcaggtgaatacagtgggagaaagaygaacttacttgtgtaggcgcagaaggtaaaacgggggtgatgattgaactgagacatgcagaatggctacaagttggggccaggcgtggtggctcacacc

SEQ ID NO: 16362 - DNA, 201 bp, Homo sapiens
agagagggacatccgagatcctaatttctgtgaacgtatgttgagaaatgtcactcactgtgtgggacctacttcagattgccttccaaactgaatagtcrgtagtctcagagctcatagtatgagcagtaaagccagcattgttattgtaattgcagttgaagacgctgggagtggaatttacttggtagttgtgctgct

SEQ ID NO: 16363 - DNA, 201 bp, Homo sapiens
atgtggaaaaccttcatgtgatgcggacggcgtgttagtcaagagagggcaagggaggtaaaaccgagaagaccaggttctcagccacgcttctggagttwgggattaatccataggcactacttttttccacatatgtattttctgaagaaaacaagaacatgctatgtatttggtcctgtgtactgagtaatggcagct

SEQ ID NO: 16364 - DNA, 201 bp, Homo sapiens
attaggtatctttttatttccccatagagtaaggcagtgttgacccttttccaaaccgcaataaaacatctggagagtaaatccctggtcccttgtgtttmtgttttaatactgactttggtaactggaaaggaagtgtgttctctttggttttcagagttttgcacaatttgtgagcagattcaatctgttgaactccag

SEQ ID NO: 16365 - DNA, 201 bp, Homo sapiens
ccaggttcaagcgattctcctggagtagctgagattacaggcacgcgccaccatgccctgctaattttttttgtaattttagtagaggagaggtttcatcrtgttagtcaggctggtcttgaactcctgacctcaagtgatctacccaccttggcctcccaaagtgctgggagtttacagatgtgagccaccgcgccaggg

SEQ ID NO: 16366 - DNA, 201 bp, Homo sapiens
cctaatttctgtgaacgtatgttgagaaatgtcactcactgtgtgggacctacttcagattgccttccaaactgaatagtcagtagtctcagagctcataktatgagcagtaaagccagcattgttattgtaattgcagttgaagacgctgggagtggaatttacttggtagttgtgctgcttttagtcgacttttgtgag

SEQ ID NO: 16367 - DNA, 201 bp, Homo sapiens
tgtactgagtaatggcagctgtagagctgcttctggcgggttgactcgcgtgaccatgaactcagctgatgtggctcctcctcccttccagttgctttgcrgagtcaggccagtgctcatgccggcctcacatgattggacgtcagtgcaacgaagtggaacctggttactactttgccaccctggatcactacctctatg

SEQ ID NO: 16368 - DNA, 201 bp, Homo sapiens
tcccctgaaagagaagatgttagtatttgttctgagccagtttatttgacagattctttttttctctggcgttgtttttcattgtggaaatgcatccaaargtttccccatcagggataggtttttctaagttgtggtataactaacatatgtggtagactcttatttattttctttgctgctgcatagagaaaaaggaat

SEQ ID NO: 16369 - DNA, 201 bp, Homo sapiens
ggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaacattctagagatgaggc

SEQ ID NO: 16370 - DNA, 201 bp, Homo sapiens
ctgtgtgggacctacttcagattgccttccaaactgaatagtcagtagtctcagagctcatagtatgagcagtaaagccagcattgttattgtaattgcasttgaagacgctgggagtggaatttacttggtagttgtgctgcttttagtcgacttttgtgagatttagagggaggaagggaatatatgtatttatacaaa

SEQ ID NO: 16371 - DNA, 201 bp, Homo sapiens
cctttgatctttttcccttgtaatctgacttccaattccccaaaatgcatcactgtgttggttagtgtcaaaacctttgcctgtttgcctatttttcagcrctctttctgcttcatcttttacttccagttgaccctgttcactacaccctcctaaatctccctcctgccttggtttcagaagactgcctttttttctctt

SEQ ID NO: 16372 - DNA, 201 bp, Homo sapiens
tggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaacattctagagatgagg

SEQ ID NO: 16373 - DNA, 201 bp, Homo sapiens
cctcgctggacggccccgccgcgcgccgttctgggacgcgcaccccggggcggacccgccctgggacctggaagcgccccagccccgcagcgatcgcagaytcggctttcaaacaaaagaggcgccccggggggtgggaccgggacctcacccggtcctcgcagagttgcggccgcccgccccttcagccccggctctccg

SEQ ID NO: 16374 - DNA, 201 bp, Homo sapiens
atgaaaactgtacttcataaatattttttcttgaattttaaaactttacagtaaatttaggacccgaagacaccaaatatagacactgcttggggaggaarcctagtatgatgaggttaactgtgggcaatttcatttcctaccctaggtgccttggatagcattaccaagtatttccagatgtctcttgaggcagaggag

SEQ ID NO: 16375 - DNA, 201 bp, Homo sapiens
ggtaattgagcagtttttaaaacgagcatgaataactgcatttaacaaatactctatcttcatgacaataagtagaaagagcctctattctaaggtaattsaactgtaaacttttaattaggtatctttttatttccccatagagtaaggcagtgttgacccttttccaaaccgcaataaaacatctggagagtaaatccc

SEQ ID NO: 16376 - DNA, 201 bp, Homo sapiens
ggcaattttccagcaagagtttatttcaaaaggtcctcctgatttcctgaaaatacaccagtctgtgacatgattcattctgacacattcctgtctttccscatttaagacttcttttgctctcaagatggaccccaaaagctctctcaaacacaagaagcgtggcaagcctcccttgctgaacaggcaggcttgagagct

SEQ ID NO: 16377 - DNA, 201 bp, Homo sapiens
gtggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaacattctagagatgag

SEQ ID NO: 16378 - DNA, 201 bp, Homo sapiens
tatggtaaaggaagctctggaagaagcagaaaaggcccaggtcgcagcagagaaggcaattaaacaagcagatgaagacattcaaggaacccagaacctgytaacttcggtaggcatacacaatcattacatgaatgggaacacacctacatatacacttaccagaaaagtacatttgttatctatgaacagaaattctta

SEQ ID NO: 16379 - DNA, 201 bp, Homo sapiens
ctcccaacctttcagcatctttacattttcctggttttttatactattatatcgccaagaagacaattacattcaattaggtgaaccagtaatacccagargtaaaatctgctcaaatattactttctttacaatacacatacaaccctacccacacccacctggagcacactcgcatgtgcacacacacacccatatcca

SEQ ID NO: 16380 - DNA, 201 bp, Homo sapiens
tggctcttggtattgcttcttggttcttctcttcctttgggagagtaagaggaagaggatgcagtcttagtagtttcccttaaaaaaaaaaaaaaaaaaaagcaactggagccaggctctctggtatatatgattagccatgcatttgtgaagtgcttttcacagatagcagggcctaaagaaagggactggacatatgct

SEQ ID NO: 16381 - DNA, 201 bp, Homo sapiens
taaattggtttccaggtggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaa

SEQ ID NO: 16382 - DNA, 201 bp, Homo sapiens
ggaggctgaggtgggaggatcactggagcccaagtgttcaagaccagcctggacaacatagactcagtctctacaaaaaatttttaaaacttagctgggcrtggtggtccacacctgtggtcccagctgtctgggaggctgaggtgggaggatcacttgagcccagtaggtcgaggctgcagtaagcgataatcagtccac

SEQ ID NO: 16383 - DNA, 201 bp, Homo sapiens
ataaattggtttccaggtggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaatagga

SEQ ID NO: 16384 - DNA, 201 bp, Homo sapiens
ggtctccagcaatcctcctctcacctcagcctcctcccaaagtgctgggattacaggctaacaccccagcccacccccacccccgctttttttttttttttaaagagatggagtctcactacgttgcccaggctgacctcaaactcctaggctgaagcgatcttcccacctcaccctcctgagtagctgagatgacaggca

SEQ ID NO: 16385 - DNA, 201 bp, Homo sapiens
ttttttaaaactttagttttggaagtgtgcattaaaggtgatttatcctctttttaaaacccttgggtttccccacccccctctaccgcatcttcacttgrgtaaagaggattccagcaatgacaggcgtcttgcaaggtgattccaatcactgaacgaacccgttttcctctcctcatttggtgctgttcccaactagat

SEQ ID NO: 16386 - DNA, 201 bp, Homo sapiens
taaaaggaaaacataaatgtaaatgtgataaatgattaatttttaaaattttactgtcattgaaagaaaaatttaagtgctatgcctgaagtaaaaaaaaactaaaataagctagctaacaaaaacctttttaaaaaaatggtgatttggctaagtggtaaatcgtgcagtaatataaattggtttccaggtggtatgtat

SEQ ID NO: 16387 - DNA, 201 bp, Homo sapiens
agtagagacagggcttctccatattggtcaggctgatctcaaactcctgacctcaagtgatccgcacacctctgcctcccaaagtgctggaattacaggcrtgagccaatgcgccctgcccacggctggaaaattttaacccacacccatgggatatcattttagggatcaaatggagttggtttctttctatcttttcct

SEQ ID NO: 16388 - DNA, 201 bp, Homo sapiens
cccgggaggcagaggttgcagtgagctgagatcacaccattgcactccagtctgggtgacagagcaagactctgtctcaaaaaaaaaaaaaaaaaaaaaaagggctttggagtcacaaagtcctggatttaaatgtgttcataaatcataaatgtgttcagtacatcaaagctgttgctacatttgttgctgttgatgttg

SEQ ID NO: 16389 - DNA, 201 bp, Homo sapiens
cccaaaaaggtgagaagtccaatgggaagtgcccatgagggaagcctgcaagttgctgatagggcagcatgagtttgtcagtaaatatcagaagaattacrgaaatagttgatgttctcatttaatcttactcctttaatcttcaggatttaatctctcttttaaggttttagagatacgacttttgaaattatcttggat

SEQ ID NO: 16390 - DNA, 201 bp, Homo sapiens
aatagcttatctgctagaatgtgtgacttgagtaatatgttttggtcatggaggttttttttttttttttaaacaaaagggttagattttttttaatttaraaatttctatagagaagcaactttatttttggggaagtgtctctccatggtaagtgacattttactactacacagtttaaatgcatactattacgcattt

SEQ ID NO: 16391 - DNA, 201 bp, Homo sapiens
gtgactcgagaccctcacatgtgcctctttgcctctatcctgtcttgggagtactgctccttccgtaactcccccatctcctcaggcatttggaccccagygttccgggcctgagagtccagaatttccactctctgtgatacaaagaagaggccctggctcattattgactataaccctagggtttttcctcttaagagg

SEQ ID NO: 16392 - DNA, 201 bp, Homo sapiens
gtctcccaaagtgctgcgattacaggcgtgagccaccgcgtctggccagaatacatttcttaaattattttcagataccttcccagaacctgtcaagttaygagaaggctcagggctactgagctgatagtctcaagttttctatattggtcacataacattaactacttaaccacctaggttccgggctgtctacttatt

SEQ ID NO: 16393 - DNA, 201 bp, Homo sapiens
attttgaaaaaaaatgagttgaatgggatgaggatgtgttgggagggaaggagagttaagatgcatcagagtttgtctctttatatttgactgtacactamaaattttcaaacataaaccagattatgcttaaaaattaatactataaatcctataaacattaccccactttggtagcagaaatttttgtgtcttttattc

SEQ ID NO: 16394 - DNA, 201 bp, Homo sapiens
aggactcttggaataatggactatgctacaggattattttaagttcagatagataaattagcttcttcccaaattctcattctgcttttcctgtggtactrtatagtatcatgaagttatatctttaaactcttagtttgtactatgtggtgtcttatgaaaaccttgatttgtttatacttagtgaatgaaacacttggg

SEQ ID NO: 16395 - DNA, 201 bp, Homo sapiens
tctcaaagactttgtatagatcaggcaggttagcaagctgcaggatatttccatcttctgtgaaatgtttaggaggcagaatgtgtgagcgcaaggctttwtagacaatgtgttccacagtccacttccaggagtttggaatggagccaggcacttcactctggaaaacacattagatgtcataagcctccctgtttgcat

SEQ ID NO: 16396 - DNA, 201 bp, Homo sapiens
ggcaaagacctttcattggaaaatgatgctttctttcaaattattgtcataagtaaatcaactctaaaatcatgaatactttaatctattaacatgggtcyaatctctttttctatagaaggacctttgattttggaaaagtatcacaaaataattaagattgatcttgtagaataacatttgtttggttctaactttcag

SEQ ID NO: 16397 - DNA, 201 bp, Homo sapiens
aggtcgcgccactgcattccagcctaggcgacagagcgagactccgtctcaaaaaacaacaacaacaacaacaacaacaacaacaaatgtaaatcagtgaygaattcctaaagatcagaatacctgattagaaattgaatcatagtagtgcttataaacagacttcagcatacatttggtcaagggcatcagtcacagcag

SEQ ID NO: 16398 - DNA, 201 bp, Homo sapiens
acgtctaaatgctggtctcagctttatgatctcatagattcttacttaatccttctgtgctgcaactttcttactgcaaaatgaaggggtcagactagatratctctaaggactcttctagctcttaaaaatagaattgctaccagggtcactttatatcgttgctaccagggtctgtttccctcatgtttgccactgtgc

SEQ ID NO: 16399 - DNA, 201 bp, Homo sapiens
tagtggcattacatccatttgcattgtcatgcagccatcaccactatccttaagaactctgtcatcatccagtactggaactctgtactcattaaatagtragtcccatttccccctaccctcagtccctggcaaccactattgtgctttctgtctgtatgaatttgactattttaggtttctcattaagtggaagtatac

SEQ ID NO: 16400 - DNA, 201 bp, Homo sapiens
gcagaacattgtgctggagggtcatgggccaaatcactaagttccttattaatctgtcttagtgccatagtatgtgcttgtcatctggctcctcactctcycggtatgtgctcaaaagtctggccaaaactcctggttatcccggaggtgggacagcattgtctcatctcataccggctctgccagacacaagctcttggt

SEQ ID NO: 16401 - DNA, 201 bp, Homo sapiens
gtgttaggacagacttacttgagaatttctttgtgattcatactgtaatgaaattttgctggtttattttgttaaagcaagtcaaaaattttttaagttayggaatatttagctaaatgagctatacttcttagcaatgtgtatagaagaaaagagggcatgaaatttgggttgcattctttcatggtaatctttaatctc

SEQ ID NO: 16402 - DNA, 201 bp, Homo sapiens
agattgtatgaggtcctgtcctagtcctggggtgccagtgtgcatcaccactgtacctgctggcctgagagggtcgactcctcagatatgtactgcttccrgatggaatagaacatagcgcattctttactgaggctttcaaaacattccttttcttcgtcccaattcacctggtccaaagaaattcaatacctcaaaata

SEQ ID NO: 16403 - DNA, 201 bp, Homo sapiens
gaagtataagaatggctgtcacacctcatcaatttccaaagagaaatagtctgcaagcatctcagccttcttcttcagaaactcaacaatgtattcagcawgtccttctttgggaccatcttcctctgtccagccactctctggactatctaaggcaagcatggcaaggtcaaagagcggtgctggctcctaggaagaagc

SEQ ID NO: 16404 - DNA, 201 bp, Homo sapiens
ccttataattagctattttaaccaacttagtttttccctccatcattttagaaggtaatagagttattttagtatgcatagagttgttttcttaatcttgkcctttttttttttttttttttcttttggagacaaggtctcactctgtagcccaggctggagtggagtagcgcaagtatagctcactgcagcctctgtctc

SEQ ID NO: 16405 - DNA, 201 bp, Homo sapiens
caatcttggctcactacaacctccgcctcctaggttcaagtgattttcctgcctcagcctctagagtagctgggattacagacatgcaccaccctgctcgkctaatttttgtatttttgatagagacagggtttcaccatgttggccaggctgcccagctatagtaattttaaatggttaagtagaatttctgctgatggc

SEQ ID NO: 16406 - DNA, 201 bp, Homo sapiens
ccctggatgactctttttttatttaaaaaaatattttcttgaggaaaagcttatgtcttctgttaagtttctgaaaatagaatacaactcaagttttagcktcattttctatctcttaattgggactgtaattacagtgttacttatttcttctggttacaagtgactggaactcccgcaaagctccaaagactctcaata

SEQ ID NO: 16407 - DNA, 201 bp, Homo sapiens
aggggacttgttagtagattacttggcatttataatgacattgtatttccatcctggctaccaaaaagtggtgacttctagtgcccagtactagaggcctrtgttctcatacttacagattagccggcttgagggacaggttctgagatataaaactgctgctgagaatgctgagaaagttgaagatgaattgaaagcaga

SEQ ID NO: 16408 - DNA, 201 bp, Homo sapiens
aacaggaaagtactaaaaacaactgtctagaaagtggcaaaattcaaatgcgtatgaagttcacctgtgtaaagagaggctgtattctgtggtatcactgygttctgaacaccagtctgttattaaaattataagagtaaaatttctgaaaatattgatgattcttcattttatgacccttacagatatatgttgttgcaa

SEQ ID NO: 16409 - DNA, 201 bp, Homo sapiens
ctaaataggtccttcataaatgtgtattgaatgaatcgataagtaaaagacagtcaaacctactggagaggcaatgaaggaggcagggaaaatataatacyaaaaatgtgtataatcagcctttaataattgatcctgcttgtaattgcagaattgtatttagggccctgtgcagttatttcggacataaatcgagcattc

SEQ ID NO: 16410 - DNA, 201 bp, Homo sapiens
aaaaataccccaaagatgtactgttccataagcagacacaaatttaaaatatggctattttctactgggacacctggtcctggggcttgctcttttcgatrtttgttcgtagcttatctttagcacctaggacgatgtgtgtctcctattaggcactcaagaaaataggttttgaatgaatgtggctgatacgataagggt

SEQ ID NO: 16411 - DNA, 201 bp, Homo sapiens
tcggcctcccgagtagctggtattacaggcacccgccaccatacccggctaatttttgtatttttagtagagacggggtttcaccatgttggtcaggttcrtcttgaactcctgacctcaagcaatccacccaccttggcctcccaaagtgctgggattacaggcatgagccaccgctcctggctttctttaatgtaactt

SEQ ID NO: 16412 - DNA, 201 bp, Homo sapiens
ctgcatgctttgtagaaatttttgattgttgcgttaatctgtactcactgtttagaatattgaggatatggtgtgattcactttgttgtgcatggattagrtgttcccttagtacataaactcaagcactaatttgtcctaataattggtgatttctctataaatgtgacttagcatgtaatttcttaaatgagtctctaa

SEQ ID NO: 16413 - DNA, 201 bp, Homo sapiens
acacttgaagtggaaaaaaacccataaaaataaagaaaagattgtctgattggtgaccaagcatggtggtatgatgtatcctattgaaaaaggatgttggstcattgcttgtgacattactgttattatgtttgcctttgggatgctctcaaccactctcccctccatccttttatcaggaaagtttattattactaatac

SEQ ID NO: 16414 - DNA, 201 bp, Homo sapiens
ggtttaataatacacttttttcttaggcctctcctactgcaaattctggtctgctgagaagtgccagtctggtttgtattttcctcttccagtgtgtgcastgctggtggggtcaatgtcatggtgctaactctatggcttgacagcttttctccaaaatagttaaggacacatgattttagtgtcatgtatactgcagaa

SEQ ID NO: 16415 - DNA, 201 bp, Homo sapiens
tcctcagctgaaggggcctattttaatgcaggcttgggaagagtcaaacctccacaggctaggagtgagccctaatggtgctgccaccaagccgcagatcyacccatggatgcccacatcttttttttttttttttttgagacgaagtctcactcggtcgcccaggcaggattgtagtggcgcgatctcagttcactgcaa

SEQ ID NO: 16416 - DNA, 201 bp, Homo sapiens
gtctattctattcattttacccgaattattccagtttttctcatttttctacttctgacctcataataaaatgatcactgcagtcacactaattcccatagtaggaagatttcagcaggaatttgtagttagcctttgttagtgattatgtgtaattctcggacagaggagattttcatttttccaataagaatagtgact

SEQ ID NO: 16417 - DNA, 201 bp, Homo sapiens
aggtcttcctgtctgaatgagaaaatcattcaggttttctcctgaattgttctcctgaatgattttttcattcacgtctttctccttcaaagatgctcctyttccacatgctacctaaaatgttggccttgcatcaaattcgattcctgttctctccttttgaccctgaaccaactccttgggttatcttgctgttcccct

SEQ ID NO: 16418 - DNA, 201 bp, Homo sapiens
atcctgattcagagaaaatgtgcttcttacattctgatcatgatgctacttccatctgactgcacaatttccaggcccaatcattgtgtaccttccaagaragggagtctgtatttgaaatagcctcaataatgaggccacacattaggctcagcctatgttggcttatggttctcacagaaaaaattatccacactgcta

SEQ ID NO: 16419 - DNA, 201 bp, Homo sapiens
acagagcaagactctgtctcaaaaaaaaaaaaaaaaaaaaaaagaatctcagaggtagaaagaggtaagccctgatcagtgaggtttatcctgattcagaraaaatgtgcttcttacattctgatcatgatgctacttccatctgactgcacaatttccaggcccaatcattgtgtaccttccaagagagggagtctgtat

SEQ ID NO: 16420 - DNA, 201 bp, Homo sapiens
caacagagcaagactctgtctcaaaaaaaaaaaaaaaaaaaaaaagaatctcagaggtagaaagaggtaagccctgatcagtgaggtttatcctgattcaragaaaatgtgcttcttacattctgatcatgatgctacttccatctgactgcacaatttccaggcccaatcattgtgtaccttccaagagagggagtctgt

SEQ ID NO: 16421 - DNA, 201 bp, Homo sapiens
acagcagtcccctgccctggctcctctgacctcgcccctgaccatttctgttaaatacttttagctgattcttgtgtactgtccttgtatctctgtataamatacttatgttgcatcttgattgttctgcttcaggcattctatattgacatccttttatggaagatgaggatttagctgtttttcatcctttgtccctgc

SEQ ID NO: 16422 - DNA, 201 bp, Homo sapiens
atttctatagagaagcaactttatttttggggaagtgtctctccatggtaagtgacattttactactacacagtttaaatgcatactattacgcattttaraaaattttgtaacaagattttgttacacatgcaataataatattttttattgtgttttctgttagtttcaggataatataagaaaagcatgcggtacaga

SEQ ID NO: 16423 - DNA, 201 bp, Homo sapiens
cttgctgcaagggatactgtagtaacatatatgctagagcatcttgtagtatatacagtccagaacctgggctgctgaagatgctgtggttgttgtgtgtrcatttgtattttgtaatttttttttggcagggggacggagtatcgctctgttgccaggctggagtgcagtggcgcgatcttagctcactgcaacctctgc

SEQ ID NO: 16424 - DNA, 201 bp, Homo sapiens
ctttggaaggctgaggtaggagaattgcttgagcccaggagttcaagaccaacctgggcaacatagcaagaccccatctcctaaaattaaaaaaaaaaaaattaggtaagtatggtggcatgttcctgtagttctgtagttccaggtacttgggagcctgaagtgggaggatcacttgaacccaggagttcgatgttgcgg

SEQ ID NO: 16425 - DNA, 201 bp, Homo sapiens
gacattttactactacacagtttaaatgcatactattacgcattttagaaaattttgtaacaagattttgttacacatgcaataataatattttttattgkgttttctgttagtttcaggataatataagaaaagcatgcggtacagatattttgctccaataaaattggtatttattacaataacattttcaatgaattt

SEQ ID NO: 16426 - DNA, 201 bp, Homo sapiens
agtgacagggttagtactttctgaggaatgttctgcctttagagctaccagttgctttttttggggtttaataatacacttttttcttaggcctctcctaytgcaaattctggtctgctgagaagtgccagtctggtttgtattttcctcttccagtgtgtgcagtgctggtggggtcaatgtcatggtgctaactctatg

SEQ ID NO: 16427 - DNA, 201 bp, Homo sapiens
atactattacgcattttagaaaattttgtaacaagattttgttacacatgcaataataatattttttattgtgttttctgttagtttcaggataatataaraaaagcatgcggtacagatattttgctccaataaaattggtatttattacaataacattttcaatgaatttataccagtggtaaaatggtaccacttagt

SEQ ID NO: 16428 - DNA, 201 bp, Homo sapiens
tgcatctttatgtgtttgtggcagtgctataatttcctgttatattgcatgtattcaattaacattttagatatcagactgatgacttaactctcatttargaatctttgtctgaagtggaagaaaaatacaagaaagccatggtttccaatgcacagttagacaatgagaagaacaatttgatctaccaagtagacacac

SEQ ID NO: 16429 - DNA, 201 bp, Homo sapiens
ccaggagagagatctcacaaccacacttgtccacattcctggctactcagaccttagcctttctttttctctccctctttctctctttcccctcggacctrcctcttaatatgtctctctacaaatgatttttaaaaaccatttaatagagaaaaagaaatgactttaaatttgaagacgtgttaatttttgtcatcatta

SEQ ID NO: 16430 - DNA, 201 bp, Homo sapiens
ggaaacttcataccatagcagtcactctccatttcctctttacccgagactttgtggaaagcactagtctgttatactttctgtccctatggatttacctrttctggacattttacataaatgaagttattcaatatgtaatctttgtgtctggcttttatcacttctcatgttttcatgattcaaccttgttgtatgtag

SEQ ID NO: 16431 - DNA, 201 bp, Homo sapiens
ctctggagtagctgggactacaggtgtggaccaccacaaccagctatatttttttttttttgtagagacaggatttcaccatgttgcccaggttggtctaraactcttgctcaaggtatctgcccaccttggcccctcaaagtgctggattacaaggcgttagccaccatgcccacccagtattcttgttttgacagttag

SEQ ID NO: 16432 - DNA, 201 bp, Homo sapiens
ctcactcacatctttgctgtgagttgaaaagcagtgacagagtggtggtctgttccacagagtcattgagggactcaggctgctttcagctagtgattctrccacccactggggcctcagagactttgaatttcctgcatctggctggcagatgcgaggacaaagagagggactgtggtagattgcatggaaagtttgatg

SEQ ID NO: 16433 - DNA, 201 bp, Homo sapiens
cattctctgctcaagcctgcaatatcctccatgtccatacatgtatttttggccaaaatttttaattttgaaaaaccaaaaagctctactacctctctaartctgttagtcaggataggctgaactactttaatgaataattaccaaatcagtggtttttaacacaaaatttatttctcactcacatctttgctgtgagtt

SEQ ID NO: 16434 - DNA, 201 bp, Homo sapiens
agctattctcctgcctcagtctcctgaatagctgggattacaggcatgcgccaccatgcctggctaatttttgtatttttagtagagacgggttttcaccrtgttggccaggctggccttgaactcctgacctcgtgatctgcctgccttccaaagtgctgggattccagatgtgagccaccgcgccctgcccagagtttt

SEQ ID NO: 16435 - DNA, 201 bp, Homo sapiens
agttaagtgacctaaggattataggactaaatgtagaaaaaaattcagctttagattagatgttttttcccttgtcacagataatgctgtatctaggtgarcagtcaaggaaatgagagggcattgttcttgtcttgccagattcatcctttgcaatcaaataaagtttgttttgtttttaaaattgtggtacaatataga

SEQ ID NO: 16436 - DNA, 201 bp, Homo sapiens
tttactgctttagggaagcaaatttaatttttatgttactgttctgagcatgttgttccttacatgcccactttcctaagtagaaatatattaacagctasaagaaatcttttggctttctgttttgtaagttagagtataccgtactgtatgcagaggattaggatgttaaaatatttatttccctgttaaatggcttaa

SEQ ID NO: 16437 - DNA, 201 bp, Homo sapiens
tatttgataatagttaaatggctacatcttaagtaggttgattgtttcagaattttatgaccagtatcaattaaaagcattgtgtatagtttaaattcttkccctgcataagtcggctactatattattagtcaggaaagaagtaaataatctacctccttttttcctttaccttccacatcctaatctatacataataaa

SEQ ID NO: 16438 - DNA, 201 bp, Homo sapiens
aaatgcacgaccctggtccttccccagtgccttgaacctggtgggcctcgttagatatttccggaataaataacaagtccgtgtctatcagatttttaacrgactctatactcctccctccatcccgctccccgcccccccccccacacctctcgcgcaagcattcttctccagaaataattttaaggtcatgcgtcttca

SEQ ID NO: 16439 - DNA, 201 bp, Homo sapiens
tggagtgctgtggcgcaatcttggctcactacaacctccgcctcctaggttcaagtgattttcctgcctcagcctctagagtagctgggattacagacatrcaccaccctgctcggctaatttttgtatttttgatagagacagggtttcaccatgttggccaggctgcccagctatagtaattttaaatggttaagtaga

SEQ ID NO: 16440 - DNA, 201 bp, Homo sapiens
caggcaggttagcaagctgcaggatatttccatcttctgtgaaatgtttaggaggcagaatgtgtgagcgcaaggctttatagacaatgtgttccacagtycacttccaggagtttggaatggagccaggcacttcactctggaaaacacattagatgtcataagcctccctgtttgcatcccaacatacactggtgtcct

SEQ ID NO: 16441 - DNA, 201 bp, Homo sapiens
tcttaatacccttacccttgtttttcttttccttctgttagagttcagctgatttttaccttgattttcatttataaagaactttagttaaaaaataatgrcaagtctatcctgttggtctagcttactaaattcctttacttctttcactaaattttggcatcttttttttactttggatatccattatattcagagtgt

SEQ ID NO: 16442 - DNA, 201 bp, Homo sapiens
tcctagtcctggggtgccagtgtgcatcaccactgtacctgctggcctgagagggtcgactcctcagatatgtactgcttccggatggaatagaacatagygcattctttactgaggctttcaaaacattccttttcttcgtcccaattcacctggtccaaagaaattcaatacctcaaaataggtacgaatttaaacatt

SEQ ID NO: 16443 - DNA, 201 bp, Homo sapiens
ctggagtgcagtgatgtgatctccactcactgcaacctccacctaccaggttcaaatgattctcctgcctcagcctctggagtagttgggactacatgcgygtgccaccatgccccactaatttttgtagttttagtagagatggggtttcaccatgttggccaggatggcctcgatctcttgaccttgtgatccgcccgc

SEQ ID NO: 16444 - DNA, 201 bp, Homo sapiens
tggctgtcacacctcatcaatttccaaagagaaatagtctgcaagcatctcagccttcttcttcagaaactcaacaatgtattcagcaagtccttctttgsgaccatcttcctctgtccagccactctctggactatctaaggcaagcatggcaaggtcaaagagcggtgctggctcctaggaagaagcaagaacatgaag

SEQ ID NO: 16445 - DNA, 201 bp, Homo sapiens
cagcctctggagtagttgggactacatgcgcgtgccaccatgccccactaatttttgtagttttagtagagatggggtttcaccatgttggccaggatggyctcgatctcttgaccttgtgatccgcccgcctcagcttcccaaagtgctgggattacaggcgtgagccaccgtgcccagccccaattatttttacataca

SEQ ID NO: 16446 - DNA, 201 bp, Homo sapiens
ctgtccttttccacatccatttgtcatctttaagctcccatacagcaagcacccttccccattaaagttttttctctggaatttgtcttggataattggaygaatctatttggaactacttcacactaaattgagtagtttcagaattttcctagaagtattttgttaatccaagtttatctttattagatgaaatttaaa

SEQ ID NO: 16447 - DNA, 201 bp, Homo sapiens
tagtagattacttggcatttataatgacattgtatttccatcctggctaccaaaaagtggtgacttctagtgcccagtactagaggcctgtgttctcatayttacagattagccggcttgagggacaggttctgagatataaaactgctgctgagaatgctgagaaagttgaagatgaattgaaagcagaaaaacggaagc

SEQ ID NO: 16448 - DNA, 201 bp, Homo sapiens
cattcttgaattaaatttctaaaggaggcttcaggtacaatttaatatacatgtaaatgaaaattcctacacattgatagggctttcttaaaaaggtttgraagttttgatgctttgtgattttaaaatacatttgctatctacttaagcttaaaagccttgaagtgtttcctattaaaaaaaaaaaactctaataagaaa

SEQ ID NO: 16449 - DNA, 201 bp, Homo sapiens
gtgggaacagacacctctgagtctgcaggggcaggggggcccttcctggccccagagagtgcagagatgcctgggtctgcagctgcagtttgggcagctgyggctgcgcccaggagggtggggctcttgcctgcttcctgcagagacaagaacttaacttttcactgtgactttttgtaacctgaatgctttggcctagtt

SEQ ID NO: 16450 - DNA, 201 bp, Homo sapiens
ttagtacccaggtggttttatagaaatgattattgtatctttaaagtgcttacacagaaaatatattgggggaaaatctagtgactaaaggcacataagataataaaactagactttaaaaaggtaactcaaaagtgaataaaatctctaatatttgttccttttttaattagcccttcatttaaaaaatatggataccaa

SEQ ID NO: 16451 - DNA, 201 bp, Homo sapiens
cttagtacccaggtggttttatagaaatgattattgtatctttaaagtgcttacacagaaaatatattgggggaaaatctagtgactaaaggcacataagataataaaactagactttaaaaaggtaactcaaaagtgaataaaatctctaatatttgttccttttttaattagcccttcatttaaaaaatatggatacca

SEQ ID NO: 16452 - DNA, 201 bp, Homo sapiens
acctcaaaataggtacgaatttaaacattctcattctaaacggagatcacagactacttaaagctaaaaaacgaaatgtgatactttaggcgttaaaactrtaaatgggactgctgaatattgctgggaatgaatattagtggggatgagagcaggccttcagctatcccacccttatcatctttatcattccagatcaaa

SEQ ID NO: 16453 - DNA, 201 bp, Homo sapiens
tcttagtacccaggtggttttatagaaatgattattgtatctttaaagtgcttacacagaaaatatattgggggaaaatctagtgactaaaggcacataagataataaaactagactttaaaaaggtaactcaaaagtgaataaaatctctaatatttgttccttttttaattagcccttcatttaaaaaatatggatacc

SEQ ID NO: 16454 - DNA, 201 bp, Homo sapiens
gaagagtcaaacctccacaggctaggagtgagccctaatggtgctgccaccaagccgcagatctacccatggatgcccacatcttttttttttttttttttgagacgaagtctcactcggtcgcccaggcaggattgtagtggcgcgatctcagttcactgcaacatacaacctctatctcccaggttcagacggcttccc

SEQ ID NO: 16455 - DNA, 201 bp, Homo sapiens
aatggctgtcacacctcatcaatttccaaagagaaatagtctgcaagcatctcagccttcttcttcagaaactcaacaatgtattcagcaagtccttcttwgggaccatcttcctctgtccagccactctctggactatctaaggcaagcatggcaaggtcaaagagcggtgctggctcctaggaagaagcaagaacatga

SEQ ID NO: 16456 - DNA, 201 bp, Homo sapiens
atatcacactttgatacaacactttgtatcggaatacagagaaagaagaacacatcccacagtgcataaataaccatatttaacacctctcaaagactttstatagatcaggcaggttagcaagctgcaggatatttccatcttctgtgaaatgtttaggaggcagaatgtgtgagcgcaaggctttatagacaatgtgtt

SEQ ID NO: 16457 - DNA, 201 bp, Homo sapiens
tagctgggttaatacttgactaatatgaggcgttattgacacccagattgttaagttacagaactccagtcagccctgcctgtgagtaaccagcagcatgyaggaggacctaaggaaacccacttctttttctttcttagagggaaaaaagttcaagtgtttgctttacttttttcaccgtgggagatacaaatacaggct

SEQ ID NO: 16458 - DNA, 201 bp, Homo sapiens
tccagccagaggcttcgtctacaaaatctttttcatcactctgtgtgtttcctgcaaagccatactacacctgtcattaccttgtttgtttgcttcagccmgtctattccactaaggtaagcttttcaaatgcacgaccctggtccttccccagtgccttgaacctggtgggcctcgttagatatttccggaataaataac

SEQ ID NO: 16459 - DNA, 201 bp, Homo sapiens
cgtggttaggtgtatttcgtgccttttttgtcaggaggctcctcaactatcacttcctcctagaggtcttttttagccatcctatccagccagaggcttcrtctacaaaatctttttcatcactctgtgtgtttcctgcaaagccatactacacctgtcattaccttgtttgtttgcttcagccagtctattccactaagg

SEQ ID NO: 16460 - DNA, 201 bp, Homo sapiens
agtatgctttacaccttaaagcagcacttttattttgcacattgataatgctgtatgtatactttctttttttccattttattttatttaaaattttttttattttaatagcttttagggtacaattgcattttggttacaatgctgtatgtatacttccatgtagttttcttaatcagtaaaatgatctttcatgttaaa

SEQ ID NO: 16461 - DNA, 201 bp, Homo sapiens
ctgcgcccctcgcccatagccccagcgggcgccgggcgggcgagcagctcttcggcccttcccggacagcgacgcagtcgcagcgcgcgccctaacacagrtaagggccgctcctcccgccagcccggtgggagcagggagcggggagttgggaacctttttcccggcctccgcagtcccgtgggatccgcgccgcctccg

SEQ ID NO: 16462 - DNA, 201 bp, Homo sapiens
taaaaacctaaagactgtagtatgtcaatttcctggttttaataaggtattatagatatgtaagatatcaatagggtaaactgggcaaatactacacatgmccgctatactatttttgcaactttttaataattatatccaaataaaaagtaaaaaagaaaaaaataacaacatgaaaaaataaatctagataggaattct

SEQ ID NO: 16463 - DNA, 201 bp, Homo sapiens
tgtttagaaacttttttaaaaaatccagtcaaatgacgagtcttgtattcctctgttttcctttgataacaatctgtgaaaaaactgcagtggtcagaagwtgtgttaaaatatacacacacaagttgtataatgttgcaggtttattagggcaggatgacatggaacagtatgaccagagaaagcaaccaccttacaaat

SEQ ID NO: 16464 - DNA, 201 bp, Homo sapiens
attcccaggagaaggcatttctgatacctcaggttaggtcaagtcccaatgcttttatgccctcatggcagcacatacctaccctttgtaatacctgttarattttaaaggtacttttgtgagattgtctaacttaccagtttcataagaaaaagaaacatttttgtttttgcttcccgtcggatgtctagcatttgcaaa

SEQ ID NO: 16465 - DNA, 201 bp, Homo sapiens
aagtcttactctgtggcccaggctggagtgcagtgccatgatctcgactcactgcagcctacgcctccccggttcaagcgattcttgtgcctcagcctccygagtagctgggaccacaggtgcatgacactatgcatgaatgaattcttaacattgaagtcagagtggtcttttgaaaatacaaatctgatcatgttgctc

SEQ ID NO: 16466 - DNA, 201 bp, Homo sapiens
ttcaccatcagtatccatttctatattttggtgacagtactccattttgttcttccgggaaccactcctctcctatagtccatgatctttgggtggaccasaggtaaagcatatgactcaaatttggctaatcatagcacaagagttttccttgctacagtaatttgttaaaggatgggaaggtaactctctatcctttaa

SEQ ID NO: 16467 - DNA, 201 bp, Homo sapiens
tgcagtattgtgtgtggaattggaagagattcaaagtgagtgccatggcagtgactaacttctttcaaaagcttaaggaagaaacaatgcataggcctttsagttagttggtgtagtaagcattgtgttttcaccatcagtatccatttctatattttggtgacagtactccattttgttcttccgggaaccactcctctc

SEQ ID NO: 16468 - DNA, 201 bp, Homo sapiens
atctaaaagatgaattggcttcttaagccaattcattgtcacttgcttctgaagtgtttcccaggcaccttagttatcagccaccctgcccctagggtatygaggacaaatacgtttcaggtagcttgacaacaggaaagaattttaaggacaagaaactacctgcaataccagttgggagtgtcctgaaaagtgatgtac

SEQ ID NO: 16469 - DNA, 201 bp, Homo sapiens
cctccagcacacatgcatgtaccgaaatgcttagtatctgcttgatcactgacctcagtggctagtcgaagaatgaagataggcagtccctccaaaggggrcacatagttgtcaatcagaaggggtaatccaatcaggttcccttcctgcttgcaggaaaaaggacaagggaacaagaaataatgctgtcatagtttaaac

SEQ ID NO: 16470 - DNA, 201 bp, Homo sapiens
cttcgctatgcaatcattgaagttaacttggaatatttacttccagaatcattcttacagtcactctcatggaatgaagaagaggtcttctgattctcatraagacctactggttagttctgttgtctctcatatcacaattcacgaagtactgttaggaacttaaggattatgattgctttggtgtgctactaggacatt

SEQ ID NO: 16471 - DNA, 201 bp, Homo sapiens
agatcaggcaggttagcaagctgcaggatatttccatcttctgtgaaatgtttaggaggcagaatgtgtgagcgcaaggctttatagacaatgtgttccayagtccacttccaggagtttggaatggagccaggcacttcactctggaaaacacattagatgtcataagcctccctgtttgcatcccaacatacactggtg

SEQ ID NO: 16472 - DNA, 201 bp, Homo sapiens
attttaaatggttaagtagaatttctgctgatggcagctttctgaggctaatattataatacacacagattgctgtgggtagcatagtgaaaagaagtagragttttagtaattagtataaaattaaatattctaaaatttattggaataatttggtagtgggaagaggtatttggtgactaatttctctgttaaaagtga

SEQ ID NO: 16473 - DNA, 201 bp, Homo sapiens
aatgtattcagcaagtccttctttgggaccatcttcctctgtccagccactctctggactatctaaggcaagcatggcaaggtcaaagagcggtgctggcycctaggaagaagcaagaacatgaaggagcaagctttaacggagcatccaaatgaagcctgaattcccaagaatccactatcagaatggcaggtgagaaac

SEQ ID NO: 16474 - DNA, 201 bp, Homo sapiens
cccaggctgatctcaaattcctgggttcaagtgatcctcccactttggcctcccaaatcattggaattacaggattacagcccagcctagatttaattttkagttttttattttgattctgtcatattggtatttgtcttagtccatttggactgctataacaaaatatagcttttgtggcttataaacaactgaaattta

SEQ ID NO: 16475 - DNA, 201 bp, Homo sapiens
agaaactcaacaatgtattcagcaagtccttctttgggaccatcttcctctgtccagccactctctggactatctaaggcaagcatggcaaggtcaaagascggtgctggctcctaggaagaagcaagaacatgaaggagcaagctttaacggagcatccaaatgaagcctgaattcccaagaatccactatcagaatggc

SEQ ID NO: 16476 - DNA, 201 bp, Homo sapiens
agcatgggaggtggaggctgcaatgagccatgatcttgccactgcactccaacttgggtgacagagtgagaccctgtctcaaaaaaaaaaaaaaaaaaaaagaaagaaaagtatttggcatctgcctaataagtaatgaagtcaagcactatttgatgtcttttcttgttggttcaggtaaactgtttatgaattctgtat

SEQ ID NO: 16477 - DNA, 201 bp, Homo sapiens
cattccagatcaaagggtggtcatttgccctttccctccagcacacatgcatgtaccgaaatgcttagtatctgcttgatcactgacctcagtggctagtsgaagaatgaagataggcagtccctccaaagggggcacatagttgtcaatcagaaggggtaatccaatcaggttcccttcctgcttgcaggaaaaaggaca

SEQ ID NO: 16478 - DNA, 201 bp, Homo sapiens
gagcatgggaggtggaggctgcaatgagccatgatcttgccactgcactccaacttgggtgacagagtgagaccctgtctcaaaaaaaaaaaaaaaaaaaaagaaagaaaagtatttggcatctgcctaataagtaatgaagtcaagcactatttgatgtcttttcttgttggttcaggtaaactgtttatgaattctgta

SEQ ID NO: 16479 - DNA, 201 bp, Homo sapiens
attccagatcaaagggtggtcatttgccctttccctccagcacacatgcatgtaccgaaatgcttagtatctgcttgatcactgacctcagtggctagtcraagaatgaagataggcagtccctccaaagggggcacatagttgtcaatcagaaggggtaatccaatcaggttcccttcctgcttgcaggaaaaaggacaa

SEQ ID NO: 16480 - DNA, 201 bp, Homo sapiens
aagaaatgagtttataagagttgattaaaacaatcaatcaaacttgcttgctgatagataatatcttctcctgcccaccccttttgcgtggtaatgtcccrttctttattttcaaatctggtgtacaggttgtttttgtttttgttgtataaagctgagttttatattacttttcaggcagaggcaaggctggcagcaaaa

SEQ ID NO: 16481 - DNA, 201 bp, Homo sapiens
acccaggaggtggaggttgcagtcagccaagatcgtgccaccacactccagcctgggtaacagagtgagaccttccctcaaaaaaaaaaaaaaaaaaaaaagtgctgctaccagaagaggggagaagggatgctgagcaggctggacactaaggccacagccttctctcccttctctcaagccttagattcacactgctat

SEQ ID NO: 16482 - DNA, 201 bp, Homo sapiens
atctttatcattccagatcaaagggtggtcatttgccctttccctccagcacacatgcatgtaccgaaatgcttagtatctgcttgatcactgacctcagkggctagtcgaagaatgaagataggcagtccctccaaagggggcacatagttgtcaatcagaaggggtaatccaatcaggttcccttcctgcttgcaggaa

SEQ ID NO: 16483 - DNA, 201 bp, Homo sapiens
gaaattttagagatgggcaagtttcatctcctaaagattgtatgaggtcctgtcctagtcctggggtgccagtgtgcatcaccactgtacctgctggcctsagagggtcgactcctcagatatgtactgcttccggatggaatagaacatagcgcattctttactgaggctttcaaaacattccttttcttcgtcccaatt

SEQ ID NO: 16484 - DNA, 201 bp, Homo sapiens
gtatatcacactttgatacaacactttgtatcggaatacagagaaagaagaacacatcccacagtgcataaataaccatatttaacacctctcaaagactytgtatagatcaggcaggttagcaagctgcaggatatttccatcttctgtgaaatgtttaggaggcagaatgtgtgagcgcaaggctttatagacaatgtg

SEQ ID NO: 16485 - DNA, 201 bp, Homo sapiens
tggtacactttgtatatcacactttgatacaacactttgtatcggaatacagagaaagaagaacacatcccacagtgcataaataaccatatttaacaccwctcaaagactttgtatagatcaggcaggttagcaagctgcaggatatttccatcttctgtgaaatgtttaggaggcagaatgtgtgagcgcaaggcttta

SEQ ID NO: 16486 - DNA, 201 bp, Homo sapiens
gcctaaatctagtttccataatattctgatgagcaggaccacagagcagtgattttgatcaggattgtgcctgttaaaagctggctactccatggcatgcrcagctccaggatgggagattaacttcaacaaccattcatttagtttggtttgattttctgccagtctcatgaccgacttgaagcacgtcctagaacagag

SEQ ID NO: 16487 - DNA, 201 bp, Homo sapiens
taacctactgttttacgttaaaacattatccactttctcctacaatagaaattgtaatggctataatacatgattatttcattatcacatctatttttaargaaaccaggcctaaatctagtttccataatattctgatgagcaggaccacagagcagtgattttgatcaggattgtgcctgttaaaagctggctactcca

SEQ ID NO: 16488 - DNA, 201 bp, Homo sapiens
atatttgttttaagtagtaacaacaaacacatttatagctattatcgtgtccattgttataagttactagtattatgagtgcttcacttacattagctaargtagctttagcaatgacaaagtgtagtatagctttaattgtcctaaaatttggattaattatattatgatatctatatagtaaaacactgtaaagtcatt

SEQ ID NO: 16489 - DNA, 201 bp, Homo sapiens
aaattagctccccagcaaggcaaattcctggaggattaaagacagggagtgatcccagcaacatttctagttactaatgcctagggataggaagggcaatsaattaatttttccctcaggattccaactgaggttgtcccataaagtattgggtcatatttccaaagccacgttaggtcaggccttggttacccatcacat

SEQ ID NO: 16490 - DNA, 201 bp, Homo sapiens
atcatccccatcacactgaatcatggctagtctgtgtgaatgacaagatatgtagaagtaatggtgcatttcttctaagactaggccattaaagacacttrcagcttcttctgccattctctcttggatcattcactgtggaggaaaccagctgccatattgtgaggacactcaagcagccctatggagaggtcctcatgg

SEQ ID NO: 16491 - DNA, 201 bp, Homo sapiens
aatggaggcctggtgagaaaagactgtctcaacacctcagtcagggtcagcggaggagtgaccttccctgccccagggccagttcgatgtgtgagccttgragctgatggagggagggagaaggcatcatgctacctgcctcctctgggtctgatgctgcaagtgatggtgcagttggatatgtggaaaatgttatcctag

SEQ ID NO: 16492 - DNA, 201 bp, Homo sapiens
tgttcatttatagaataacataactaccaagtaaagaaatgcaaccactggcatgttatatgaagggaggaaatggaaagattatcagttgtgttggagayatgaggatagtgggtagtcaaaatatgatactttaaaaatatttttgataattcttaggacaaatgactataaaagtaggagaaataattatataggttc

SEQ ID NO: 16493 - DNA, 201 bp, Homo sapiens
cagagagaaacatgcttgcaggactactcagaatggtggcttcttctgctaatggaggcctggtgagaaaagactgtctcaacacctcagtcagggtcagmggaggagtgaccttccctgccccagggccagttcgatgtgtgagccttggagctgatggagggagggagaaggcatcatgctacctgcctcctctgggtc

SEQ ID NO: 16494 - DNA, 201 bp, Homo sapiens
agggatgggaggacggaataattagatgattctccactccagaatagatgctgcaagttggtgtgtcccaaatgtcagtgggacatacatatctctggggktacataaggggattttaggtgctccttggcatttcctaagtatgatctgcctttcatggtgacccttttcctctactgccctttaggggaaagggcttgc

SEQ ID NO: 16495 - DNA, 201 bp, Homo sapiens
tatttccctgcttgatgtgattaaacatgttttgccaaattgatgcatgagaaccagtttctatgagaagtctcttctggagatgtatatccatgtaactytgtatttcctcccatatctgactgtttgtttccaatcttttgactgctttcttgctttttatgcctttatctttgcttatttgaattaggtacttctctg

SEQ ID NO: 16496 - DNA, 201 bp, Homo sapiens
tgctggtattttaaaataatgtgaaattctttccctttttgttcttttatctttttgtgccaaaatgccaaccacataaaataataaacctgctttgggggctgcttctcaaattcaatagcttaagttaggactggtaaagtgttctagtaattaattgtaattgcatttaagaagaatataatgcttgatttctatagt

SEQ ID NO: 16497 - DNA, 201 bp, Homo sapiens
cggaggctgaggcaggagaatcacgaacccgggaggcggaggttgcagtgagccaagatcatgccgctgcactccagcccggacgatgacagagcgagacmccgtctcaaaaaaaaaaaaaaaaaaaaagattcaaatccttggaagagagagtgtgaatggcctagtttgggtctctgggccacacatacccatcgacca

SEQ ID NO: 16498 - DNA, 201 bp, Homo sapiens
gttgcagtgagccaagatccagccactgcactccagtctgggtaacagagcaagactccatccccaataaataaataaataaataaataaataaataaatwaataaatccctatgcttcaatatcctaaggaaaagacccacctgcagtttatgataacacaatggctatgtctatatttgtgccaattggccttgaagat

SEQ ID NO: 16499 - DNA, 201 bp, Homo sapiens
atatgttttagactttttgaagggttgatgtcagttcaagcagaggtcaaatgggtattattgccagaaatggattgctactacattgccaatataaaaaatccagaaaataatttaggaagtgcatattgataaattgttagaaacagcaatctgaatttgcacataataaagggagagaagctgtttatataacctgta

SEQ ID NO: 16500 - DNA, 201 bp, Homo sapiens
aatgggggctgtccgtgaagccttgtggcagtacagcccaggtaatttgctgagcctgatgggtgtcagggtcagtccaagtgaaagcaaagagaggctgrgatgaagggtgcaaggaatagtaaagaaagcatgtttgagatccagaacagaataatgggttatggaggggttgtggagggaggtactgaggataggaga

SEQ ID NO: 16501 - DNA, 201 bp, Homo sapiens
tatctctggggttacataaggggattttaggtgctccttggcatttcctaagtatgatctgcctttcatggtgacccttttcctctactgccctttaggggaaagggcttgccagttctggacaaggccagcagagagaaacatgcttgcaggactactcagaatggtggcttcttctgctaatggaggcctggtgagaaa

SEQ ID NO: 16502 - DNA, 201 bp, Homo sapiens
atccagctactcaggaggctgatgaaagagaattgcttgaacccaggaggcagaggttgcagtgagccaagatcacgctcctgcactctagcctgagactytgtctcaaaaaaaaaaaaaaaaaaaaaaaagaatcacctgcagatggtttttctactcagtaatgctggagaaccactcacttaagctgaaaactaaaaa

SEQ ID NO: 16503 - DNA, 201 bp, Homo sapiens
ttgtatagatcaggcaggttagcaagctgcaggatatttccatcttctgtgaaatgtttaggaggcagaatgtgtgagcgcaaggctttatagacaatgtrttccacagtccacttccaggagtttggaatggagccaggcacttcactctggaaaacacattagatgtcataagcctccctgtttgcatcccaacataca

SEQ ID NO: 16504 - DNA, 201 bp, Homo sapiens
cctggatacctgcaaagccaatctaaattgaccattgattacacatggtaacttcttcatctgaaacccacatcttcccccaaccaccctgccctgttttyagtttccacagcaaacatatttttaaagaaatgagacttagaagggtcatatttctctttctagccttcatctcgaaattctgcctcagcaacaacccct

SEQ ID NO: 16505 - DNA, 201 bp, Homo sapiens
ccggctggaaattttatttgaagaatacaacagaagtataagaatggctgtcacacctcatcaatttccaaagagaaatagtctgcaagcatctcagcctwcttcttcagaaactcaacaatgtattcagcaagtccttctttgggaccatcttcctctgtccagccactctctggactatctaaggcaagcatggcaagg

SEQ ID NO: 16506 - DNA, 201 bp, Homo sapiens
ctacaaatttaaaagttctgtgagtttaaatacaacctaatgcatttgttctgggagtgatcaaagcccatgattttcactgtctttttttttttttttttgagacagagtcttgctctgctgcccaggctagagtgcagtggtgccatctcggctcactgcaaccttcgtctcccaggttcaagcgattcttctgcctca

SEQ ID NO: 16507 - DNA, 201 bp, Homo sapiens
cacctcagcctccctctcgtactgatcagtgcccaaagtccagagggggccaaggcagcagggggctgctgtgtcacaacctggctgggctgtgacagcayccaggcttgaccccaaccttgctccaagatcggagtgggtgccaggagcagagagagtccaggaagtgggaacagacacctctgagtctgcaggggcagg

SEQ ID NO: 16508 - DNA, 201 bp, Homo sapiens
tgtcatctccccaagtctgcctgagtctggggtttttatgggcttcagagcagaggacgtgcatgctgattggtccatgggcagccatgggcaggcccagraaaagcaccacaagtttccactctggtccatgggaccaacagcctggccatcaggcttcaggctctccccagcttgaaggtggagcttcactggagacct

SEQ ID NO: 16509 - DNA, 201 bp, Homo sapiens
caccatatttaacagcagctttgtattacggtcaagattgtttgaagaattcagcatacaaacttaatttacagatgcaagcctgcagatggacctccccmcccccacttttttgctttagattaggttgtgactggaggaaatttagttttcctttgccttcagttatttgcagctgttcacatttatgatgatgagaat

SEQ ID NO: 16510 - DNA, 201 bp, Homo sapiens
ttaagtatatttgttgacccctgatgggatcccaaagggcccagaggtttaaaaagtatgaaatccctagctggttttggttggcttacttatgcacctcmccttctttaattttttgaggtggtgtcttgctctgccacccagactggagtgcaatggcacgatcttggctcactgcaacctccgcctcctgggttccag

SEQ ID NO: 16511 - DNA, 201 bp, Homo sapiens
aaataatattagttaaggaaaattcaaagtaaaattccccattttccttccccaaatgtaatctctgttcttcaataacctttcagagatattttatgcaygtatgagtgctctttattttgagtgcaaatgggtcatattacatactgctcctcaatatattttctttatttaaagtagctttctgtatcagcacctata

SEQ ID NO: 16512 - DNA, 201 bp, Homo sapiens
gaaccaggggcaagttaggtaaatggtccctaatgtattctcattagaataatgaggtgatcattgttgtaaaacctttcttcttggaaactttatagccwtctgaatgcagttattattcatcaagaataagttcagcccgaagcagtccaggggtgagctgtctagtctctgcatgctttgtagaaatttttgattgtt

SEQ ID NO: 16513 - DNA, 201 bp, Homo sapiens
aaggaataatacagtgaacatcacatacctatcatttagattatataattcattatatttcctttatcacataattatctatttgaccctctaaccatcarttcatcttagtttttgatacatttcaaaataagttgtaagcatccatatacttcagagtgggtacccttttaaaaaagcttacatataaaaatgtaaaca

SEQ ID NO: 16514 - DNA, 201 bp, Homo sapiens
aatacaagaaagccatggtttccaatgcacagttagacaatgagaagaacaatttgatctaccaagtagacacactcaaggatgttattgaagagcaggargaacagatggcagaattttatagagaaaatgaagaaaaatcaaaggtaatgcttatcttgtattttctcttggggcagaaaataaaagcctgccacttac

SEQ ID NO: 16515 - DNA, 201 bp, Homo sapiens
ctgttctctttgctttatccgaagttgcctagaatagcaataccaacattaacaccaacaatttaattactgaaaatagttaaaagatttttattttgttkgttttgcttggctgttatttttgccactagtctgtgtgtggccaaactattgtttttagaagttacttgaaatagtttctttctgcgcttctaactggat

SEQ ID NO: 16516 - DNA, 201 bp, Homo sapiens
ataaattgttttcattccattttctctgagggtttattgtcttgtttttaaatttaaaaatttagtaatgtctttgttttaggggcttgaaataattgtcrctttgacttaatgtgatatgatgatttaaaaacattttggagaagaagggatttggcaatatcatattttgcctttttgtgttcagttttgcctttgtgt

SEQ ID NO: 16517 - DNA, 201 bp, Homo sapiens
tctttctccagttatttgaacgttagtccctatggactgatactttaaccttatatatttttctttcttattttctacctctctctcttttttttttttttctgttttctgtaagacttcttgaactttatttcccaacctgagttttgtaaaactaatttttttattgaggtactactcgtgtgtcataaaatttacccc

SEQ ID NO: 16518 - DNA, 201 bp, Homo sapiens
ctcaagggatccacctgccttggtctcccaaaatgttgggattacagacatgaaccaccgcacccagcctgttttctctttctccagttatttgaacgttrgtccctatggactgatactttaaccttatatatttttctttcttattttctacctctctctcttttttttttttttctgttttctgtaagacttcttgaa

SEQ ID NO: 16519 - DNA, 201 bp, Homo sapiens; identical to SEQ ID NO: 2693

SEQ ID NO: 16520 - DNA, 201 bp, Homo sapiens
gatctctcccgctaagggctcagcctttaggaacacacttgacatttgagttgtctgtctactagtgaaagcttgaaacaaggaaatgacctcctttgtayttctgtttgtctttaagtggcaaatcactgctgtggggaacaaatgttggatttggtgccctgataaatatcagttgtgtggaaatactttttagatagt

SEQ ID NO: 16521 - DNA, 201 bp, Homo sapiens
gaaatgatgttaaaagtgataataattttcttaaaaagcatttttgactttagaatgcttaattcttgtatttaaaggctcccttaggatgttttgtgctrtagtgtactgagattgaatcatatcactattactgattatgaattttgttgtttaaaagaaaaataaacatacagttttgaatatacatacagtttagca

SEQ ID NO: 16522 - DNA, 201 bp, Homo sapiens
tcagcatctgggtcactgtaaggcaataagtgtaactgtaaggcctgtggatggaagtactatgggcctatacacatcggtttttacttaactacaaactkttctgcaaagagatagtctagtatacctgtgctaggggagcagtaggctagcaggagacttctcaagtgtgttataagtttctcatccttggaacatctg

SEQ ID NO: 16523 - DNA, 201 bp, Homo sapiens
cagttttgttcttaccaattgaggaaaaggtttagttctttaagttgtttgataccaccaaggaaacactggaaggagttaatgtgctcctgaagaaaagkgttcttgaggaaaccttagggtagaaatttactgcaagtcctttaggatcagaaacaaaattatttaaggtttcctttgagtctacattctcagttttgt

SEQ ID NO: 16524 - DNA, 201 bp, Homo sapiens
cccggatttgaggaaagacttaggaactagagaaagaaatgagtttataagagttgattaaaacaatcaatcaaacttgcttgctgatagataatatcttstcctgcccaccccttttgcgtggtaatgtcccattctttattttcaaatctggtgtacaggttgtttttgtttttgttgtataaagctgagttttatatt

SEQ ID NO: 16525 - DNA, 201 bp, Homo sapiens
tagtcgaagaatgaagataggcagtccctccaaagggggcacatagttgtcaatcagaaggggtaatccaatcaggttcccttcctgcttgcaggaaaaasgacaagggaacaagaaataatgctgtcatagtttaaacaaatcccatttctccagtgctttcccaggccttgtgctcctatctgccactctgggtgacca

SEQ ID NO: 16526 - DNA, 201 bp, Homo sapiens
cccatggatgcccacatcttttttttttttttttttgagacgaagtctcactcggtcgcccaggcaggattgtagtggcgcgatctcagttcactgcaacrtacaacctctatctcccaggttcagacggcttcccgagtagctgggattacaggcgcctgccaccacgcttggttaatttttgtatttgtttagtagaga

SEQ ID NO: 16527 - DNA, 201 bp, Homo sapiens
aaccactgtctgattgctgctaaacaagcaactttctttctttctttctttcttttttttttttgagatggagtttcgcgcttgttgcccaggctggagtkcagtggcacaatctcagctcactgcaacctccgtctcctgggttcaagcgattctcctgcctcagcatctcaagtagctgggattacaggcgcccgccac

SEQ ID NO: 16528 - DNA, 201 bp, Homo sapiens
tctttgttcttttctagttggatgaaaaatctgacaaacagtatgctgaaaattatacaagagtgagtatgtaaattcctaagggaaattctcaaggtcarttaaacttgctatctgtaacttgttcattatttattttacaacaattggtctgatgtagctgctcttcctcccttcatctatttcctgtccttgaccctc

SEQ ID NO: 16529 - DNA, 201 bp, Homo sapiens
cccactttccctccctgcaacattccaattttgaaattttaaatcaatagttggtgttttcattataatgaaataaatattgtttactgatcagccatgtrgtatatcatacttgtttcctttcttgtttaactttgttttttcagggagttaaaatttgccttttacatttacataattttctgtttacctgttgctttc

SEQ ID NO: 16530 - DNA, 201 bp, Homo sapiens
tattttggtgacagtactccattttgttcttccgggaaccactcctctcctatagtccatgatctttgggtggaccagaggtaaagcatatgactcaaatytggctaatcatagcacaagagttttccttgctacagtaatttgttaaaggatgggaaggtaactctctatcctttaacaaattactgtagcaaggtaatt

SEQ ID NO: 16531 - DNA, 201 bp, Homo sapiens
gaacattgaaaatgccttctaggaatatggcattgcggggtgtatacaaaaaaatagatcttttctcaaaaagcatgtaatctgcttgggaagacaagaayattattaaaaaaaaccctttagaacacaagtgagttgtggacagtaatacatataaataatctgaatggcagtatataataactgataactatctacaac

SEQ ID NO: 16532 - DNA, 201 bp, Homo sapiens
tgagaacagcctggccaacgtggtgaaaccccatctctattaaaaatacaaaaattagccaggcgtggtggcacatgcctgtaatcccaggtattcaggargctgaggtaggagaattgcttgagtcagggagaaggaggttacactgagctgagatcgcaccactgcactccaacctggccagcagcgagactctgtcaa

SEQ ID NO: 16533 - DNA, 201 bp, Homo sapiens
tcccttggctcacatagtcctcccacctcagcctcccaagtagctgggactacaggtgttcgtcaacatgtctggataattttttttttttgtaaagacaraatttcaccatgttgcctagtctggtcatttttctaatattggtaaggaaatctgcctacagggtccaaataatacagttcttttaaaagtactaggtta

SEQ ID NO: 16534 - DNA, 201 bp, Homo sapiens
gttctttgctacctaggcttatattgttctttctaatacttctagtcttttcctgttttctgctttatttcatacttttttttttttttgagaggagtctygctctgttacccaggctggagtgcagtgatgcgaccttggctcactgcaacctctgcctcccaggatcaagcaattctcctgcctcagcctcccaagtaa

SEQ ID NO: 16535 - DNA, 201 bp, Homo sapiens
catttctcaggtggctaaatgaaaaaagaagaaacatcaagatacgttctgtacaaaaaggtaaagaatggttagtctgaaggttcaggtttctgcaagcraagggactctgccacattgctggcaacatcttaggaatggaatgaagcatagtctaccaagaactctttgaaaacattagtcatccttgcaggcctgcta

SEQ ID NO: 16536 - DNA, 201 bp, Homo sapiens
cttgattctttggttctttgctacctaggcttatattgttctttctaatacttctagtcttttcctgttttctgctttatttcatacttttttttttttttgagaggagtcttgctctgttacccaggctggagtgcagtgatgcgaccttggctcactgcaacctctgcctcccaggatcaagcaattctcctgcctcag

SEQ ID NO: 16537 - DNA, 201 bp, Homo sapiens
tagcagtcttagacatagcaaacccacctctgcctactacactcgggtttgtctaaacttttttggctttatgtgtttgattcacttttaacatatttctratctccccattttgcattttgactagctgtaactaatctgtaaatggctacgtatatactagtttttggtaactgaatttatatagtctgtgggagtctc

SEQ ID NO: 16538 - DNA, 201 bp, Homo sapiens
ccacagtgcataaataaccatatttaacacctctcaaagactttgtatagatcaggcaggttagcaagctgcaggatatttccatcttctgtgaaatgttwaggaggcagaatgtgtgagcgcaaggctttatagacaatgtgttccacagtccacttccaggagtttggaatggagccaggcacttcactctggaaaaca

SEQ ID NO: 16539 - DNA, 201 bp, Homo sapiens
gtattttatctgctgcttatttgtggaatgaaacctcaaacaaacccaaagggggagggtagggcagggcaggcagattggaaatctgcctgcagattctrttaaatacacccttttgccaaccacaattggctactgacatgttcattttgttataggagactttaaaacaaatcatggcaaccacatccctcttctttt

SEQ ID NO: 16540 - DNA, 201 bp, Homo sapiens
aaaaccataggaaactatagctatcagtttttgtagatatttcaggagaattcaagatcatcatttgtaataaaatcccttacgcattccaaaaagtgtamgaacttttccatttagtgtctcttcctatattgctttggcacttaaacaatatggtcataataaaacttagcatgggaaattggccctaaaatgactcta

SEQ ID NO: 16541 - DNA, 201 bp, Homo sapiens
gtggtgccatataagccttggactcctgggctcaagcttcctgaggtagctgacattactactacaggcacaaacctgggcctttttttttttttttttttaccccccagaaggctctctctttatttgtctgacctgaaatgggcataagttgcaacagattgaaaattctaactctaccttcattttcagaagtgtcta

SEQ ID NO: 16542 - DNA, 201 bp, Homo sapiens
gggagttgaggatgcattgtccattcgaagtgttggcagtcacagggttggtattttaacttgtctacacaatacaaagcttacgtgtgagctttcttcartaatgttgcctaaacaatctgacaatgttcctgtatttctttgcgtttttaaaagaagtataaaatattggcaaagacctttcattggaaaatgatgctt

SEQ ID NO: 16543 - DNA, 201 bp, Homo sapiens
gctcatttgtttaggtctttgatccattttgagttttttcttctttctttctttctctttctttctttctttctttctttctttctttctttctttctttctttctttctttctttctctttctttctcttttcttttcttttcttttcttttttttgtgacagagtttctctcttgttgcccgggctagagtgcaatggt

SEQ ID NO: 16544 - DNA, 201 bp, Homo sapiens; identical to SEQ ID NO: 2696

SEQ ID NO: 16545 - DNA, 201 bp, Homo sapiens
attgttctagtagaaattggtatgcccaaattatggattttcctaccagatagattcaacatttttttttaaaccagctgaattctacattatattttggraaaggaaaattgaaacaggttatttccagtttggcttgttaaatcctatgcctgtgtaaaatgccactggtgctatagagaggatgataagaggaaagac

SEQ ID NO: 16546 - DNA, 201 bp, Homo sapiens
taaatttccttgtggtttgctatataattttggagttatgcatttctcagccagttatttttaaaaacttaaggccgtgtactaagaggtctaatactttytgaacgtagtatttgatgtttgaacattagcagtacctgaatgtgaggtggatatatttatggtcttatgctgcattcttaggactttaggtttctcctt

SEQ ID NO: 16547 - DNA, 201 bp, Homo sapiens
atcatgcagggagtcagtcaataaaagctttaaagttaagtctcaaaggctgtgaaaataatcctcttcttgtatttatggctttttcatttgcttttcaktataatgttcgcagtgtgtattttcacacagttgttattaagccggttatttataaatttgtatgtggccttaggaaatttgattatatatttgtttaac

SEQ ID NO: 16548 - DNA, 201 bp, Homo sapiens
atcagttggatccgtgggcggaggttgcagtgagctgagatcgtgccaccgcactccagcctgggtgacagagtgatactctgtctcaaaataaaaattaraataaatattttgtaaagaatcatgcagggagtcagtcaataaaagctttaaagttaagtctcaaaggctgtgaaaataatcctcttcttgtatttatgg

SEQ ID NO: 16549 - DNA, 201 bp, Homo sapiens
tacacagagctatatttcatgtaactgattctaaccaggttttacctgtagcaaacatgtattgttgcagagtgacctcacagagcttacagcttccataygggccttttgtgatggtgggtttttcccccctgcagaaacatggcttagttataatccccgatggcactcccaatggtgatgtcagtcatgaaccagtgg

SEQ ID NO: 16550 - DNA, 201 bp, Homo sapiens
tgaacagcatttattccaacatatatttatttaggcatacactgtgtgcacttggctaggtacataggtagatttaggaaggccaagacagggcccctctycttgcttacacatacgatgtttaaaaagcatgacaaatgtcataaaaatgcaaataaaatacagcaagggaaggacttataattaaggggagtcatgaaa

SEQ ID NO: 16551 - DNA, 201 bp, Homo sapiens
gttttgccatgttgcccaggcagggtcttgaattcttcggctcaagggatctgcctgcttcagcctcccagagtgctgggattacaggcatgagctaccaygcccagcccaaaatttttatttttatgtagtctaatttattgtaccattacctcattgcttgtggatttttgagtcattttttcagtaaagattgcccca

SEQ ID NO: 16552 - DNA, 201 bp, Homo sapiens
ttagactttcctggaaacaagtctgaaggctcactactaatttcatttaaaagaaatataattgagataaaactttttctgttttacccaaataatattgwgagttctaagttttcatcaaattatttgcttttaaaataatttttccattaagctgaattgttagacaacttttgtcctctgtagatggcctaaacactg

SEQ ID NO: 16553 - DNA, 201 bp, Homo sapiens
atcgtccttatctggtttgtaataacctatacacttgcctctaatacttttcctcattagcttaatgtaatcactcacaaacttttactgtgtttattttyatttttatcagggagttgaggatgcattgtccattcgaagtgttggcagtcacagggttggtattttaacttgtctacacaatacaaagcttacgtgtga

SEQ ID NO: 16554 - DNA, 201 bp, Homo sapiens
tgagaccagcctggccaacatagtgaaaccccgtctctactaaaaatacaaaaaattagctgggcatggtggtagccacctgtaatcacagctacttgggrggctgaggcaggagaattgcttgaacccgggaggcagaggttgcagtgagccgagatcgtgcctctgcactccagcctgggcaacagtgcgagaatccat

SEQ ID NO: 16555 - DNA, 201 bp, Homo sapiens
aaataagtccacaaaataaagtctattctattcattttacccgaattattccagtttttctcatttttctacttctgacctcataataaaatgatcactgyagtcacactaattcccatagtaggaagatttcagcaggaatttgtagttagcctttgttagtgattatgtgtaattctcggacagaggagattttcattt

SEQ ID NO: 16556 - DNA, 201 bp, Homo sapiens
cccggctggaaattttatttgaagaatacaacagaagtataagaatggctgtcacacctcatcaatttccaaagagaaatagtctgcaagcatctcagccktcttcttcagaaactcaacaatgtattcagcaagtccttctttgggaccatcttcctctgtccagccactctctggactatctaaggcaagcatggcaag

SEQ ID NO: 16557 - DNA, 201 bp, Homo sapiens
ataaataaccatatttaacacctctcaaagactttgtatagatcaggcaggttagcaagctgcaggatatttccatcttctgtgaaatgtttaggaggcasaatgtgtgagcgcaaggctttatagacaatgtgttccacagtccacttccaggagtttggaatggagccaggcacttcactctggaaaacacattagatg

SEQ ID NO: 16558 - DNA, 201 bp, Homo sapiens
ctttgtatagatcaggcaggttagcaagctgcaggatatttccatcttctgtgaaatgtttaggaggcagaatgtgtgagcgcaaggctttatagacaatrtgttccacagtccacttccaggagtttggaatggagccaggcacttcactctggaaaacacattagatgtcataagcctccctgtttgcatcccaacata

SEQ ID NO: 16559 - DNA, 201 bp, Homo sapiens
tatttccatcttctgtgaaatgtttaggaggcagaatgtgtgagcgcaaggctttatagacaatgtgttccacagtccacttccaggagtttggaatggarccaggcacttcactctggaaaacacattagatgtcataagcctccctgtttgcatcccaacatacactggtgtcctggctgatgggatgtgcactgggtc

SEQ ID NO: 16560 - DNA, 201 bp, Homo sapiens
cttgctcttttcgatgtttgttcgtagcttatctttagcacctaggacgatgtgtgtctcctattaggcactcaagaaaataggttttgaatgaatgtggstgatacgataagggtctgctttgttctatgatgtgaccatagaataagcatcggcttcatttgagagattggatcttgctgatgaacctttattttcatt

SEQ ID NO: 16561 - DNA, 201 bp, Homo sapiens
tctattcaaaaataattttaaaatatatcacaataagttatagagcatatatttcgtctactaggttggaatcagtgttggctccttgctactcctgcttrtccatgttgcttcaagcatctagtaataatgtatagaaagaaccagataaagtagttttaaatcctgtttatttcttttaaagcatgtggttttaatggc

SEQ ID NO: 16562 - DNA, 201 bp, Homo sapiens
tggtcatttgccctttccctccagcacacatgcatgtaccgaaatgcttagtatctgcttgatcactgacctcagtggctagtcgaagaatgaagataggmagtccctccaaagggggcacatagttgtcaatcagaaggggtaatccaatcaggttcccttcctgcttgcaggaaaaaggacaagggaacaagaaataat

SEQ ID NO: 16563 - DNA, 201 bp, Homo sapiens
tatctgcttgatcactgacctcagtggctagtcgaagaatgaagataggcagtccctccaaagggggcacatagttgtcaatcagaaggggtaatccaatyaggttcccttcctgcttgcaggaaaaaggacaagggaacaagaaataatgctgtcatagtttaaacaaatcccatttctccagtgctttcccaggccttg

SEQ ID NO: 16564 - DNA, 201 bp, Homo sapiens
ggtacattggaaacacccatttcctgttaggctgcaacagtactggcaaaggaagtgcagtcccaactccttgctaattcagggttcccatgggttgaacsgggagagggttggaaggctttggttggtacaagggaggagagaagggagaatgtaatggggaggaaattaacgagaggccctggaaggtagggtcttggg

SEQ ID NO: 16565 - DNA, 201 bp, Homo sapiens
taatattttgtcaataggttgcctgagtttctaaattacatagacatctcttaaaatattcagagtaatgtataaaaagatgcatattcaaaaaaaaaaaagtaaaatgagtttttaatcattgattgggaatacagctatatatatgtgagatggtttacctagagcagtctgttgcctttggctcttgataggtagggc

SEQ ID NO: 16566 - DNA, 201 bp, Homo sapiens
ggtttataagtgattgctttgattttactccttcccccccttttttttttgccagatgtgggaagataaatgaaggggtctagatgtaaatgtcagtggaraggagagctaccatcactaaggtatgaaaatgttcactgaaagaatttgcactatacaaaatagtcttttgagtggaaagcatcacccatttttgtgatt

SEQ ID NO: 16567 - DNA, 201 bp, Homo sapiens
gttgtttatgtagagcatgttgtgacagtgatcatttacccacttatatgtggtgatacatgacataactatgcatgcagataccagtaaccaaaaatacytaatccataaagtgacactcaacacatgggaaagtattgttgtgctttgttttcccaatgtttcagttattattaattattaacataatggagtgttaac

SEQ ID NO: 16568 - DNA, 201 bp, Homo sapiens
gatggtgagaccaattcatctttgtttttgtttttgcttatttattttgtttttgtctcttagcagtcttcttccctgtacagtgaccctctggcaacatrtaagagtgacagggttagtactttctgaggaatgttctgcctttagagctaccagttgctttttttggggtttaataatacacttttttcttaggcctct

SEQ ID NO: 16569 - DNA, 201 bp, Homo sapiens
agtttctttttcagagtttttacagcaagaagtaacaaagagttaaatgtctaaaaatagtgtttatattactgatgtaatactatcatcataataaagaatatttataaacataagtgtgggtaataaaaagaacactaaaaactttcagatatgtggaagttagggtgaagtgttctgagtagagccagaaatgatgtt

SEQ ID NO: 16570 - DNA, 201 bp, Homo sapiens
gtcagggaatctggcaaaactaaagtgtttacaagatactacggtaaatatctagaagaaatgtgattgggagagtagattgctctatgtggttttgcttytaagctaagcttatcacgctttagctctcaagaataaggaaaagcaaaacatgtctgtgctgtgaaataagtcttcagcccatctaggctccaggaactt

SEQ ID NO: 16571 - DNA, 201 bp, Homo sapiens
ggtgagctgtctagtctctgcatgctttgtagaaatttttgattgttgcgttaatctgtactcactgtttagaatattgaggatatggtgtgattcacttygttgtgcatggattaggtgttcccttagtacataaactcaagcactaatttgtcctaataattggtgatttctctataaatgtgacttagcatgtaattt

SEQ ID NO: 16572 - DNA, 201 bp, Homo sapiens
ataatagttctgtattaaaatagaaaagccagcagagagcacttgttgggacattttagccttctgttttctctaaaaccataggaaactatagctatcaktttttgtagatatttcaggagaattcaagatcatcatttgtaataaaatcccttacgcattccaaaaagtgtaagaacttttccatttagtgtctcttcc

SEQ ID NO: 16573 - DNA, 201 bp, Homo sapiens
aaagaaagaaatgtcagggactgtgaagagaacagataatgtgatagggaacctggaggggtctatgtgtgtgggttaccctttggatggggtgattagaratgcttctctgagaaactgacctttgagctgagacctgaaatgtgaggagccagttgcttgaagagctgggaggggagcgttctaggccagtgccaaggc

SEQ ID NO: 16574 - DNA, 201 bp, Homo sapiens
tctaaataattggatagaagtctttaatcagttatttaaaatcagcaatttggagatgtgggtcagaaattgaaagatgttttctttagaggtttataagytgtaatgttaaaatgtacagatggagaatataacgcattgtccaaggcccagatttgctctctgacaactgcagaaaacaaattggattcttttaaaagc

SEQ ID NO: 16575 - DNA, 201 bp, Homo sapiens
tttgtatatgaatgtcattgaattgtatatgttcattttataacctgttactttactaaattatcttttgtttttaataattttgccattgattagttcasgttttcctgataattatacaagatggaattttaaaattttcttaacttttctatagaatacacaatttttctaagttactatgaatcaggagtttgggca

SEQ ID NO: 16576 - DNA, 201 bp, Homo sapiens
accactgatctactttctatctatagagttccctattctagactcatatgaaaggagtcatataatacatggtcttttgtgactggcttctttcgcttagygtgatgttttcaaggttcatccatgttataccatgtatcaatacttaattcctttttatagcctattaatattccatttttttgggtatgctacattttg

SEQ ID NO: 16577 - DNA, 201 bp, Homo sapiens
gtttcactttgttggtcaggctggtcccgaactgacctcaggtgatccacccacctcggcctcccaaagtgctgggattacaggtgtgagccactgcgccyggcctatttaatgttatttttaagcagctttattgagatataattcaaataacatacaaatcatccatttaaagtgtacaattcagtggtttttagtata

SEQ ID NO: 16578 - DNA, 201 bp, Homo sapiens
tttattttattttatgttattttatttatttttttaaattttatttattttatttttttagacgagttttgctcttgttgcccagggtggagtgcaatggygcaatctcggctcactgcaacctctgcctcccgggttcaagtgattctcctgcctcagccttctgagtagctgggattacaggcatggaccaccacgcct

SEQ ID NO: 16579 - DNA, 201 bp, Homo sapiens
catattatatatctaatcaatgttaaaatttcagtagtttcaaaatgtcataaatgatttttcttttttacacttaaaaaaatcgggatccaggtaagttkcacaccttagaatgagttgataaatcttttaagtctcttttcatgtataggtcctctttcatgttttttctccttataatatatatgttgaagaaactgg

SEQ ID NO: 16580 - DNA, 201 bp, Homo sapiens
ttacagacatgagccaccacaccccgcataatctttatttttaatgtgtatgtaactactaggtattcttcagtgctatgattacctctgccttccttttyttttccactctagatttttaattgcaattcctaattcccatgcctttttttcacctagtcatccacacttcttttttttttttttttttttttttttttt

SEQ ID NO: 16581 - DNA, 201 bp, Homo sapiens
cttaattaaagacttttaagtgaatttttttttttttttttttttttttttttttgcgcatagggcttactcattgggctcaagcaatcctcctgcctcarccctgcaagtagctgggactacaggtgtgagccactatacctggctaatttttgtgtcaaaaccccagctgcctttttttcctccccttctttttctttc

SEQ ID NO: 16582 - DNA, 201 bp, Homo sapiens
atgcatactttcacctaagcccacacttcctactccctccctgttcccattgcttacccttcccttccccagagcccctttgtcttctagaacttctggtrtcctggagaataggagatgaagttgaagctgaggtaatagcctagcaatggaaaggggacctggaggtctaactacttaattaaagacttttaagtgaat

SEQ ID NO: 16583 - DNA, 201 bp, Homo sapiens
gtggaggttgcagtaagccaagattgtgccactgcactctagcctgggcaacagagtgagactgtgtctcaaacaaacaaacaaacaacaacaacaacaamaaaaaaactgattctttggtgtgagttggttgaaggtaaacaaaataaataaaaagaaaaagaaaaaaagaaaaaaattaaactgattcttctgctcatt

SEQ ID NO: 16584 - DNA, 201 bp, Homo sapiens
ttagaaatagttttaaagcaggcaaccactgtgatcttagaatatcgagacaaatgctgccattactgttaatatttggatgacaaatccttgttgtacaygcaaccttaggtggtttgaaggagcagtctgtaggaaaatgaattgccaaaaagaatacaccgctttgatatgggctgtcattaggtcccataattgtgg

SEQ ID NO: 16585 - DNA, 201 bp, Homo sapiens
tagggcgtagcattttttgggaattttacttcttcctccttgacctgagctggatcgcgcgggtttaacaggcgctagctgggttaatacttgactaataygaggcgttattgacacccagattgttaagttacagaactccagtcagccctgcctgtgagtaaccagcagcatgcaggaggacctaaggaaacccacttc

SEQ ID NO: 16586 - DNA, 201 bp, Homo sapiens
tgggcgtggtgctggatgcctgtagtcccagttactaaggaagctaaggcaggaagatcacttgagcccagaagttcaggactgcagtgagctatgagcaygccattgcactccagcctgagtgacaaagtgagaccctgtcttaagggggaaaaaaaaaaggagaaaagccaatttgttaccatggtcaccagtatgatc

SEQ ID NO: 16587 - DNA, 201 bp, Homo sapiens
tcattttatttcttggtactttatcacccatcaaaattttaaaaaacttttccctaattggccaatgttcttatttttttctttcttttttcttaaccttkaaagcatcttgttttttttctgaccgaaaggtatctgccgctgattatttcagtcgctccaatcgtaggggaagtgttgtctctgaggtggatgatatca

SEQ ID NO: 16588 - DNA, 201 bp, Homo sapiens
gctcaaggtatctgcccaccttggcccctcaaagtgctggattacaaggcgttagccaccatgcccacccagtattcttgttttgacagttagatgtttaraaacttttttaaaaaatccagtcaaatgacgagtcttgtattcctctgttttcctttgataacaatctgtgaaaaaactgcagtggtcagaagatgtgtt

SEQ ID NO: 16589 - DNA, 201 bp, Homo sapiens
ttcaaacaccacatctgctcccaaccacttcctaccacttccactgctacctgaattattgttatagcctaactggtcttcctgctctcacctttgctccyctaaagtctattcacaataaccagtttaaactattattttattaggaaaaatttcaaacacacagcaaagttgaaagaattttacagcaatcacttctgc

SEQ ID NO: 16590 - DNA, 201 bp, Homo sapiens
gaggaaattaacgagaggccctggaaggtagggtcttgggatctctggggagaggtgagccttaggtgcctagttgagggtgtgagtggggagtgaggagyggtgtgggaaggcagggctaggggtggtagggatggggtgggagtagggatgtcctcaactccactgtcaacactgatggagtctttaagtcagagattg

SEQ ID NO: 16591 - DNA, 201 bp, Homo sapiens
tagccataagtgagattttgcacactaaccaacaaaccacagcattctttttttttttttttttttttttttttgaggtaggatcttgctctgtcacccargctggcttgcagtggtgtagtcatggctcactgcagctttgacctccaggactcaagtgctccacccacctcagcctctggagtagctgggactacaggt

SEQ ID NO: 16592 - DNA, 201 bp, Homo sapiens
atcattccagaattatatgaatgaaggaaaaacaattttctctctctcattcaaggcaaaggggtattcaaggtgcctcaggaggtaaagcaagtggtgayattttcttggaaatagttcagaatctggatggatggagagagagagattacataatgaaaagcccacaaatgttggttcattgctggcacacagtgaaca

SEQ ID NO: 16593 - DNA, 201 bp, Homo sapiens
tttgctgcctggacacactagacagatgatatttggccagcataacccacttctgaggcccagctccaatttttagtgcatcctgccaacttgtctgttgsctggctctacctccatctgcagctctcacgactacggcccagcagtgtatccaacaacattgtgtgaacctctgctctaggagaaaggccataccctcca

SEQ ID NO: 16594 - DNA, 201 bp, Homo sapiens
ttcccccagtcccactatcccctgacctatttgcccttttcagtggttgggagtgggagttatgtttttgtactttgatttctctgcttttagtctggaayatacaaaagtgagtcacatttcatctgaatcctttgcgatttaagatacgtttgtgcatggttttatgcaatggttcattcctatgtcctgcaggatatc

SEQ ID NO: 16595 - DNA, 201 bp, Homo sapiens
acattagcacaaatatagaatatttccatggtcagagaaagttgtattggacagtgcttatttaaggtatagtttgtgactgtggaataaactatactctytgtccaaattaactgacctgtatgggggtttatattttattctgtagttttcagaagtctttttaggccaatttttcaaatggagcaagaaaagctgttt

SEQ ID NO: 16596 - DNA, 201 bp, Homo sapiens
gtgcttattatgtgccagccaccatattaatttgaggtagggaccatttaagggtaagaaaatcaaccacacaacatcagtgatggagctaggattcaaayccaggctgaccaaagagttcactctattctttgcaattactgcatcctcaaacaatcccctcctccacggctcttgtttttcttcagtaatggttcccaa

SEQ ID NO: 16597 - DNA, 201 bp, Homo sapiens
ggacgagactccggctaatttttgtattcttagtagagagggggttttgtcatgttggccaggctggtctcgaactcctgacctcaggtgatccacccacstcagcctcccaaagtgctgggattacaggcatgagctactacgccaaacccagatccagtattttaaaaggataatcaacataaatgagtttgggataat

SEQ ID NO: 16598 - DNA, 201 bp, Homo sapiens
ctgagcatagagttgtcgaatactcaatacttactaagtttaatttcttactgggcaagtttaccaattattattgcttatattatgtgttgggtgacagrctttttcttaaaggaccatgtagtgaatatttcaggccgatggactgagatgatctgtcacaagtactcaactctgccataaacaaatgggtgtgaacat

SEQ ID NO: 16599 - DNA, 201 bp, Homo sapiens
ccatgtaatctctactagtgaattcacctagttccacggattttgctgagcatagagttgtcgaatactcaatacttactaagtttaatttcttactgggyaagtttaccaattattattgcttatattatgtgttgggtgacaggctttttcttaaaggaccatgtagtgaatatttcaggccgatggactgagatgatc

SEQ ID NO: 16600 - DNA, 201 bp, Homo sapiens
aaagagaattacttttgactggaggtgtctggcaaattttcactgaggatgtgacattcgagttgaggcttgatgaatgggaaagatttaaatggggagaragggaagttgaagtagaatgagcagaagtatagaggcataaaagtgacatgtttcagcatggtcatatggttataaatgaaattacaaaggtaggctgaa

SEQ ID NO: 16601 - DNA, 201 bp, Homo sapiens
ttctcagtggcctaacacaaaggatattgtttgtgttgtgtgtatgtgttttgctttgtttttgctgttcctgtctttcaaaaaggctttgcaagcaagaytgaagtctggatggagggacaaaagtttaccttcttgggatacatcgcaacatatagcttttaaggtggggagggagagataatttatacctcacactta

SEQ ID NO: 16602 - DNA, 201 bp, Homo sapiens
gaggccgggcatggtagctcacacctataatcccaggagtttgggaagccgaggcaggcgtatcgcctgaagtcaggagttcaagacctgcctggccaacrtggcgaaaccccgcatttactaaaaatgcaatatattagccgggtgtggtagcgtgcacctgtaatcccagctacttgggaagctgaggcaggagaatcg

SEQ ID NO: 16603 - DNA, 201 bp, Homo sapiens
aagatgcctcatttcactaataatagttattatttgttgggtattattatgtgccaggtactacactaagtgatttatttttttaatcctcatgatcaacycatgaacgagataatatccttgtttcacagatggagaaactaaagatgagactggctaggtaacttacctgaggaaatagcctgtgaggttgcaaagccc

SEQ ID NO: 16604 - DNA, 201 bp, Homo sapiens
cttctatatggcaggtactcagaattctaagatgcctcatttcactaataatagttattatttgttgggtattattatgtgccaggtactacactaagtgmtttatttttttaatcctcatgatcaacccatgaacgagataatatccttgtttcacagatggagaaactaaagatgagactggctaggtaacttacctga

SEQ ID NO: 16605 - DNA, 201 bp, Homo sapiens
gtctcgctctgttgcccaggctggagtgtgcagtggcgcaatctcggctcactgcaacctctgcctcctgggttcaagctattcttctgcctcagcctccmgaatagctgggactacaggcgcttgccaccatgcccggctaatttttgtatttttagtagaaacggtgtttcatcatattagctaggctggtctcgaact

SEQ ID NO: 16606 - DNA, 201 bp, Homo sapiens
gcgcccaccaccacacctagctatttttttgcatttttagtagagacgggttttcaccgtgttagccaggaccgtctcgatctgacctcgtgatctgcccrcctcggcctcccaaagtgctgggattacaggcgtgagccactgcgcgtggcctccgactaattttttaaaatattttttggtagagatgaagttttacca

SEQ ID NO: 16607 - DNA, 201 bp, Homo sapiens
cctgatggtaaggaaaccagccctagaacttctgcattacctgaaaaacaccagttttgcttatccagctatacgatatcttctgtgtatcctttcctgcytgcgtggaccctcatgaaccaatgctttctcccctcaaataaggcaacagaagaaatgaaaaaaagtactgttgaggccgggcatggtagctcacaccta

SEQ ID NO: 16608 - DNA, 201 bp, Homo sapiens
gggatcatgccattgcactccagcctgggcaacaagagcgaaactccatctcaaaaaaaccaaaacaaaacaaacaaaaaaaatttataataggccaggcrcggtggctcacgcctgtaatcccagcactttgggaggctgaggcgggaggatcacaaggtcaggagatcgagaccatcctggctaacatggtgaaacccc

SEQ ID NO: 16609 - DNA, 201 bp, Homo sapiens
cagcactacaacatctccccccaggatttggagactgtatttccccatggccttcctcctcgctttgtgatgcaggtgctcaagacagggaatggaattgragggagcccagaatacaagctgctgctagcaaaggggtggggctaaatgagaagaaaatttaaaaagatgaaatttaatctgaaaaacagaaattcatgt

SEQ ID NO: 16610 - DNA, 201 bp, Homo sapiens
cacagtggggcaggtcaaatactattggagtgacattgcactctagaaaaggagccctgaaatcccacaagtgaaaaggcaggcaggccagtagagaccaycccagtcttattcaccactatagactctgtgtagtgtgggcgtgtggaagcatgtcatatgcttcttgaatgactgagtttaggagtgctttggcgtctt

SEQ ID NO: 16611 - DNA, 201 bp, Homo sapiens
aaaaaaaaaagaaagaaagatagatagatagatagatagatagatagatagatagatagatatagatatagatgaagatatatatatataccattcacctmttttcacaaacacaaaatgaagtagaataaatgaatcaagccactgaagtgtcttttcagctttctttgtaattgcagtccttttatctgccaattcctc

SEQ ID NO: 16612 - DNA, 201 bp, Homo sapiens
acggaagctgattacacgttctgaccgtcatttctcatagtgtctataacataggcaaaataatagctccagtgtccacaggcacgcctatggaaagaagkgcatctggaccatgtcacacactccttcctctccagtacccagcctgcttcctagtccacagctcttccagtagtggttgtgccggggagcattgagaag

SEQ ID NO: 16613 - DNA, 201 bp, Homo sapiens
gaagaattttaagcaaggcttcagtggagaaaatgtttaagtctggatgctggtagatcatttattttaatttgggttcaagatgatagtgtcctagaacrgaagctgattacacgttctgaccgtcatttctcatagtgtctataacataggcaaaataatagctccagtgtccacaggcacgcctatggaaagaagtgc

SEQ ID NO: 16614 - DNA, 201 bp, Homo sapiens
aaggctcagaactgagccagaaagacttggtcattttcagctgattatttaattacagattagatttcctagaaaaggagcccttcctcctatatggctcyccctgcatgtgcccccttccctcaggcctatatattaatacataaaataacccattattataaaatgaaacgaaagcaaggatcagcagagggatggatt

SEQ ID NO: 16615 - DNA, 201 bp, Homo sapiens
atactgaagaattttaagcaaggcttcagtggagaaaatgtttaagtctggatgctggtagatcatttattttaatttgggttcaagatgatagtgtcctrgaacggaagctgattacacgttctgaccgtcatttctcatagtgtctataacataggcaaaataatagctccagtgtccacaggcacgcctatggaaaga

SEQ ID NO: 16616 - DNA, 201 bp, Homo sapiens
gccaaaaaactgattctgtacctggttgatcatgcctgtaaaaaaaaaaaaattaaaaattaaaaaaattgattctgcctataaaaaaaaaaaaaaaaaaagaaaattagaaaacttgggccaggccccgtggctcacacctgtaatcccagcactttgggaggccgaggcaggtggatcatgaggtcaggagatcgagat

SEQ ID NO: 16617 - DNA, 201 bp, Homo sapiens
agagagagctccatgctggtttggaggagtagacacagaaaaggaagtaatgcatacaaaagaagagtagcttgttggggtgagggtctagaagtaagatytcttgggagatgataattacctcagaacgtaatttggatatggtagcctctgactacacgatattctggggaacacagtgcagcaggaggaaactgccac

SEQ ID NO: 16618 - DNA, 201 bp, Homo sapiens
ctacaatccactgtctctcccaatagggcataacacgggtgaggaacgccacagatgcagttggaattgtgctgaaagagctaaagaggcaaagttctttsggtatgtttcacctcctagtggccgtggatggaatcaatgctctttggggaagaaccactctgaaaagagaagataaaagcccggtaggaaaactgggtg

SEQ ID NO: 16619 - DNA, 201 bp, Homo sapiens
ggcgggaggatcacttaaggtcaaaattttgagaacagcctagccaacatggcgaaaccctgtatctactaaaaatacaaaaataagctggcgtggtggcrggcgcctgtagtcccaggtacttgggaggctgaggcaggagaactgtttgaactcgggaagtggatgttgcagtgagccgagatcatgccactgcactcc

SEQ ID NO: 16620 - DNA, 201 bp, Homo sapiens
gagactgtccggggcaatatagcaagaccctaccctatgtcaaaaaaaaaagtgtaacaaaaatgtcatcacattactgtagaaatagcaccaccttgtgrcccttgaatagtttgttttccactctgctttctctccagctaaagaggcatggtgctttctctccggtagataaaattgagtagcgtttaagtagtacta

SEQ ID NO: 16621 - DNA, 201 bp, Homo sapiens
ctataataacaagcagccagtctttagggagcatggtgggggatgggagccctggttgtaaagctcccattggttgcattacagcgttgacctcttgcaartcggtcagcatgcaccatctaccatactttttttaaaattacatatactggggaattccaaggagagaaagtgggtgaaatatatcctttttctagtagt

SEQ ID NO: 16622 - DNA, 201 bp, Homo sapiens
gcccaggaatttgagactgtccggggcaatatagcaagaccctaccctatgtcaaaaaaaaaagtgtaacaaaaatgtcatcacattactgtagaaatagsaccaccttgtgacccttgaatagtttgttttccactctgctttctctccagctaaagaggcatggtgctttctctccggtagataaaattgagtagcgtt

SEQ ID NO: 16623 - DNA, 201 bp, Homo sapiens; identical to SEQ ID NO: 2766

SEQ ID NO: 16624 - DNA, 201 bp, Homo sapiens; identical to SEQ ID NO: 2767

SEQ ID NO: 16625 - DNA, 201 bp, Homo sapiens
ttttcttccccaggaaggatttgatgccctggatccctttattcccatcctggtttccaactataacccaaaggaatttgaaagttgtattcagtattatytggaaaacaattggcttcaacatgagaaaggtccatcatttagttttttcctatcagggctttgtgatcacagtagaatcccactcagtcagagccttga

SEQ ID NO: 16626 - DNA, 201 bp, Homo sapiens
ggcgacaggacgagactccggctaatttttgtattcttagtagagagggggttttgtcatgttggccaggctggtctcgaactcctgacctcaggtgatcyacccacgtcagcctcccaaagtgctgggattacaggcatgagctactacgccaaacccagatccagtattttaaaaggataatcaacataaatgagtttg

SEQ ID NO: 16627 - DNA, 201 bp, Homo sapiens
acacccagcactgaatgttgtctttttcttttctttcctttttttttttagaggcatggtcttaactatgttgttgcctagggtggtcttgaactgctagsctcaggcaatcctcccacctcggcctcctaaagtgctgggattactggcgtgagccaccatatccagctcctatcattctttgaccacttctttattttc

SEQ ID NO: 16628 - DNA, 201 bp, Homo sapiens
gcgcgttgagtcgtttcctgccggatgacccgacccttttttgcagtctcaggacgggcgctttggagccggccccaggcagcgtgtgtcggtcgcctagkctggagaactagtcctcgactcacggtgagggaatggaccgacacgggtattgtaccgctgagggaaaggagcgggactccggacctccaggaggtaggg

SEQ ID NO: 16629 - DNA, 201 bp, Homo sapiens
cacacccagcactgaatgttgtctttttcttttctttcctttttttttttagaggcatggtcttaactatgttgttgcctagggtggtcttgaactgctascctcaggcaatcctcccacctcggcctcctaaagtgctgggattactggcgtgagccaccatatccagctcctatcattctttgaccacttctttatttt

SEQ ID NO: 16630 - DNA, 201 bp, Homo sapiens
tggattaatcatttttggatgtgggccggctataccaaaattggttgaaattatgggaaactgggcatgtttttcagtgtaaatagtgtcatctctttgayagtatagttcctgttttagtcctgtcttgtatctatcattctgattggtacaattaactgcaaaggtccccttaggggaccaatcagtgacaattccata

SEQ ID NO: 16631 - DNA, 201 bp, Homo sapiens
gcgagactctgtcaaaaaaaaaaaaaaattgttgtcaattgtttcgggagaacatctaggaaaggcacgtgatgatctcttctctctttctgtccgatatrcagattgcccccgaggaattagcacttgttcacaacttgaggaaaatgatgaaaaatgattgggtaagtgcatatgatacctcacacatttcagaaagaa

SEQ ID NO: 16632 - DNA, 201 bp, Homo sapiens
cccgactccggccatgtagcgcgcacgtcagcccgcacgcgtacgagtgtctacgggctcgtcgctggctgctcccaccaaccaccaccttcggccgtccygcgagccagccatcccgtacgcgctcacccacgggaacctcctcgcccagttctccactccccctcagaccctgtcaagccggctccagcgcaggccctc

SEQ ID NO: 16633 - DNA, 201 bp, Homo sapiens
cgcgcgtgcgcctcccacagtccccaccgcgggactgttccattcctggcggctgcaggggcaggagaggaagggaccggcaaagcgagtctggcttgccrtttgactggaattgccagggtggccggccgagtcccatgacaacctacctccctgggttcgtcgccgcggcgctgcggctcgcctcctcctccatgggac

SEQ ID NO: 16634 - DNA, 201 bp, Homo sapiens
ctcccaggcccaggtgatcctcccactttagcctcccaagtagctaggaccacaggctcacaccaccacacctggctaattttttaaatttttggtagagracaaggtctcattatgttgcccaggctggtctcaaactcctggaattaagcagtcctcccgtctcagcctcccgaagtgtgagaattacaggtgtgagcc

SEQ ID NO: 16635 - DNA, 201 bp, Homo sapiens
ggctgaggcaggaggatcatgtgggcccaggaatttgagactgtccggggcaatatagcaagaccctaccctatgtcaaaaaaaaaagtgtaacaaaaatktcatcacattactgtagaaatagcaccaccttgtgacccttgaatagtttgttttccactctgctttctctccagctaaagaggcatggtgctttctctc

SEQ ID NO: 16636 - DNA, 201 bp, Homo sapiens
gggtcctcaggcgatatacatccccagcttacgaagatgacgggattaagagattaaagtaaagacaggcataggaaattataagagtattgattggggargtgataaatgtccatgaaatcttcacaatttatgttcagagattacagtaaagacaggtgtaagaaattataaaagtattaatttagggaactaacaaat

SEQ ID NO: 16637 - DNA, 201 bp, Homo sapiens
ccagcctcaacaccatccgtagggtacctgaagtccggtggcgacaaaggaatgagaagagacaggttaagagttcataaaggtgggagccagggggccakttgcaaaatggaggctgcaaaaggcccagagttctggtctctacactatttattgagtataatcacttagatctaagaagcagatgttcagggcaaaact

SEQ ID NO: 16638 - DNA, 201 bp, Homo sapiens
gctacttgggaggctgaggcaggaggatcatgtgggcccaggaatttgagactgtccggggcaatatagcaagaccctaccctatgtcaaaaaaaaaagtrtaacaaaaatgtcatcacattactgtagaaatagcaccaccttgtgacccttgaatagtttgttttccactctgctttctctccagctaaagaggcatgg

SEQ ID NO: 16639 - DNA, 201 bp, Homo sapiens
caatttatgttcagagattacagtaaagacaggtgtaagaaattataaaagtattaatttagggaactaacaaatgtccatgaaatcttcacaatttatgytcttctgccatggcttcagccggtccctctgtttggggtccctgacttcctgcaacactctggactctccctttttattagtacttggtaggggtggttc

SEQ ID NO: 16640 - DNA, 201 bp, Homo sapiens
ttcaaaaagtacctgtagtttcagctacttgggaggctgaggcaggaggatcatgtgggcccaggaatttgagactgtccggggcaatatagcaagacccyaccctatgtcaaaaaaaaaagtgtaacaaaaatgtcatcacattactgtagaaatagcaccaccttgtgacccttgaatagtttgttttccactctgctt

SEQ ID NO: 16641 - DNA, 201 bp, Homo sapiens
tcacattattcaaacacaaatgctttacaaacaatttgtacaggtaatgcaatcatcacagggtcctcaggcgatatacatccccagcttacgaagatgaygggattaagagattaaagtaaagacaggcataggaaattataagagtattgattggggaagtgataaatgtccatgaaatcttcacaatttatgttcaga

SEQ ID NO: 16642 - DNA, 201 bp, Homo sapiens
gcccagatttcacattattcaaacacaaatgctttacaaacaatttgtacaggtaatgcaatcatcacagggtcctcaggcgatatacatccccagcttaygaagatgacgggattaagagattaaagtaaagacaggcataggaaattataagagtattgattggggaagtgataaatgtccatgaaatcttcacaattt

SEQ ID NO: 16643 - DNA, 201 bp, Homo sapiens
aaaaaaaaaaaaaaaaagattccattttgctagcttttaatttgcttcaaaaagtacctgtagtttcagctacttgggaggctgaggcaggaggatcatgygggcccaggaatttgagactgtccggggcaatatagcaagaccctaccctatgtcaaaaaaaaaagtgtaacaaaaatgtcatcacattactgtagaaat

SEQ ID NO: 16644 - DNA, 201 bp, Homo sapiens
ggttatctcccttgttccccgaaaatcgttgttatcctgttcttttcaaggtgcccagatttcacattattcaaacacaaatgctttacaaacaatttgtrcaggtaatgcaatcatcacagggtcctcaggcgatatacatccccagcttacgaagatgacgggattaagagattaaagtaaagacaggcataggaaatt

SEQ ID NO: 16645 - DNA, 201 bp, Homo sapiens
atatatcctttttctagtagttttttaactatttcatggaacgcccccaagtttttctgagggagcggccactgttcgacccagacaggatgctgcagggygagcctgaattgcttcttcaccatagtgaactgcaggttgggcagtaatgggtgcggcaagctgagtttcaggctccctccccctgcactcactcagctg

SEQ ID NO: 16646 - DNA, 201 bp, Homo sapiens
taaggtgggctgaatccaattaatgtctcctaacaatttttgaaaatcatttaaggtttttaaagaatcttttctgatttgaaccttttgaggcttaatgrctctatcttgtacttgtatccccaaatattgaaaaggaagagttgtttgaattttgtcaggtgttataagcaatccagcatttgtaattgccttttgcaa

SEQ ID NO: 16647 - DNA, 201 bp, Homo sapiens
tgcccttgacgcacttactcatggatggtacttcagcctcgttagacagcctggtgatggaggatgaagaaaccatgtgcttctcattcagttctggactyagtttcccttgtcttcagcaagttatttttgttagttccttatcaaaaagtgtacataaaaattaggcaactccaaacatgcctccagggttggtgtgtg

SEQ ID NO: 16648 - DNA, 201 bp, Homo sapiens
tatgcgatgatgtttgtttgcccttgacgcacttactcatggatggtacttcagcctcgttagacagcctggtgatggaggatgaagaaaccatgtgcttytcattcagttctggactcagtttcccttgtcttcagcaagttatttttgttagttccttatcaaaaagtgtacataaaaattaggcaactccaaacatgc

SEQ ID NO: 16649 - DNA, 201 bp, Homo sapiens
tctgtctgtctggtgctttgttccttaactaacatgtttcctgatcctttttcttccccaggaaggatttgatgccctggatccctttattcccatcctgrtttccaactataacccaaaggaatttgaaagttgtattcagtattatttggaaaacaattggcttcaacatgagaaaggtccatcatttagttttttcct

SEQ ID NO: 16650 - DNA, 201 bp, Homo sapiens
cctaaaatattaacttgatcatcattgctttatccgtctccgtctttctccagagtttcttttcttttttttttttttgagacggagtcttgctctgtcamccaggcttgagtgcaatggcgcaatttcggctcactgcaacctccgccttccgggttcaagtgattctcctgtctcggcctcctaagtagctgggattac

SEQ ID NO: 16651 - DNA, 201 bp, Homo sapiens
aagtaacaagccttgtattctcagtggcctaacacaaaggatattgtttgtgttgtgtgtatgtgttttgctttgtttttgctgttcctgtctttcaaaamggctttgcaagcaagactgaagtctggatggagggacaaaagtttaccttcttgggatacatcgcaacatatagcttttaaggtggggagggagagataa

SEQ ID NO: 16652 - DNA, 201 bp, Homo sapiens
cctgggtaacagagcgagatatggtctcaaaaaaaagataaaagaggtcaggcgtgtggctcagacatgtaattccagcattttgggaggccgaggtgggyagatcacctgaggtcaggaattctagaccagcctggccaacatggcgaaaccccatctctactaaaaatacaaaaattagccaggcgtggtgacacacgc

SEQ ID NO: 16653 - DNA, 201 bp, Homo sapiens
tcaaaactacaaatgagcgcttcctgaaccaggtgactagactcccagaagttgagtgctaggtagtccttacatggattctttgtgccctgagtaccaayagactatggagaactgatactggagttggaataactgtatcatttttaatttctttcatacgttttgctcacagtggactcataacttgaaactcattta

SEQ ID NO: 16654 - DNA, 201 bp, Homo sapiens
agcagagtggccgcggcagctcctccagagggagggagctaagggcgcctagcgacacccccaacctcccactcctccctcctcgcgttcttccccacggycccccgcttcgcccgactccggccatgtagcgcgcacgtcagcccgcacgcgtacgagtgtctacgggctcgtcgctggctgctcccaccaaccaccacc

SEQ ID NO: 16655 - DNA, 201 bp, Homo sapiens
gaagaatttcaaaactacaaatgagcgcttcctgaaccaggtgactagactcccagaagttgagtgctaggtagtccttacatggattctttgtgccctgrgtaccaatagactatggagaactgatactggagttggaataactgtatcatttttaatttctttcatacgttttgctcacagtggactcataacttgaaa

SEQ ID NO: 16656 - DNA, 201 bp, Homo sapiens
taagccgactggcggaaatgcgagagaggagaagggaaaggtggagggctaaaggggcaaactgagaggaggcggatcccgcaaccgacactgggatcgtytcccctcgcaaagcgaacccaaaatggcggcggcagcggcggcagcagagtggccgcggcagctcctccagagggagggagctaagggcgcctagcgaca

SEQ ID NO: 16657 - DNA, 201 bp, Homo sapiens
ccagaaagcagaagtgatatttaatacacttggtatgttttatatattgattctaatgataatgtttagtctaagatggacctgacaaggccaggcatagyggttcaacagcactttgagaggctgaggcaggatgattgcctgagcctaggagttcaaggttacagtgaactgtgatcacatcctgccttctagcctggg

SEQ ID NO: 16658 - DNA, 201 bp, Homo sapiens
gtaaaactccattttaaaaataatatatatatatgtatgtgtatatatatatgtatgtatgtgtatatatatatgtatgtatgtatatatatatatatatacacatagacatacatatatacacacacatagataagacaaaaaagaaagtcttggtcactttgtcaccattatacctgtttgcactcttatttcctaggc

SEQ ID NO: 16659 - DNA, 201 bp, Homo sapiens
agtaaaactccattttaaaaataatatatatatatgtatgtgtatatatatatgtatgtatgtgtatatatatatgtatgtatgtatatatatatatatatacacatagacatacatatatacacacacatagataagacaaaaaagaaagtcttggtcactttgtcaccattatacctgtttgcactcttatttcctagg

SEQ ID NO: 16660 - DNA, 201 bp, Homo sapiens
tgggtgtggtggcgggcacctgtaatcccagctactcaggaggctgaggcaggagaattgcttgaacccaggaggcagaagttgcagtgagccaagatcgygccactgcactccaggctgggcaagagagcaagactctgtcttaaaaagtatatatatatggctgagtgaggtggctcacgcctgtaatcccagcatttt

SEQ ID NO: 16661 - DNA, 201 bp, Homo sapiens
ttggctgggcatagtggctcacacccataatcccagcactttgggaggctaaggcgggcagatcacctgaggtcaggagttccagaccagcatgaccaacrtggtgaaacccagtctccactaaaaatacaaaaattagtcaggcgtgatggcgggcgcctgtaatcccagctactgaggcaggagaaccacttgaacctg

SEQ ID NO: 16662 - DNA, 201 bp, Homo sapiens
cacacctgtaatctacactttgggagggcaaggtgggaagaccacttgatgtcgggagtttgagaccaggctaggcaatatagtgagaccccatctctatygaaaaaagcaaaaaaaaaaaaatactatttagaatagcttattaaaggagtacagtgaagagtgtaagactaactgtagcatgttaagttgggatgcaca

SEQ ID NO: 16663 - DNA, 201 bp, Homo sapiens
gttttgtttttgccatctgttaacagtcctgagtacccatagagccttttactatttatcagcattctagagtcgtcagtatggattgtcaaaacttgcakttgtctcttttttgttcagtgttgtgtgcatccacattttctttcttttttaaacaaccctgcttatgtaacatccacattttctgacttacctttcaaa

SEQ ID NO: 16664 - DNA, 201 bp, Homo sapiens
cccagaaagcccaggattcaatcgctgagagagtgcttaggcccgaatgccggcccaaatcgttctactcaccgtgtcggaggccgagagcgatgagagtrcagggaagtgaggaagagggggtggccgccaggctcctccgcttccctgggtccaccgcggatccctcccgcttgtcaggaggcggccagcgggtaagcc

SEQ ID NO: 16665 - DNA, 201 bp, Homo sapiens
ggcacggtggcatgcgcctgtaatccaagctacttgggaggctgaggcaggagaattgcttcaacttgggaggcggatgttgcagtgagccaaaattgcascactgcactccagcctgggcagcagagcaagactccgtctcaaaataaataaataaataaataaataaataaataataaatgtatactgtactgttttac

SEQ ID NO: 16666 - DNA, 201 bp, Homo sapiens
ataataacaagcagccagtctttagggagcatggtgggggatgggagccctggttgtaaagctcccattggttgcattacagcgttgacctcttgcaagtyggtcagcatgcaccatctaccatactttttttaaaattacatatactggggaattccaaggagagaaagtgggtgaaatatatcctttttctagtagttt

SEQ ID NO: 16667 - DNA, 201 bp, Homo sapiens
taaataggcaacagtaagttgttcccattttgtgggtagcaaagtgaaatccagttgattcattgacttttcaaggtacagcctccaatccctcgcaagcrcatttccaactacatgattttctccagacaatatctttttagggaaccagaaatgtattggaaaaattcttctttaccctggtgattcttagataccctg

SEQ ID NO: 16668 - DNA, 201 bp, Homo sapiens
gtggagagagagctccatgctggtttggaggagtagacacagaaaaggaagtaatgcatacaaaagaagagtagcttgttggggtgagggtctagaagtamgatctcttgggagatgataattacctcagaacgtaatttggatatggtagcctctgactacacgatattctggggaacacagtgcagcaggaggaaactg

SEQ ID NO: 16669 - DNA, 201 bp, Homo sapiens
acgccacagatgcagttggaattgtgctgaaagagctaaagaggcaaagttctttgggtatgtttcacctcctagtggccgtggatggaatcaatgctctytggggaagaaccactctgaaaagagaagataaaagcccggtaggaaaactgggtgtctctatcttgtttctctgatttctgattccatcagtatggaggc

SEQ ID NO: 16670 - DNA, 201 bp, Homo sapiens
tccggacctccaggaggtagggagtgaggccggtagaccggcgcgcctccgggggggattcctcccgggcgttgagttgccaacctgggacccgaggaagwtcggcgtggtggtgtgctttttgttgttgttaaccctcctcggatttctcgaatttcacaccactgtccatatgcgatgatgtttgtttgcccttgacgc

SEQ ID NO: 16671 - DNA, 201 bp, Homo sapiens
ttccctcaggcctatatattaatacataaaataacccattattataaaatgaaacgaaagcaaggatcagcagagggatggattctggactcaactgatcrtattacaaggctaaaataaatttcctctctcggccgggcacagtagctcatgcctgtaatcccagcactttgggaggccgaggcaggcagatcacctgag

SEQ ID NO: 16672 - DNA, 201 bp, Homo sapiens
cagggacaccccttcaccccgcctggagggacttcccggtaggctcaggatccccctccctgctctcccctcccccatcttcaccactgctctcccagagrtccaggtccgggagatgacagtggctcccagaaagcccaggattcaatcgctgagagagtgcttaggcccgaatgccggcccaaatcgttctactcaccg

SEQ ID NO: 16673 - DNA, 201 bp, Homo sapiens
gcctgtcagggacaccccttcaccccgcctggagggacttcccggtaggctcaggatccccctccctgctctcccctcccccatcttcaccactgctctcycagaggtccaggtccgggagatgacagtggctcccagaaagcccaggattcaatcgctgagagagtgcttaggcccgaatgccggcccaaatcgttctac

SEQ ID NO: 16674 - DNA, 201 bp, Homo sapiens
gcgacaggacgagactccggctaatttttgtattcttagtagagagggggttttgtcatgttggccaggctggtctcgaactcctgacctcaggtgatccrcccacgtcagcctcccaaagtgctgggattacaggcatgagctactacgccaaacccagatccagtattttaaaaggataatcaacataaatgagtttgg

SEQ ID NO: 16675 - DNA, 201 bp, Homo sapiens
cgagactccggctaatttttgtattcttagtagagagggggttttgtcatgttggccaggctggtctcgaactcctgacctcaggtgatccacccacgtcrgcctcccaaagtgctgggattacaggcatgagctactacgccaaacccagatccagtattttaaaaggataatcaacataaatgagtttgggataatttt

SEQ ID NO: 16676 - DNA, 201 bp, Homo sapiens
tgtttgcactcttatttcctaggccaagcatggggatcagcacgagggtcagcactacaacatctccccccaggatttggagactgtatttccccatggcyttcctcctcgctttgtgatgcaggtgctcaagacagggaatggaattggagggagcccagaatacaagctgctgctagcaaaggggtggggctaaatgag

SEQ ID NO: 16677 - DNA, 201 bp, Homo sapiens
ggagggcaaggtgggaagaccacttgatgtcgggagtttgagaccaggctaggcaatatagtgagaccccatctctattgaaaaaagcaaaaaaaaaaaaatactatttagaatagcttattaaaggagtacagtgaagagtgtaagactaactgtagcatgttaagttgggatgcacaatagacagatttctaagagttg

SEQ ID NO: 16678 - DNA, 201 bp, Homo sapiens
tttaagtagtactagggtgtgttattcagattgctaccctgaagtaacaagccttgtattctcagtggcctaacacaaaggatattgtttgtgttgtgtgyatgtgttttgctttgtttttgctgttcctgtctttcaaaaaggctttgcaagcaagactgaagtctggatggagggacaaaagtttaccttcttgggata

SEQ ID NO: 16679 - DNA, 201 bp, Homo sapiens
tctgctttctctccagctaaagaggcatggtgctttctctccggtagataaaattgagtagcgtttaagtagtactagggtgtgttattcagattgctacsctgaagtaacaagccttgtattctcagtggcctaacacaaaggatattgtttgtgttgtgtgtatgtgttttgctttgtttttgctgttcctgtctttca

SEQ ID NO: 16680 - DNA, 201 bp, Homo sapiens
ctctgctttctctccagctaaagaggcatggtgctttctctccggtagataaaattgagtagcgtttaagtagtactagggtgtgttattcagattgctaycctgaagtaacaagccttgtattctcagtggcctaacacaaaggatattgtttgtgttgtgtgtatgtgttttgctttgtttttgctgttcctgtctttc

SEQ ID NO: 16681 - DNA, 201 bp, Homo sapiens
aaaactgtccaaaatacatacacacaatatgtgtgtgtgcgtgtgtatgtgtgtgtattcacacaagtagcatccgcctcctcaagcattgcctttttttktgtgtgtgtagacatggtcttactctgtcacccatactgtgacagtatgtgtagtggagcaatcgcagctcactgcaatctcaacctcctggtctcaagc

SEQ ID NO: 16682 - DNA, 201 bp, Homo sapiens
ccttgaatagtttgttttccactctgctttctctccagctaaagaggcatggtgctttctctccggtagataaaattgagtagcgtttaagtagtactagkgtgtgttattcagattgctaccctgaagtaacaagccttgtattctcagtggcctaacacaaaggatattgtttgtgttgtgtgtatgtgttttgctttg

SEQ ID NO: 16683 - DNA, 201 bp, Homo sapiens
gtcactactaaaaatacaaaattagccaggcgcggtggcgcatgcctgtaatcccagctactcgggaggctgaggcagcagaatcgcttgaacctgggagrcagaggttgcagtgagccaagatcacaccattgcactccagcctgggcaacaagagtgaaactccgtctcaaaaaaaaaaaaaaaaaaaaaaaagattcc

SEQ ID NO: 16684 - DNA, 201 bp, Homo sapiens
accatctggcgaagtcccacagtaggccgtgagcaagctgaggagcaagtaagccagtccaagtcccaaaacttcaaaagtagggaagctgacagtgcagycttcagtctgtggctaaaggcctgagagcccctggcaaatcactgttgtaagtccaagggtccaaaagctgaagaacttggagtccagtgttcgagggcg

SEQ ID NO: 16685 - DNA, 201 bp, Homo sapiens
ttggagttcgagaccagcctgaccaacatggagaaacccatctctactaaaaatacaaaattagccgggcatggtggtgcatgactgtaatcccagttackcgggaggctgaggcaggagaatcgcttgaacccaggaggcggaggttgcagtgagccgagatcgccatatatatatattcatatatatgtatatatacac

SEQ ID NO: 16686 - DNA, 201 bp, Homo sapiens
aaaaaaaaaatttcctctttcttaataacagacaacaaagacctgaggctagactgtagagtgctgttggtgagagaaagttttgttttttttttttttaytagtttggttcagggtgactgtattagtcagggttctctacagggacagcactaataggatagaagtatatatgaaggagagtttgttaaggagtattga

SEQ ID NO: 16687 - DNA, 201 bp, Homo sapiens
ggaggctgaggcaagagaatcccttaaacctgggaggtggatgttgcagcgagctgagatcatgccactgcacttcagcctgggttacagagaaagaagcwgtctcaaaaaaaaaaaaaaagaaagaaaagaaagcattcacttctacattgaggtctcttacagaacctgaacaatagattaaaatgaactcctgttaac

SEQ ID NO: 16688 - DNA, 201 bp, Homo sapiens
gatgagactggctaggtaacttacctgaggaaatagcctgtgaggttgcaaagcccacacgagatgccaggtctgtctgacttcaaagcctgtggcctaamcactgtgctctattgcattttatggtccatgttctccagaagcttacagtccagtagaatcatgaaaaaatgactatttcagtatggtgctcttacagca

SEQ ID NO: 16689 - DNA, 201 bp, Homo sapiens
catgaacgagataatatccttgtttcacagatggagaaactaaagatgagactggctaggtaacttacctgaggaaatagcctgtgaggttgcaaagcccrcacgagatgccaggtctgtctgacttcaaagcctgtggcctaaccactgtgctctattgcattttatggtccatgttctccagaagcttacagtccagta

SEQ ID NO: 16690 - DNA, 201 bp, Homo sapiens
cctcatttcactaataatagttattatttgttgggtattattatgtgccaggtactacactaagtgatttatttttttaatcctcatgatcaacccatgarcgagataatatccttgtttcacagatggagaaactaaagatgagactggctaggtaacttacctgaggaaatagcctgtgaggttgcaaagcccacacga

SEQ ID NO: 16691 - DNA, 201 bp, Homo sapiens
cagtgcagcaggaggaaactgccacttacctgtgtttgtctccattttagctcctacagaagaagggaaaaaagagctgctgttcctaagtaacgcgaacmcctcgctgctggagcggcactgtgcctacctctaagccaagatcacagcatgtgaggaagacagtggacatctgctttatgctggacccagtaagatgag

SEQ ID NO: 16692 - DNA, 201 bp, Homo sapiens
ggttttcttagttctaaagcttcaaccacactggatccttgtgttttcacaacccttaaggttagagccaactttcaaaaagaataattaaatcgggaaakaagtggggtcagcaggtttcgtagtgcttttaaacaggaagtctcagaactcatggagggaagtagctgacagcaaaactgctttcctactcatcaaccc

SEQ ID NO: 16693 - DNA, 201 bp, Homo sapiens
atttcccaccaagctttggactaaagcaagacagagagctctaggttttaatatctttgatgattctagctcattgtcttggtttcagggagagaggcaaragttaacaaatactaaaatgaagaaagaacagcaaaaataggaaacaaggccagggggaacaactagataattcaaagatgcgttcatctgtttctcttc

SEQ ID NO: 16694 - DNA, 201 bp, Homo sapiens; identical to SEQ ID NO: 2809

SEQ ID NO: 16695 - DNA, 201 bp, Homo sapiens
gaccgtcgcaggaggcgtccgctggataccttcccccttccctgacctagagctctacagctgctgcctcggtactgaccgagggttcccagagctgtctyaccattgcaaaaacgttatagcaacagcctctgattacgacatggctgagatcaccaatatccgacctagctttggtaagtagactcgggaaaactaagc

SEQ ID NO: 16696 - DNA, 201 bp, Homo sapiens
attcggaagaggcggagtcttcttccgaggaccattcggaagaaggcggagcctacctctcatcaggaccagtctgactgcacctgcatccttagctcagmgcatccccggagcatcttaagagctgagcgcagctgacaactaggggccggaccgtcgcaggaggcgtccgctggataccttcccccttccctgacctag

SEQ ID NO: 16697 - DNA, 201 bp, Homo sapiens
ccctgcagccagcccggtcctgcctttcattgcctgaaggaactgctactgccacctggcacactcagatccatgtcacgggccagggaagtccaagaatyttgaagaatattagacacatttgtgattgtgatttagggtagaggtggccctcaggacatctggccccaagaagggtttattgaggttatgttcatccac

SEQ ID NO: 16698 - DNA, 201 bp, Homo sapiens
tcaaaataaaaaataaaaaataaaaaataaaaaaataaaagaaaatatggccaggcacagtggctcacccctgtaatactagcactttggaaggccaaggygggaagcccaggagtttgaggttgcagtgagctattaccacaaactgcactccagactgggcaacagatcatgtatgtgtattgcagggaggaaaagggg

SEQ ID NO: 16699 - DNA, 201 bp, Homo sapiens
tggctgtcatctccctagtcactcatccactaggttccctagaagtgcaggctgcaaatgtctatcccaaatcctccctaccatagcaaagtaggatctcyccttggtgaacgtcagctagagctgccctggaccatgccacactggctgtaaagggctttttcctggtctggattacatagaccaggaaaaagctactgc

SEQ ID NO: 16700 - DNA, 201 bp, Homo sapiens
aatatatgtatacataaatacatatatatacacacacacatatatacatatatacacacacatatacatatatacacatacacacacacacacacacacayatatatatatacatacatacacacacctatttttttgcctacaatggatatattcatcctggaggaataccttttttttttttgagacgaagtcttgctc

SEQ ID NO: 16701 - DNA, 201 bp, Homo sapiens
ttcatttgatgtggctaatagtaaaaatgagtttatattcactgattacattctgatttctggcaaaaggaaaaagcccagaagtatactggttggcaagrgcaaccagactgtaattcaaaactggctgagggccaggcatggtggctcacgcctataattccagcacttaaggaggctgaggtgggcggatggcttcca

SEQ ID NO: 16702 - DNA, 201 bp, Homo sapiens
gattacaggtgtgtgtcaccacacctggctaatttttgtattttattttagcagagacagggtttcgccatgttggccaggctggttttgaactcctgacytcaggtaatctgcctgcctcagcctcccaaagtgctgggataacaggcgtgagccgccacacccggcctatttctgtttagttatttgttcatccaacac

SEQ ID NO: 16703 - DNA, 201 bp, Homo sapiens
aaaaaaatctatttctctttctcttttttttttctttttttttttttttgagatggggtctcggtcttttgcccaggctggagtgcagtggcacgatctcwgctcactataacctccacctcccggcttcaagtgattctcctgcctcagcctcctgagtagctgggattacaggtgtgtgtcaccacacctggctaattt

SEQ ID NO: 16704 - DNA, 201 bp, Homo sapiens; identical to SEQ ID NO: 2801

SEQ ID NO: 16705 - DNA, 201 bp, Homo sapiens
ctgtagtaggcacctgtccccctgcagccagcccggtcctgcctttcattgcctgaaggaactgctactgccacctggcacactcagatccatgtcacgggccagggaagtccaagaattttgaagaatattagacacatttgtgattgtgatttagggtagaggtggccctcaggacatctggccccaagaagggtttat

SEQ ID NO: 16706 - DNA, 201 bp, Homo sapiens
accagtgcagatgaaattatacctgcctctcatgtaatctggacattatgctcatagtattgtgctcatgatgctcataggctttctagagaagataaacscttcatctaggtttggagggaagaaaaagccatggattggttggagaggataggagaggatacctctaatagaagggaaaacagtaggcattatactaat

SEQ ID NO: 16707 - DNA, 201 bp, Homo sapiens; identical to SEQ ID NO: 2808

SEQ ID NO: 16708 - DNA, 201 bp, Homo sapiens
aaattttgaaaaaaaaagaaaactgaaaaagctaacatgaattgtgtgaaattgcataatgctgtaatgctaatctacaatatgtaatgctatcttgtatsttgaatttgttaatgcaccacacaagtgcaaaataaagactgattcacattacataggcacagtgatgtcagcctgattctctggaaagctggaggactc

SEQ ID NO: 16709 - DNA, 201 bp, Homo sapiens
ttcaatggctctttcaaaagaaagagccattgacatagctacttggaatgggaattgggtagaaagagaaagggagggagcttgagggaatgacattaaaytgccttcaatgcagaatggagtggcattcaggtggtgttgtggctacagacttgggcatcacaaagcggcgctgagtggggatgggcatgctgcccgtgt

SEQ ID NO: 16710 - DNA, 201 bp, Homo sapiens; identical to SEQ ID NO: 2803

SEQ ID NO: 16711 - DNA, 201 bp, Homo sapiens
ccgactccttgcctgtggcccagatagacctccacacttcaagatccttgcctctttcacttttaatctgctcctctttctgtagacattctcttcctgaygagtatctacgtccaatagatttccctggctaggaagattcttcagttgaacaaatggggtctttacatttggcaaggtatcctaaataatattcatgcc

SEQ ID NO: 16712 - DNA, 201 bp, Homo sapiens
tttaatatacttcttggtatcatgggatttcttcagacctaacctgagaaagttgttctgttctattcctgcttggtttccttggcccctcatccaggcargcagactcacatatagtcagtgtgtgtttattgtgcaatcactaaagaacacatgggatggccatcaaagatacgaacaacagagccccccctttcccaa

SEQ ID NO: 16713 - DNA, 201 bp, Homo sapiens
cctttcacccacattttataggtgaggaaactgaagtacagagatgttgagtaacttgtccaaggtcacagataagaaatagcaactgggcatggtggctyatgcctgtaatcccagcattttgggaggctgaggcgggaggatcacttgagaccaggaattcaagaccagcctgggctacacagtgagactctgtgtata

SEQ ID NO: 16714 - DNA, 201 bp, Homo sapiens; identical to SEQ ID NO: 2813

SEQ ID NO: 16715 - DNA, 201 bp, Homo sapiens
tgcagtgagccgaggtctcgccactacactccagcctgggtgacagagcgagagactctgtctcaaaaaataaaattaaaaaataaataaataaataaatwaattaattaattaaaaaagcctcccctgaatctcccagctctaggtgcccagagcacttagacaggcttctcatttctctgacaagtcccgcacaggttt

SEQ ID NO: 16716 - DNA, 201 bp, Homo sapiens
aggttgcagtgagccgaggtctcgccactacactccagcctgggtgacagagcgagagactctgtctcaaaaaataaaattaaaaaataaataaataaatwaattaattaattaattaaaaaagcctcccctgaatctcccagctctaggtgcccagagcacttagacaggcttctcatttctctgacaagtcccgcacag

SEQ ID NO: 16717 - DNA, 201 bp, Homo sapiens
aatttttttgtatttttttagtagataccaggtttcaccgtgttagccaggatggtctcgatctcctgaactcgtgatccgcctgcctcggcctcccaaartgctaggattacaggcatgagccactgctcccggctatagcggcctcttaactgagctttctgatgttggtcttcctcgactttagctcattttccacct

SEQ ID NO: 16718 - DNA, 201 bp, Homo sapiens
ggaagctcttggatgtcaaggataagcagtggtcagagtaagacagagggcctggcagatgaggtctcctctaagaagcaacttcctggtgagagaaggtycaatagctttcaccatttcacttagtggttggcatcctgatgctgtccagcttacttggaacaggctggcctaccatttgtagatccttcattatatcag

SEQ ID NO: 16719 - DNA, 201 bp, Homo sapiens
atctcggctcactgcaagctccgcctcccgggttcacgccattctcctgccgcagcctccccagttgctgggactacaggcgccagtcaccacgcccggckaatttttttgtatttttttagtagataccaggtttcaccgtgttagccaggatggtctcgatctcctgaactcgtgatccgcctgcctcggcctcccaaa

SEQ ID NO: 16720 - DNA, 201 bp, Homo sapiens
ttgggctccagaattggactgcacgactttactctccagcttaccacttgccagccgtgtgacacgggtgagttactcgacccctctaagcctctattttstcatttgtaaaatggagctgataatattgtcttccttacagagaatcaaatgagataatatgcctggcatatgattgcccttgaagaggtttcactttat

SEQ ID NO: 16721 - DNA, 201 bp, Homo sapiens
actctccagcttaccacttgccagccgtgtgacacgggtgagttactcgacccctctaagcctctattttctcatttgtaaaatggagctgataatattgycttccttacagagaatcaaatgagataatatgcctggcatatgattgcccttgaagaggtttcactttattgaaggagaaagacaaatattttttgtaat

SEQ ID NO: 16722 - DNA, 201 bp, Homo sapiens
ggcgcccgccaccacacccggctaatttttctatttcttttttttttttttttcctgagacggagtcttgctctgttgcccaagctggagtgcagtgactrcaatctcggctcactgcaagctctgcctcccgggttcacgccattctcctgcctcagcctcctaagtagctgggactacaggcacccgccaccatgcttg

SEQ ID NO: 16723 - DNA, 201 bp, Homo sapiens
aagagccacatttctttccactttattaactcccttgaggagggataagccagggctaggatcctgagcaacacatgccctggagaaggcccgagataggwtacccagagcctgtgcagccccaccctagagccttccagcctcccaggcttcctaaacccattttcccaaccagtgcccgtaggcaggactatgttccat

SEQ ID NO: 16724 - DNA, 201 bp, Homo sapiens
tgagacaccagaatcgcttgaacccaggaggtgggggttaccgtgagctgagatcgtgccactgcactccaacctgggtgacagagcaagaccctgtctcraggggaaaaacaaacaaaacaaacaaaaacacattggctgagggaccaagcatggtggctcacacctgtattcccagcactttgggaggctgagacggat

SEQ ID NO: 16725 - DNA, 201 bp, Homo sapiens
taattccagcacttaaggaggctgaggtgggcggatggcttccactcaggagatcaagaccagcctggccaacgtggcggaaaccccagacatggtgattsacgccggtaatcccagctactcaggaggctgagacaccagaatcgcttgaacccaggaggtgggggttaccgtgagctgagatcgtgccactgcactcca

SEQ ID NO: 16726 - DNA, 201 bp, Homo sapiens
ttttatatttttagtagagacggggtttcaccatgttggtcagtctggtcttgaactcctgacctcaaatgatccacctgcctcagcctcccaaagtgccrggattacaggtgtgagccactgcacccagccttgtattttatatacctgggagctaaaattttggaacatattttaaaagtacataaacccagaattctt

SEQ ID NO: 16727 - DNA, 201 bp, Homo sapiens
gtgagccgaggtctcgccactacactccagcctgggtgacagagcgagagactctgtctcaaaaaataaaattaaaaaataaataaataaataaattaatwaattaattaaaaaagcctcccctgaatctcccagctctaggtgcccagagcacttagacaggcttctcatttctctgacaagtcccgcacaggtttattt

SEQ ID NO: 16728 - DNA, 201 bp, Homo sapiens
gaaaactgaaaaagctaacatgaattgtgtgaaattgcataatgctgtaatgctaatctacaatatgtaatgctatcttgtatgttgaatttgttaatgcmccacacaagtgcaaaataaagactgattcacattacataggcacagtgatgtcagcctgattctctggaaagctggaggactctcagtgaggttaacact

SEQ ID NO: 16729 - DNA, 201 bp, Homo sapiens
acttcttggtatcatgggatttcttcagacctaacctgagaaagttgttctgttctattcctgcttggtttccttggcccctcatccaggcaagcagactsacatatagtcagtgtgtgtttattgtgcaatcactaaagaacacatgggatggccatcaaagatacgaacaacagagccccccctttcccaacatgaaat

SEQ ID NO: 16730 - DNA, 201 bp, Homo sapiens
ttccctacgcttcacagccaattaactgcccaagcctaaaaacccctgacaattcttcctgagacatattttacctccatgtccatctcctctgccacagycctagttccagtcccaatcatttcttctgtagcacgttgctacagaacaacgaagtctgcttttttgagatggagtctcactctgtcgcccaggctggag

SEQ ID NO: 16731 - DNA, 201 bp, Homo sapiens; identical to SEQ ID NO: 2807

SEQ ID NO: 16732 - DNA, 201 bp, Homo sapiens; identical to SEQ ID NO: 2818

SEQ ID NO: 16733 - DNA, 201 bp, Homo sapiens
tggggtctgggtgggggcaaagagacccagtcaattacatgtttggtaccaagaaaggaacctgtcagggcagtacaatgtgactttgaaaatatataccstgggggtagttttaccctatatctataaacactgtttgttccagaatctgtatgattctatggagctattttaaaccaattgcaggtctagatacctcct

SEQ ID NO: 16734 - DNA, 201 bp, Homo sapiens
ctctgggtttcttatttgtttcacacatttcctgccctgactaatcttttgaaatattaattttctttaaatctttcaaaaacatcatagaaaagatgggsaaaaggtagttttattcagaactttgaatctctgaaatgtcttttttctactatcaggaaaattatttctcctttttcaagaggtaaaatgaattcttgt

SEQ ID NO: 16735 - DNA, 201 bp, Homo sapiens; identical to SEQ ID NO: 2821

SEQ ID NO: 16736 - DNA, 201 bp, Homo sapiens; identical to SEQ ID NO: 2822

SEQ ID NO: 16737 - DNA, 201 bp, Homo sapiens
acctctttttggtcgtgtaaaaattatattcctgcaatctccaaccctccagcaacaagccaacaaaaactgcgcaaagcaagggagaaattttagaagtrgtagacttcaagtaaaattcctaccattctttaataaacaggggtaaaaatttcagaaagtaatgaaggttgtgaaagctgatgaacaaagactttgcta

SEQ ID NO: 16738 - DNA, 201 bp, Homo sapiens
taatttacttggaaagtagaacatacattaaatgaaaatattttttatggatgaacttctgtttttcctgtgttttaacactgtattttgcaaaactcctraattatttagctgctgtttctcttacaggagtgtgtttaggcactaagcaagctgatttatgataactgctttaaacttcaacaaccagtaagtcttcaa

SEQ ID NO: 16739 - DNA, 201 bp, Homo sapiens
cctctgggtttcttatttgtttcacacatttcctgccctgactaatcttttgaaatattaattttctttaaatctttcaaaaacatcatagaaaagatggscaaaaggtagttttattcagaactttgaatctctgaaatgtcttttttctactatcaggaaaattatttctcctttttcaagaggtaaaatgaattcttg

SEQ ID NO: 16740 - DNA, 201 bp, Homo sapiens; identical to SEQ ID NO: 2825

SEQ ID NO: 16741 - DNA, 201 bp, Homo sapiens; identical to SEQ ID NO: 2826

SEQ ID NO: 16742 - DNA, 201 bp, Homo sapiens; identical to SEQ ID NO: 2827

SEQ ID NO: 16743 - DNA, 201 bp, Homo sapiens; identical to SEQ ID NO: 2828

SEQ ID NO: 16744 - DNA, 201 bp, Homo sapiens; identical to SEQ ID NO: 2830

SEQ ID NO: 16745 - DNA, 201 bp, Homo sapiens; identical to SEQ ID NO: 2820

SEQ ID NO: 16746 - DNA, 201 bp, Homo sapiens
actaagcaagctgatttatgataactgctttaaacttcaacaaccagtaagtcttcaagtggaatttattattgattcttttatgttaatttgttaggtcwaaagaaaaatctttagagcaaaataaaagttttgctctttattaggaggttctttagatattacacttttaattgggtagcttatttgcatgtattttga

SEQ ID NO: 16747 - DNA, 201 bp, Homo sapiens
acagaaggcataagaactaggagctgctgacatttcaatatgaagggcaactccacccttgccactactagcaaaaacattaccagcggtcttcacttcgkgcttgtgaacatctctggcaacaatgagtctaccttgaactgttcacagaaaccatcagataagcatttagatgcaattcctattctttactacattata

SEQ ID NO: 16748 - DNA, 201 bp, Homo sapiens; identical to SEQ ID NO: 2824

SEQ ID NO: 16749 - DNA, 201 bp, Homo sapiens
ttttgctctttattaggaggttctttagatattacacttttaattgggtagcttatttgcatgtattttgaaactatctaaagtaaatagtgtttcctttktatgcttatctttagctaatgtgtttttttttttggttttaaaataatgcttctagtgaaaaaaatcacaaaaacctcaacactgtaacgtttgagagca

SEQ ID NO: 16750 - DNA, 201 bp, Homo sapiens
catttgaaatggagggagaaaccaggtttaaacaatgagtgaaaacagtttccatctcagctttcctgctgataaacatatgtgccccctcatttgtttcygaaacataagttttccatcattttaacagagcctcagcctcaactgaatctgtccagagcataggaaacaaatattttgagatttagtaaaatggtgcat

SEQ ID NO: 16751 - DNA, 201 bp, Homo sapiens
ctggtgctattacgtcccagcgtctgagagaacgagtaagcacagaattcaaagcattctgcagcctgaattttgaaggtaagtatgaacaatttatatawaatttacttggaaagtagaacatacattaaatgaaaatattttttatggatgaacttctgtttttcctgtgttttaacactgtattttgcaaaactcctg

SEQ ID NO: 16752 - DNA, 201 bp, Homo sapiens
ctgatttatgataactgctttaaacttcaacaaccagtaagtcttcaagtggaatttattattgattcttttatgttaatttgttaggtcaaaagaaaaayctttagagcaaaataaaagttttgctctttattaggaggttctttagatattacacttttaattgggtagcttatttgcatgtattttgaaactatctaa

SEQ ID NO: 16753 - DNA, 201 bp, Homo sapiens
ccaagtaagccactgacttcaaaattctctagcacatttgtggaaacttcattttttttgtttgagatttatttgaatgagctgttatgattggagacagygagaatttcagattaatgttttgcagacaaaaaaaaacctctctggaaagctggcaagggttcataagtcagccctagaattatgtaggttgaaggctcc

SEQ ID NO: 16754 - DNA, 201 bp, Homo sapiens; identical to SEQ ID NO: 2829

SEQ ID NO: 16755 - DNA, 201 bp, Homo sapiens
cagtatttcttcaagtggtgtcaatattattgctattctttttataaactttttgttaattctctgcagttacaaaatttttctttgacttgtgaaaaaawttactcctaagattatgaagacgcagagtaaatggccctttaatcttctgggaaatatgtacctctttaaactttatttatgtcagaacttactgtaatg

SEQ ID NO: 16756 - DNA, 201 bp, Homo sapiens
aaaaggcctaatttgttgttgtatgcctcttggaggtagccaaactcaaggttaaaggcacagtcctccagactaagttggcccaagatttctgacaccarctgtaactttacggatttcccaaaaccactctctagttcagtaattttctagaacaactcagagaactcagaaaagcactgtgcttaggattacaatttt

SEQ ID NO: 16757 - DNA, 201 bp, Homo sapiens
tgagtcattttcatttaatagttttccattggaaagcatctttacttctgtctggatttttggagatacacattaccttggaatatggatacaatgctgtmatagaaatatgtttcagactttgagtactcattcacatgatttagcatagtcacttagaattattttgtaaggaagatctgtcatttctccctcatttat

SEQ ID NO: 16758 - DNA, 201 bp, Homo sapiens
cctcagtggcataaattatcaggtgtggtcccaaagggcccaccatgaataacaaagacacttttatcactggggaaattccaagggtttagaggtcgccyctcaagagctaagagaaagtcctaagcctctttaggttaggtcaaattccttactacacatatgccaattaagtgttttattcatccaacatgtatttat

SEQ ID NO: 16759 - DNA, 201 bp, Homo sapiens
gggagcttgcagtgagcgagatcacgccactgcactccagccagggtgacagagcgagactctgtctaaaaaaaaaaatatatatatatatatatatatatataaaaatatatacaaatatttaaaaatatgtaaatatataaatatttaaaaatatatatgtaaatatataaatatatataaatatgtatatatttgagg

SEQ ID NO: 16760 - DNA, 201 bp, Homo sapiens
agtagtcttatcttagatatatcctccccaaccacccccctaccagttctcctcactctcttttaattgctactagggtattttagttttgttttccaatstcttatattggcagagtgctagacttttttcaagttggtctgcaaggagagattgctttgagggacgtctttgttgaatatgtacgtttactaagttata

SEQ ID NO: 16761 - DNA, 201 bp, Homo sapiens
gagcttgcagtgagcgagatcacgccactgcactccagccagggtgacagagcgagactctgtctaaaaaaaaaaatatatatatatatatatatatatataaaaatatatacaaatatttaaaaatatgtaaatatataaatatttaaaaatatatatgtaaatatataaatatatataaatatgtatatatttgaggat

SEQ ID NO: 16762 - DNA, 201 bp, Homo sapiens
atcaactgcattttttaactctagaatttctgattgattctttttaactgtttcaatctctttgttaaatttatctgatagaattctttttttttttttttgaggtggagtcttgctctgtcgcccaggctggagtgcagtggcatgatctgcaagctccgcctcccgggttcatgccattctcctgcctcaccctcccaa

SEQ ID NO: 16763 - DNA, 201 bp, Homo sapiens
taatttcatttctattgagagtgtatttataaaacattatctttgctttaaagaaactgcaaagccttctccagtataaattggtccccatttttttaaattttttttttttttggtttggtccagcttaaatgtatatttttaaagaaactaaaaaaagtattctatggtagtatttcatttcatacatgtacatatttt

SEQ ID NO: 16764 - DNA, 201 bp, Homo sapiens
aaatcattactataattgctacgtttgtaatgtcatcaggtgtacacggcatagtgaaaatgtttaataggttgatatatactctcagaactataatagakaatctagttgggagacaacacttgtcaggaaaaaatcttaatcaagcctgtttaattacaaattgattttttttttaatgcttgcccatgtcaggtcaag

SEQ ID NO: 16765 - DNA, 201 bp, Homo sapiens
gatatggcagatacatatggttcagtctaatcaaaagccttacctgagtctgtgatctcctggctccatatctaccaggactttagagaaagtgggggaasggggcattctcccattacaagcttatttccccttctaattagtgtcctgaaatctgactaatcccaaccagtagtagagtgggggagatagatgatagaa

SEQ ID NO: 16766 - DNA, 201 bp, Homo sapiens
ttgttactggatgctttttgttctgttaactcttgggggaggcttgttattttacagttactgcagttactgaactaattacttcctcacgagccatagtraagatgacctatatcatttgcttataatgcatctaagtttttaattctttgaatgttagtcgttaaacaattaaatcaaaactaatgttttcaaactttg

SEQ ID NO: 16767 - DNA, 201 bp, Homo sapiens
gataacagctcttataaatgtttcagtaagcgctaagtagacagttatgtgcactctcattccacgcttatttgcttactgtaataaactgataaaatatrtgtggtttgtctctgtgtatctacaggcatcatgagtcacatagatttcctttagaaataatgttgtgtctgcagaattgattgcttattttcataaacc

SEQ ID NO: 16768 - DNA, 201 bp, Homo sapiens
gaggaaacaccatccctcataccacttttataagggcaataatcccattcatgagggtagaacccctataacctaattacctactaaaggccccaccataktctggattaggtttcaacacgaattttggagggacataaatgttcagaccatagcacaaaccttcttgttattcttgttattcttgtcattcttgtcttc

SEQ ID NO: 16769 - DNA, 201 bp, Homo sapiens
tgttacaaggaaaactaacaaacagaaaggaatagcatcaacatcaactaaaaggatatccacaccaaaaccccatctctaggtcaccaacatcaaagacsaaaggtagtataaaaccacaaagatagggagaaaccagagcagaaaagctgaaaattctaaagaccagaggacctcttctcctacaaaggattgcagctc

SEQ ID NO: 16770 - DNA, 201 bp, Homo sapiens
tctctgtataatatgtgcatgtcttcccagacaggatacagcatatcataggtaaaaacaatagcgtttgaatcagatagaactggcttaatgtctgagcrtctgccacatagtatatgtaccaattctttatgagttttaggctccagatttgtagggtttataatatctaatttatacatttgctgtttgtgtcgagag

SEQ ID NO: 16771 - DNA, 201 bp, Homo sapiens
ccttttaattatatattcagaacacagagattttaaaaaataatgcctgacaaacattattatcattataaggaaaggctttagtttttttaataactctrtaataaatattatttataaacacagcatgttttagtcttgccagagactggccattggccaacagatagctctattgagggaacattttatttcctgctg

SEQ ID NO: 16772 - DNA, 201 bp, Homo sapiens
gtggctagatcaaaaaatatgttaactgtataccttcaacattctttttcctcagaaattcacctaattatattcaaaattaactagatttaaaagccatmaacttggagcagctttgtgtttttaagccaaacaatatctaagtgttcggtaaaactggataggtaatatccagtaaaatatgtaagctagatcccatat

SEQ ID NO: 16773 - DNA, 201 bp, Homo sapiens
atgaatttcatatcattttaatgttacaatcatattacttttgatttttcaaccatttagaaatgtgaaagtcattattagtgaacaggcattgcaaaaayagacagtggaccagatttggcctctaagcatggtttgctggtgcctgcttaataccgagcatgaaataagatgctcattaaatatttgttcattatgtgt

SEQ ID NO: 16774 - DNA, 201 bp, Homo sapiens
agccttcccaaatacaataagcacaaacaagcccagactgtgaagactacaataaatacctaacttcaatgcccagagactgatgaacatctgtaagcatsaagaccatccaggaaaatatggcctcaccaaacaaactacataaggcgtcaggggccaatactagagaaacagagagatacgtgacccttcagacagaga

SEQ ID NO: 16775 - DNA, 201 bp, Homo sapiens
ggctaatttttgtatttttagtagagatggagtttcaccatgttggccaggctggtctctaactcctgatctcgtgatccacccacctcggcttcccaaartgctgggattacaggcgtgagccactgtgcctggccttttttttttttttttttttaagatggaatgttgctcttgttgcccaggctggagggcaatggc

SEQ ID NO: 16776 - DNA, 201 bp, Homo sapiens
ttgtgtatctaaacgtatctaaacatagaaagttacagtaaagatacagtattataatcttacaataagattatatatgtggtccctccttgaccaaaacrtggcacgactgtaatttaaaaataacacaaaattcagtcattgtaatataccacattaacagaaggaaagggaaaaatccctcacaatcatctcaattta

SEQ ID NO: 16777 - DNA, 201 bp, Homo sapiens
gatctcgtgatccacccacctcggcttcccaaagtgctgggattacaggcgtgagccactgtgcctggccttttttttttttttttttttaagatggaatkttgctcttgttgcccaggctggagggcaatggcgcgatcttggctcactgcaacctccgcctcatgagctcaagcaattctcctgcctcagcctctcgag

SEQ ID NO: 16778 - DNA, 201 bp, Homo sapiens
atttttaaaatataatttatttaaaaatgtaatatgtttttaaaagattcatcttttatggcagttttgtcatcttcggtgaaaatatgtaaataaatgartttctgaaattctatcttttaaaaaacagttcatagtctgaaattatgcatttaaaaaaggcagttcatagtcacacaaatttgatggaattttgtgtga

SEQ ID NO: 16779 - DNA, 201 bp, Homo sapiens
attggcttaagcaaatatgtgccagtttgtcctaactggcggatagtactcataatgttagttgttagtattttagtaaaattccccacagtgacaaatcygctgaatcagatgctaattatagttattaatgaactagcaattatttgtggcaaaaaacccaggtcacccaaaaaaacaaaggaaacatgcacacagatc

SEQ ID NO: 16780 - DNA, 201 bp, Homo sapiens
ttgctaaattccacatttccaccttttttcctctgtaccattataacttaaaacctaaaagagttactttcaatatttgacacagcttaagatttagatayctgaactactcttctcctttagcaagaagtagaaggatgattttcatagtccgtactcttcgccgtttgctttccttgaattaccattgaggaccatcac

SEQ ID NO: 16781 - DNA, 201 bp, Homo sapiens
agagaagataaaatgtatattatgtttttgccaaattctgtagctagatatagctagtgtacaaaatgtatgttttgggggagagagaagtagctactggytgaaagccatattgtgaaacagttgaaaggagttctgaagattttagagcaggttattgatagtgatcagatctttgttttataaagttgtgtgaaagat

SEQ ID NO: 16782 - DNA, 201 bp, Homo sapiens
atgattaaaatgtccttaattttaaatgtaggtaagatcaaataaaaagtaggcacaatcctagctttggatttttggtagaaaatatgaaaagcaaaacmgattgattcccctgagtgaatgatggtaagttgtcgagttttcacctgttcctagaggcccgtttagtttaaattttgttccagggacttaattttaaga

SEQ ID NO: 16783 - DNA, 201 bp, Homo sapiens
ctttagaattatatactaaatcaatctttgtatataccgtatgtggtaaactccttagaattatttaattaatgaactgcatttatatgtcctgtaaaatsttatttgctccatggtaggtcttttgcttcttagatggtgcaaacttagtccatccttcattccatgcttaattttcttaaattctcaattagagttcag

SEQ ID NO: 16784 - DNA, 201 bp, Homo sapiens
aggttaataggttctcaacgtggccgggcgcggtggctcacacctgtaatcccaacactttgggaggccgaggcaggtgggtcagctgaggtcaggagttygagaccagcctggctaacatggtgaaaccccgtttctactaaaaatataaaaaattagcctggggtggtggcgtgtgcctgtaatcccagctacttggga

SEQ ID NO: 16785 - DNA, 201 bp, Homo sapiens
aaataaatatgtaaaggaaaaatctattcaaaatgtgaggagaaattgataaaatagttacaatgtgtgactgtaatgtatttctctcatattagatattyctagtagacagatataagtaagaaaattaagtaatcaaaaacttatttagtaaatatagctaaaaccttatatctcttgaacagataatacccactttta

SEQ ID NO: 16786 - DNA, 201 bp, Homo sapiens
tgcgcagaactttagtgggcagaggaagaatgtttagtgaaggcaactttgaaaagcaatggttgcagaagtagggtaacctatgaaaagaaagcaaaggktcacataattagttggttcaaagtaacattcatccctctctcaattcccccattgcaaatgcagtacatctttaatgtcagatcctggaaaatagaaaat

SEQ ID NO: 16787 - DNA, 201 bp, Homo sapiens
accaaagagccactttacgtttttatgttagcaagaagttgtccgattgtagaataattacatacctttaaattttgttctgacatttataatttttaaayacaaaatagtttaagagtttgcatagtgggtaagaaatactatatgctaattgagacaaatgttgattcaggaaaacattttatataaccatacagaagt

SEQ ID NO: 16788 - DNA, 201 bp, Homo sapiens
aagtaattcttttgttccaaataacacctataacaaaattacttttagtaattccttattttaagtgatttcacatactttacacaatgtaaaggggaaawttttttttatatgaaacagtggagagaaaattcagtgatgtagaccacattgtgtcaggaagagattcacatttatatcactttatcctgtttttgacca

SEQ ID NO: 16789 - DNA, 201 bp, Homo sapiens
gatactgattataattaagatcacattcaaaaaagtttccatgctagttctttccacctctctccttgaaggagagaaaaaaatctccccatgagcttgcrtgactgacctttactttcctttatcataaggaccattttgtgtttattgaaaaaggaattatagcttattgcttgacagaaatgacactgaagaatatta

SEQ ID NO: 16790 - DNA, 201 bp, Homo sapiens
taatctcagtttatggatttgtttttaaaagttatttgttaaggatactgattataattaagatcacattcaaaaaagtttccatgctagttctttccacytctctccttgaaggagagaaaaaaatctccccatgagcttgcatgactgacctttactttcctttatcataaggaccattttgtgtttattgaaaaagga

SEQ ID NO: 16791 - DNA, 201 bp, Homo sapiens
atcctgaggaagtaaagaagtgtaaaatattgtctcaaggtgtggttgtcccctgtgatgtagcattcagacttccccttagattcctttgccttatgatrtatgcttatgaaattatcacttgaaatccactttcagacatgcagtttattaaataactgatattttaaagacaattctaatctcagtttatggatttgt

SEQ ID NO: 16792 - DNA, 201 bp, Homo sapiens
tctagtagaaattttattaacaaataatcctgaggaagtaaagaagtgtaaaatattgtctcaaggtgtggttgtcccctgtgatgtagcattcagacttscccttagattcctttgccttatgatgtatgcttatgaaattatcacttgaaatccactttcagacatgcagtttattaaataactgatattttaaagaca

SEQ ID NO: 16793 - DNA, 201 bp, Homo sapiens
atctcttaacatgagaaacctgacctaaacatggaagatgttatgatatttacaaaacctttatttctcttcgaaggaagagaaacgaatttagctgtagratacatgtccaatgaacactaagaattgattaccactgacaagagagtatggagtaaaaacaagtacagtatataaccctaatatcaaagaaaagtaaaa

SEQ ID NO: 16794 - DNA, 201 bp, Homo sapiens
tacatatatatttaaaattgttatatcctcttgctgaattgactcctttatcatatagtgaccttctttgtctcttcttatagtttttgtcttgaagtcttattttgtttggtattgtatagcaactcctgctcttttttcatttccattgggatggaatgtcattttccatacctttgttttcagctgatatatgttttt

SEQ ID NO: 16795 - DNA, 201 bp, Homo sapiens
tgagttaattccttacaattagtataaaagtgggattctgtcattttggtactgaaggtaggtatctagtagaaattttattaacaaataatcctgaggargtaaagaagtgtaaaatattgtctcaaggtgtggttgtcccctgtgatgtagcattcagacttccccttagattcctttgccttatgatgtatgcttatg

SEQ ID NO: 16796 - DNA, 201 bp, Homo sapiens
tcaaaatctttatctgttacatatacaaaccaaagtatttactgatgaaataatacatggaatttgcttttcaataattcagaagttgagtaaaagattasattaaacaagattggctaatgttggtaattttgaaatttagtgctcagtatctagttgttcatcatatcagtgtccctgctcctgtatacatttgaaaat

SEQ ID NO: 16797 - DNA, 201 bp, Homo sapiens
ttggtttttttgtggtgaaagggtcttgccgtgttgcccaggctggtcttgaactcctgggctcaagcaatcctcccacctcagcctcttgagtaactagkactgtaggtgtatgccaccaagtccaactaatttttggattttttgtggagatagtgtctttgttatgttgcctaggctggtcttgaactgctgagctca

SEQ ID NO: 16798 - DNA, 201 bp, Homo sapiens
cttttattgaactttctgcagtttaaaaatcagtttcacatatatggtctcatttgatcctcaagacaactcagtgaaacagacaggatatgtatgattarccccattttacagaagaggaaaacagaagctctgaggttgtggtttagctaaggtctcaccatttaatatgtggctgagttcaaactataacccagatca

SEQ ID NO: 16799 - DNA, 201 bp, Homo sapiens
tacatattttcactgaagatttgacattcatgcttcatagaatatgtgacctgacaaaatatcttgtaaatataaactagtacatcaaagtttacattcakttcaggctgttagctatgaaattagggaacaggattctagagtcccttccagctctaaaatttctagaaatctaaagaaagtaagtggagagacttcaaa

SEQ ID NO: 16800 - DNA, 201 bp, Homo sapiens
ttagggacagggtcttgctctgtcactcatgttgaagtgaaatggtgcgatcttggctcactgccgcctcagcttcccagactcaagtggtcctcctaccwcagcctcctgagtagctgggactaaaggtgcatgccaccatgcctgactaattttttggtttttttgtggtgaaagggtcttgccgtgttgcccaggctg

SEQ ID NO: 16801 - DNA, 201 bp, Homo sapiens
gggaagggattacttttgtaaaggcctttggatggtactatcaataaatacagcaatgttgttataaaagcatttttccaatggtgattcagctttttgayatgtacttttaatctcaggaccctgcgttatctgacagattggtgttttaacgtgggctgaaaactcaatttactaataatccaaataatgccttttatt

SEQ ID NO: 16802 - DNA, 201 bp, Homo sapiens
ttaaaaatgacatcttttatcactgtgatttgtgactccttttaagcatccataactagcattgattgaagttgtttcagtgtaatgagttccccaaacamtacattatggttcaaaatgaagcagttgtgtaagagcctcataatacatttataaatcctcaagtatgaggcaacttctttctgagggataattttaggg

SEQ ID NO: 16803 - DNA, 201 bp, Homo sapiens
cttttcttaacatgttttaaaaataaaaatacaatggcttatttaaaatgtccctatgcatggtgaaatgttaaataccaagtggatgaatggttctcaamtatattgtaatggagaattattcacatgcatctattgtttaaactaataagtaaaatagacttcctttttctgttctgttttaaatgtgcactaaaatta

SEQ ID NO: 16804 - DNA, 201 bp, Homo sapiens
aatcccggctactagggaggctgaggcaggagaattgcttgaacccaagaggtggaggttgcagtgagccgagattgcaccactgcactccagcctgggcracagagtgagactctgtctcaaaaaaaaaaaaaaaaaaaaaaattaaattagctaggcatggtggcatgtgcctgtagtcccagctatttgggaggctga

SEQ ID NO: 16805 - DNA, 201 bp, Homo sapiens
tggtggtttgctgcagtatcaacccatcacctaggtattaagcccagcatgcattagctatttatcctgatactccccctcctcccgtgccccctgacagrccccagtgggtgttgttccattccctgtgtccatgtgttctcattgttcagctcccacttataagtgagaacatgcggtgtttggttttctgttcctgtg

SEQ ID NO: 16806 - DNA, 201 bp, Homo sapiens
gcctcaaagtattgggctccagtgatcctcccacctcagcctcctgagcagctaagactatgggtacatacccccatgaatggctgagttttgttttattwttttacttgtagtagaggcaaggttttgctctgttgcccaggctggtctagaactcctggccttaagtaatctttctaccttggccttaagtaatctttc

SEQ ID NO: 16807 - DNA, 201 bp, Homo sapiens
gccaactttatattaattgtaacattaactctaagttttttaatagaaaagagacaaaatgtgccttggggctgtgccaccctgaaattcaaacaacagtrcttttgtgttcctattcaggcataatctccttctctatggtcccaaggcacaagtgttaagtaaataaagggactaataagactattgtttacataatta

SEQ ID NO: 16808 - DNA, 201 bp, Homo sapiens
agaacatttctgatacttcagaaacccacaggaataattaaagtcataacatggattttcataaaggaaatccaaaagaaaaaagtaacctctactttgtraagttgtattctgattagtaaagccactagcctgtatggcaccattgcgcagattccaaaaagtttcccttgaatgtaagctggattttagctcctattc

SEQ ID NO: 16809 - DNA, 201 bp, Homo sapiens
atcctggcctcaccttttgttactgcatttttgttaacctgctgaaagctctactgagcttttaggcctctcagcttcctcttgtctaattaacacatcctttttttttttttttttttttttggggaaaagcaattccaaaagccaatcagaattctaggtttctagatttactacttcttctgggtcttgtctgcataa

SEQ ID NO: 16810 - DNA, 201 bp, Homo sapiens
cagaagtaaccaaactgcacagctgatttttactttaaaacattctctatttaagttttatttaagttcaccatttaatgtcctctaatgcaacaattttrctaatgggaatctgtaactgtttcacgtaaaaatgaaagaaaggtattcttgatgcttttccttctggtttgacaattttgtaaggaatcaaagagaatg

SEQ ID NO: 16811 - DNA, 201 bp, Homo sapiens
gtaaattatatattgtgttagagaaggtattaagtgtctataaaaaaggaaaaaggaaatcagaagggagggatgccaatgggttaagccttactaagatrgtaatatttgagcagacatactagagctgagccatgtgggtctctggagaaagtgccttccaggtagagggtcccagggaataacctatagtgggactgt

SEQ ID NO: 16812 - DNA, 201 bp, Homo sapiens
tgtgtagtcttcctgcaatctgaacagccttgctaagattaacagttatacttctttttatcccttatcttattctgcctccctgcagtatttggcacacrccttttttcctgaccactcttcctccagtctcttctgcaagttgcttttcttctgtttttacttaaatacaggtcttcaccagatttgcgctttatcctt

SEQ ID NO: 16813 - DNA, 201 bp, Homo sapiens
gtgcagtggccaatctcggcttactgcaatctctgcctcccaggttcacgccattctcctgcctcagcctcccgagtagctgggactacaggcacccaccaccatgcctggctacttttttgtatttttttagtagaggcggggtttcaccgtgttagccaggatggtctcaatctcctgacctcgtgatccacccgcctc

SEQ ID NO: 16814 - DNA, 201 bp, Homo sapiens
ggccaggaaaactttcatgtgattctctgtgaaatatccaggaagggtttaggaaggaggtttgtgttcaatgtcgtggaaactgaggtgccttgcttttrttacattgcatgtcctctgataacagcacttatgagtaagtgcagtggccaaaaagcagaaaacaaaaaacatgtagctccgaaatcgctaaggtttttc

SEQ ID NO: 16815 - DNA, 201 bp, Homo sapiens
tttatttgaagtaatatttgctggaagattcaaatatatttcttcgagtctgtgcttatatgtaagagttaaccaaatttgccgtttacttttttaaatcytattctaggtcaatactaggttaatgctagcctcaatgaaatggattgaaggtaaaatcaagacccactttctacagtttataggataaatgagacaata

SEQ ID NO: 16816 - DNA, 201 bp, Homo sapiens
aattagtcattttgcctattgtctttgaatttggaggtctttccaagtgatttgaatggctcattttcctctcaaaatttgttcctaagaagattcaactrttgccttcttttactctaaatagaatttcccattacaagcagaagaattcaaaattatttctttagccttacatcaatccttacgtaattctttaaaaga

SEQ ID NO: 16817 - DNA, 201 bp, Homo sapiens
tttagtattaaaaaccatttatttgaagtaatatttgctggaagattcaaatatatttcttcgagtctgtgcttatatgtaagagttaaccaaatttgccstttacttttttaaatcctattctaggtcaatactaggttaatgctagcctcaatgaaatggattgaaggtaaaatcaagacccactttctacagtttata

SEQ ID NO: 16818 - DNA, 201 bp, Homo sapiens
aaaatttatatacataaggaagaagttatctttagtattaaaaaccatttatttgaagtaatatttgctggaagattcaaatatatttcttcgagtctgtkcttatatgtaagagttaaccaaatttgccgtttacttttttaaatcctattctaggtcaatactaggttaatgctagcctcaatgaaatggattgaaggt

SEQ ID NO: 16819 - DNA, 201 bp, Homo sapiens
aattctaaaccacaatgcctaatatatctattgaaaaacataattttacacttgatgaacttttagtggggtctttaaaagtaactttcttttacaaaaaygtaaagtttattttataccttgaagagtctttttctctttcattttatacttatctctttctgtgaacctctatagagataaagctaaaattattaagtc

SEQ ID NO: 16820 - DNA, 201 bp, Homo sapiens
tgtatctctttttcttaattaggttttgttacttgaggatcttgaacttttttgtctctcacttgctacctttcagaataaatatttgttgttaactttayggattaatatttgttctgccttgttcactggatattgtgagactgaaatgagaaaaagatgctttgaaaagtaatgtcacagctgggtgtcgtggcacac

SEQ ID NO: 16821 - DNA, 201 bp, Homo sapiens
ataaaaaccatagggattattagaaaaatgcagttagagtggcaacactcaaaaactatattggtgacatattttttaaaaaggaacctaaaaaaaaaaamcagaagtacaattttacacgtgttaaatggttaacaaataaatactacaatgatactgctctttatattgaaaaagacttgaggtttgcttatggaagaa

SEQ ID NO: 16822 - DNA, 201 bp, Homo sapiens
aatcagtatgcagtaagggcatcagttttatcacactgcatgaatagatttttaatagcacttagacctttttctaattgcacaagtatatggatttcttstgtctcaccaaacatgctaaataataatttaaagacatgctgttacactgttttaaaatatatacctttttatttaaaagcttttttgatcatctcattc

SEQ ID NO: 16823 - DNA, 201 bp, Homo sapiens
ctttagcccaatttaaaataatagattgggagtaaggtcttaatgcagtgtaacctttggaacgttagaaataacctcttttctttccagaaatcagtatrcagtaagggcatcagttttatcacactgcatgaatagatttttaatagcacttagacctttttctaattgcacaagtatatggatttcttgtgtctcacc

SEQ ID NO: 16824 - DNA, 201 bp, Homo sapiens
accataagcaatcatatttgatgccccttaattagagcacctttttttctttccaggttctttttccacctcagcaatcgagacaatacatttgcttaccrtgctgctctcctaagtgttcttttgcatgtaaattaatcttgattcagtttacactgtcatgctgagtggtacaaattgcctataacaataaaacagcat

SEQ ID NO: 16825 - DNA, 201 bp, Homo sapiens
ttaaaaaaacaaaatactgagaagttgtggtagaatacattctttacaatgcaataagagcagttttttgtgcactgttttaagtaactgttgacaaaggrttcaacatataatttaaggtgaaactaaggaccatgatctaatattgaaataatgtctcctctcttcccattggttatgaagcatttatcgtaaagattc

SEQ ID NO: 16826 - DNA, 201 bp, Homo sapiens
acccactggtcattcaggagcatattgtttaatttccatgtgtttgtatagtttccaaaattccttttgttattaatttctagttttattctattgtgatyagagaagatgcaattatttcaattttttgaacgcttttaagacttgttttgtgacctaacatatggtccatccttgagaaagatttatgtgttgaggaaa

SEQ ID NO: 16827 - DNA, 201 bp, Homo sapiens
tatgccagggacagtatctcttcataaaacacacctcaggagaagcagtttgccagccccctaatactttctgatgttttgatgtcctgcatatttttccrattaagttttgagtgccatgtttttagttgtatttccacattcattattctcacgtagaccccttcagcgggtttgccatatatgattatttttttaatg

SEQ ID NO: 16828 - DNA, 201 bp, Homo sapiens
tgcttctcagatcacagatcagccattgaaaaagttgcatgcatacaaactatactataaactctgaagataggtttcacaacataagaattcagaacagkggttttcaactaggcaccgcagttacctttattagtttccagtcactgatgtaacacattaccacaaacttagtggcttaaaacagtgcaaatttattat

SEQ ID NO: 16829 - DNA, 201 bp, Homo sapiens
gtttggaaagaagaaaaagaagggtggaaaggctggatggactctaaaatcaaggttaggaaatgaattgtaagttatttactcagggtacagaggatgtmagtgtgaaagaggggctcttcataaaatgtcgagtttgtcaatgggtgataatatgcagttggaagcttcatgccagccttgcgcgctgacagtgctgct

SEQ ID NO: 16830 - DNA, 201 bp, Homo sapiens
cttcaagggccaatctcacttggctttaaatccccagatattcacacactacataggatcaaggttgtattcagtgtttattgaattgataaataaattgkatttattggtttgccttcaacaatccacatatggaaaaaatataaggccacttacaagaatacaatacataatagcataaaataaaagtcgattttatgt

SEQ ID NO: 16831 - DNA, 201 bp, Homo sapiens
tagcatcgttcctgaaaaaatatatagtgctatttgaagattatgtagcctgtgatatgcaaaactataagcaccgaactgctattactgtggaaatgagytgtaggtataatatagatttacttgatgaaatgatctttattttgttgttaagctgacaagtgctggagaatttgctttatgtatacattgtgggaaacc

SEQ ID NO: 16832 - DNA, 201 bp, Homo sapiens
ccttaaatccatttttcttatagaacgtattcctaaaactccttttccacctagtgttaattagaaagttgacaagtgtcattttcaactttattatgttwacatattttatcatttttaaaaaaaattaagctcagtactatattttatgcagatcctgtttattttttatttgatgtacactttaacctcattgatcca

SEQ ID NO: 16833 - DNA, 201 bp, Homo sapiens
cagtggaccagatttggcctctaagcatggtttgctggtgcctgcttaataccgagcatgaaataagatgctcattaaatatttgttcattatgtgttcamgtatttccacaaatatatttttaatatatattattaccaaaataagaggtgagaaagtcttgtgtgctttataatgtatagtgattactaaaataaaata

SEQ ID NO: 16834 - DNA, 201 bp, Homo sapiens
gtatgtggtgtccttcaggagtgttgggaagaagagtttctattaaaaagaataaacaagtaattcaaaagtgttgtaaataatgatgtaactcagtggtyccctaacttttgaaattgtttacctctattagtaaaaatattttgagtatgtactctgtagaagtttatttgtaattatatatgtgtgtgtatatatatg

SEQ ID NO: 16835 - DNA, 201 bp, Homo sapiens
aaaatattcatacttttcaattcagcaatttcacttttagtgtatcaagcctagagaagtatttgtgcttgtacggaaatagatctagccaagtataagcrttgtttataatggagaaaaattggaaatgataatctgtgggggaataatgaaataatgatatatccctattacatatgtaggttttgagtacttcctgtg

SEQ ID NO: 16836 - DNA, 201 bp, Homo sapiens
gaaggtagagaaaaacatgtactcttgtatgctgtttgtgggatcttaaattggcaatatctgtaaaatattcatacttttcaattcagcaatttcacttwtagtgtatcaagcctagagaagtatttgtgcttgtacggaaatagatctagccaagtataagcgttgtttataatggagaaaaattggaaatgataatct

SEQ ID NO: 16837 - DNA, 201 bp, Homo sapiens
gaaaagaagagacaaaattataatttttttttttttttgagatggagtctcgctctgttgcccaggcgctctcagctcactgcaacctccgcctccttggwtcaagcgattctcttgcctgcctcagcctcccgagtagctgggactacaggcacgcaccaccatgcccgactaattgtagtattttcagtagagacaggg

SEQ ID NO: 16838 - DNA, 201 bp, Homo sapiens
tggcatataatggatgttgaataaataaatgtgctaggcccagtgataagtgctttatgattttattaagtcttcatgacaacctatttgaaatagacatsagcttttagttctgttgatttttctctattgtagttttgtttcatagaggctttgtgatactaaaataagatacaagcttcagaaaataataccaggtag

SEQ ID NO: 16839 - DNA, 201 bp, Homo sapiens
aggaaaaagcatggcaaatataaaacaaaaaaaggtggctggagaggccatgcacaccacacatactagttttcacaattcacgtcagagattaaatcctrcttttactaaacaggtaaaaaacaaaatttaacatatgctatttatgagaaacctccctaagagagaatggcacagaaaagttgagattagatagatgaa

SEQ ID NO: 16840 - DNA, 201 bp, Homo sapiens
ctttcctgttggcatggtgtctttttcagtaaactcctaaggaaaacaaacaaaaagtactacaagttgatgataaggtgggtgggcaatatcctgtataraaatgaaactatgttctagaagagttggatttatttctggacaccgacctttttaaaagcaatgcatcattctccatccaacaaatgctgccatagccaa

SEQ ID NO: 16841 - DNA, 201 bp, Homo sapiens
tggttgtctccttgtacttcgagacctcagatcacttatccgtggaggtcttttgtgatcacccagtcttactttattgcattccttattttaattgtttstgtactacttatctgatctttctttatgtttttgttcctccctgctttcttccttctctgccttgctctctccctctttacttccctcccttctcctttt

SEQ ID NO: 16842 - DNA, 201 bp, Homo sapiens
aagtgttgaacagtcttccactttcaagtatactaagagaatggatgagctttttaaaacttgggcaaaaaattaggagtagtaaactagagaaatctgcrtatttaaggaagactcatttgtctcttgttcttttactaaagcaggcaaccaatataaatgcaagcataattatccattattttggcactgattgataca

SEQ ID NO: 16843 - DNA, 201 bp, Homo sapiens
cctggctaatttttttgtatttttagtagagatggagtttcaccatgttggccatactggtctccaactccggacctcaggtgatccgctcgtctcagcckcccaaagtgctgggattacaggtgtgagccaccgtgcctggccacaaggatatattttcaatgtcatacagatttatttaattttgtatagtggctgaat

SEQ ID NO: 16844 - DNA, 201 bp, Homo sapiens
caagaggaagaggaaaaagcatggcaaatataaaacaaaaaaaggtggctggagaggccatgcacaccacacatactagttttcacaattcacgtcagagattaaatcctacttttactaaacaggtaaaaaacaaaatttaacatatgctatttatgagaaacctccctaagagagaatggcacagaaaagttgagatta

SEQ ID NO: 16845 - DNA, 201 bp, Homo sapiens
aacagtgggaagaaatagattaataaagactacagaagaggagctaaaagttagaatttgccataaattggatggagagttcactgaagcaaacctcagtygattgtggaactagattcatgccgtgggaaatctcggaatgacttagccgtgacttctttcctgttggcatggtgtctttttcagtaaactcctaaggaa

SEQ ID NO: 16846 - DNA, 201 bp, Homo sapiens
tttatgagaaatgaaaaaaacatatgtatcattatagttatttaccctacagtaaagcctgtttgctagagatttagggagcaagtcttctagtatttgartggcatcctggaaaatgttaggtttgtaaacaaatgaaattcaaactagaatcagcaaactaacatacataccactgagcaaatagcattttaattatta

SEQ ID NO: 16847 - DNA, 201 bp, Homo sapiens
gactttgtgtcttaaaccaaacgggcgacttcatttttcccctccctgggaactaagtgtggaaaggaaccctaagggtccactgctgtctcctagtggaytaaactaaaatgagaggaacagtgggaagaaatagattaataaagactacagaagaggagctaaaagttagaatttgccataaattggatggagagttca

SEQ ID NO: 16848 - DNA, 201 bp, Homo sapiens
tttttcaaagattactgtctatcagactttgtgtcttaaaccaaacgggcgacttcatttttcccctccctgggaactaagtgtggaaaggaaccctaagkgtccactgctgtctcctagtggactaaactaaaatgagaggaacagtgggaagaaatagattaataaagactacagaagaggagctaaaagttagaattt

SEQ ID NO: 16849 - DNA, 201 bp, Homo sapiens
tctccctggctagttctttttttcaaagattactgtctatcagactttgtgtcttaaaccaaacgggcgacttcatttttcccctccctgggaactaagtrtggaaaggaaccctaagggtccactgctgtctcctagtggactaaactaaaatgagaggaacagtgggaagaaatagattaataaagactacagaagagg

SEQ ID NO: 16850 - DNA, 201 bp, Homo sapiens
cataagtttaacaaagtccaaatttagaattttgtttaaagtatttttaaggtaagttcttaagtttttcagtggtagccataaaataacttatcaaaatscaaaatttataaatgtagttttttgatgagcaattttctgtaggtacagaggtacttcagggaagtacttcatgaactccacatccagatcctgtcttaa

SEQ ID NO: 16851 - DNA, 201 bp, Homo sapiens
ctgttagtggcatcaattgtaaactgaaaggaaactctgacactggggcctgctaggaatgtttttaattgcatgaatctagctttttacaactgaacttkctctgggagatgagaggttttcaagaattatcaaaatattttacttcagtgatttggaagttaaaactctaaatatttaccattattttttagaatatga

SEQ ID NO: 16852 - DNA, 201 bp, Homo sapiens
gtcagggagaagaccgattgactttaaatttacatattaatgagaagatttgttaagagggtgcttgactatagaaaataacggcgtatttatagggcacracattttataaataaagctgatgcaggaaaatggaaattaaaccttttaggttaataaattcaagagactgctaaaatgcacatttgcatttttattttc

SEQ ID NO: 16853 - DNA, 201 bp, Homo sapiens
tacattttttaactcaatataggatatagtgtttctctttgtttttaatacccaagtgctatttctttaaaaatctttcatagtcctgcttttgtcagaamcgacacttgaaactctcttgttaacaagtcagttcagcctgtgttttctggattgtctgctaagtgcaaggtactttagtaggtgctgtaatagataaat

SEQ ID NO: 16854 - DNA, 201 bp, Homo sapiens
tgtatctgataatccgataagttaaagatatgctgtttgagcacaaaggagattcatttaaaccgctattgctatagattatgcctatgatgcatttttaygaggaaccagtaaattatataaaaagatataggcagaaagttaatataaaaatatgaaatactaaaaattttctaaggaaaagagaaaagaggaagtagg

SEQ ID NO: 16855 - DNA, 201 bp, Homo sapiens
caacatggcaccattgccgtctagcctgtgccacacagcaagactctgtctcaaaaaaaaaaaaaaaaaaaaagaaaaagaaaaaaatcattctgaagaayagagattgaaaagaacagagccttggagttttgttggttcattctaaaggtctaacgtatgcatcattagaacagcagaaggagaggagaaagagattgg

SEQ ID NO: 16856 - DNA, 201 bp, Homo sapiens
ccattttattggcagatgatgaagctcattaacaaataacagaaacattctaatccagggaacatggttatggtgacagagaaagtgcacaagcattcttrcacgggcaagtgtgagagcgtaaggaggatgggtgtgtgatttcagagggttcgctaattttgtagttatgattttattttccatgcatagtatggtcat

SEQ ID NO: 16857 - DNA, 201 bp, Homo sapiens
tggctttatgttagtggttgacaaatttgagttcagctaagattttaccagttactgtacaactgttacatcaaagtaaatggcatcctatatgatttcaygtgttgatattaatgttgtggcgtaacagagccagtgtttttcagccacttctacatagccatctcaaatatataggagcaaatctagaaatggtgtcca

SEQ ID NO: 16858 - DNA, 201 bp, Homo sapiens
ctctaaatctctgaatgagaattcatttatatttactttatttgtttaaacaggcaaaagaatggaccccagcaggaaaagcaaagcaagagaattctgcyaagaagttttattctgaatctgaggaagaggaggactcttctgatagtagcagtgacagtggtgggttttataatttattggcatatattatttacatag

SEQ ID NO: 16859 - DNA, 201 bp, Homo sapiens
gtacagatttgtagcctaggagcaataggctatatcagtagtccccaacgtttttggcaccagggaccagtactgtggaagacaatttttctctggacccrgggtgggtaggatggcttcaggatgattcaaaagcattacatttatggtgcactttatttctattattattacattgtaatatatgatgaaataattata

SEQ ID NO: 16860 - DNA, 201 bp, Homo sapiens
tgcagtggcatgatcgtggcttactgtagccttgacctcttgggtttaggtgatcctccttcctcagcctcctgagtggctgggactacaggtgcatgccrccatgtccagctaattttcatattttgaacagagacagggcttcaccatgttgcccaggctggtttcgaactcccaggctcaagcaatctgccaaccttg

SEQ ID NO: 16861 - DNA, 201 bp, Homo sapiens
agctgaggtgggggatcacttaaacctgggaggtcgaagctgccgtgagctatgattgagccactggactctagcctgggagacagagtaggatctgtctaaaaaaaaaaaaaattacttataacccagttagccagagaaaactagtaaaatatttaaatatatatcttaagttactaaatatttcttgtttattgtgtc

SEQ ID NO: 16862 - DNA, 201 bp, Homo sapiens
caagtgagttctgtgtgcaagattggcaaaaagtaaggggagcactaaaatttaggattaaaatacagtgtgtttagagggctgtacatttagatgttttraaggcttattttttcatcaaagtgttatggatctatgaaatcctgttcttaaaatgaagggacacttttctgaaaatacccagctcaagaagagacggga

SEQ ID NO: 16863 - DNA, 201 bp, Homo sapiens
ttgtccaacgacgcatttctcagaacattgttaagcaatgcatcactggattatagcattttaaggataggtactttaaacctactttttttttggagacrgggtctcgctgtgttgcccaggttggagtgcagtggcacgatcttggctcactacaacctctgcctgccgggttcaggtgattctcctgcctcagcctcc

SEQ ID NO: 16864 - DNA, 201 bp, Homo sapiens
ttcttcttaatccaatattgttttcgtttatttgttctgttaactggaatctcttcaatatgttatctgagtaggcaaggatgaaaattaatttattgaartagacaattgccctcccccatccagagatttattgttaaagaatgttttaaaaattggctagtatttgtcttgccttatttcacattttcttgcatatat

SEQ ID NO: 16865 - DNA, 201 bp, Homo sapiens
aaatagttcttataaactcaattagactaagttggataagccaaaatcaaaacagttgtattcttgtggccagtttatgaattagattaaattagtactgkatttaaatgacttgataaaccatactttctttgtagatttcttgagtaaaatcaattttacttatgattaatttagtagatatttattaaacactatgtg

SEQ ID NO: 16866 - DNA, 201 bp, Homo sapiens
aatttttaaaatttgttgtggaaatgttcacattaaaaaaaatcagctcatactgacctttgtgaaacgctttaaagaactctgttaaaaaatgttagttaaaaataagttttcttgggttgatgtccttcagaaacaccaatttttcttagataagtaacttcatacattttcatataaagtacatagaaaaaccattcc

SEQ ID NO: 16867 - DNA, 201 bp, Homo sapiens
tttcctcatctgtaaagcagacatgctagtacctaccttacttctttcaagtgttatgttaaaaataaaatatgaaagatcaatgtaacacactatgtaaytataaaacaacagttttaacatttttaaaaattccataaaagatcaacagtattggagaacatcaaatgctaaaagtaacctaaattttttggtaactct

SEQ ID NO: 16868 - DNA, 201 bp, Homo sapiens
gtagatttcttgagtaaaatcaattttacttatgattaatttagtagatatttattaaacactatgtgcttgttatatataattctgaattgataattttyaactactctccctttgacaccttatggccatgatatctgagcttctaatttgatatgtttattagttttatggcctgtggtataagaaagtccaaatatc

SEQ ID NO: 16869 - DNA, 201 bp, Homo sapiens
gtccttcagaaacaccaatttttcttagataagtaacttcatacattttcatataaagtacatagaaaaaccattcctagtatagtagagctatattctgaaaaaaaaaatttttttagacaaaataaatcccctttcctcttcaccctccatccccatgattctgtgtatgtcctgctgaaaattcatgtacttgtctag

SEQ ID NO: 16870 - DNA, 201 bp, Homo sapiens
agcattcttttcattctcccagatctgaagccccagaattatctctgactactctgtcattctgtatgtttagatagttaccaactcctatatgttctgtrcgttatttctcatgtctgtttcttctttccctactgccactattctagattagctcttcattacctgcatagaccattgccattggtcatcctctgacca

SEQ ID NO: 16871 - DNA, 201 bp, Homo sapiens
tgatattgaactggatccttttattatacatcattgagacagttattgaaacttacgtgcatagtgacaattgtgtgaaagtaatgcatcagtttaatgayctgattttcttcgttgtactgtagtctgtggaacatgtccttgtttataggaaatatacatagaagtttttggggataatgtagcatcagattggcatct

SEQ ID NO: 16872 - DNA, 201 bp, Homo sapiens
aaaattatgtgaacagatggtgaaaaaatttatttaaaataatgcttttaaagtttccaggatttttatccttcatgaaacctaggcttcagtgttcttayaactacccagtatattagagtgctcctccacaccatagttatttcagctacgttgttagtccactattcgcaccttattcatgatgcaatattctagtta

SEQ ID NO: 16873 - DNA, 201 bp, Homo sapiens
gagcgctgtcccactcattatgctttcacttttttttttaaacttacattcctcctcattctttttttattttctattttttatttttgagatggagtctygctccgtggcccaggctggagtgcagtggtgtgatctcagctcactgcaacctccgccttctgggttcaagcaattcttctgcctcagcctcccaagtag

SEQ ID NO: 16874 - DNA, 201 bp, Homo sapiens
agatcctagatgtagcactctaatgggaaatgtcttaatttttttcagtctacagttggtctggaatgtgatccagctgataaatattgagcttttactayatgccaagcaatgtaataagtccttgcaatatacagatgaataagaaatggttgttgtactaaatagcctcaagttcacttccaggcagatgggataaat

SEQ ID NO: 16875 - DNA, 201 bp, Homo sapiens
taaatgatttgtactcagaatatgtaaagaactcctcctacagtctttgccttctaattggagcgtttagatcatttgctgttttattttttttgtttttktttttttttcagtaggtttttggtgaacaggtggtgtttggttacatgcataagttctttagtggtgatttctgagatttcggtgcacccgtcacccaag

SEQ ID NO: 16876 - DNA, 201 bp, Homo sapiens
ttcagctttaagaaggaatggaattctgatgcatgctacaacatggatgaaccttacttaagtcattatgctgagtcaaataagccagacacacacacacaaaaaattgtatgattccacttttatcaggtacctagaataatcaaactcatagagacaaaaagtggaatggtggttgccagcagctagggggaaagcgag

SEQ ID NO: 16877 - DNA, 201 bp, Homo sapiens
agcctatcagctggaaagacttaatagatctacaaaagtgaacagtttatagccaatatctgtttattgatggactgattatttatattgctgataggaamcagcctaattagaagtccactgtctttaattcagctgagtgagttggcatggtagctggacaaatgagagaagaatgaataaggccctgtctcagtttgt

SEQ ID NO: 16878 - DNA, 201 bp, Homo sapiens
gttacttcacttagaataatagtctccaattctatctagtttctgtgaatgccattattttgttccttttttatagctgagcagtattccatggtgtgtakgtgtgtgtgtgtgtgtgtgtgtgtgtatatatataacatgttctttatccacatgttgattgatgggcatttgggctggttccatatttttgccattgca

SEQ ID NO: 16879 - DNA, 201 bp, Homo sapiens
ctgcctcaagtcctatatgcatttacccaggttctgtctctattaccaagatgaattgcaaatggagaaatgtttgatggaatagagctcttaacttcttygtttagaattcagaattttatttttatagtagatcctttaagtatgaaaatgttttgaacttactatggattttttaaaatgaaaaatgaaatataagag

SEQ ID NO: 16880 - DNA, 201 bp, Homo sapiens
aattctatctagtttctgtgaatgccattattttgttccttttttatagctgagcagtattccatggtgtgtatgtgtgtgtgtgtgtgtgtgtgtgtgtrtatatataacatgttctttatccacatgttgattgatgggcatttgggctggttccatatttttgccattgcaaattgtgctgctataaacgtgtgtgca

SEQ ID NO: 16881 - DNA, 201 bp, Homo sapiens
gttctgtgttatatgtgacctgatatgtatttaatagatattgttacacactcttggctgtgaagtagaaattaaggtatagacttgccttcagctttaaytttatcttgatttgataggtttctaatttttcaggtggggaggttacagttccataaagacagtcatgcaccattgtagcttataggaagctacacccat

SEQ ID NO: 16882 - DNA, 201 bp, Homo sapiens
aacaggccacctacagaatgggagaaaaattttgcaatctacccatctgacaaagggctaatatccagaaaaaacaagaaaagagcaaccccatcagaaamtgggcaaagtatatgaacagacacttctcaaaagaagacatctgtgcagtcaacagacacatgaaaaaatgctcatcctcattggtcatcagagaaatgc

SEQ ID NO: 16883 - DNA, 201 bp, Homo sapiens
tgtatgaatattttctaagatattctcttcgaaatcaattttaatgagatttcctatgtgtttattttttgataactgacgaaaattcataaatacaggawtaattcctagatatacattaaattaattaatagctgtaaaacttttgtaatagttaaaaccttttctatgttaatattagagtatgattaacttacttct

SEQ ID NO: 16884 - DNA, 201 bp, Homo sapiens
gagtcagggactagagtcagaaaccttagaagtctacctagtgttctgttgtattgcagccgagctggcactcaaaccacaaggtgcaatgcttcccactyttcctcccctttctgaaggcagaggagcctcaacctgtagccaccaccaccccaggccacaaagagtactgccagagtacccccatagtcccttaacgcc

SEQ ID NO: 16885 - DNA, 201 bp, Homo sapiens
gaattggtgcttggtgccttatttagtttgattggtgaggtcgtattttcctggatggtcttgatgtttgtagatgttcatcagtttttgggcattggagmgttaggtatttattgtagtcatcactgcctgggcttgtttatgcttatctttcttgggaaggctttctagtattcataggaacttgggccccaagcccaa

SEQ ID NO: 16886 - DNA, 201 bp, Homo sapiens
aatcaactgctgatatattgatatatatttgatatattgactgctgttaatcagtcaaccacgtgttaattgctttctaccattgctgtattcttaggaastttaaatctagttgaggaaaaagtcatctatcctcaaatagttagagaagcgcttctaaaactgatctaagaatttgaaaaacttatatttacacttaaa

SEQ ID NO: 16887 - DNA, 201 bp, Homo sapiens
cttctaaaactgatctaagaatttgaaaaacttatatttacacttaaatataatctgaaacattaagtatagtttgaatcatttggtttccatcttatacmtatatttgtattcttgtgtaacatcacttggttccaagtgatcatttaaaggaacagtgtttcacaaatatgtgtattttgggtttgaaaaattctgaag

SEQ ID NO: 16888 - DNA, 201 bp, Homo sapiens
attcagctttaagaaggaatggaattctgatgcatgctacaacatggatgaaccttacttaagtcattatgctgagtcaaataagccagacacacacacacaaaaaattgtatgattccacttttatcaggtacctagaataatcaaactcatagagacaaaaagtggaatggtggttgccagcagctagggggaaagcga

SEQ ID NO: 16889 - DNA, 201 bp, Homo sapiens
gcttgaacccaggaggcagaggttgcagcgagccaagatcatgccactgcactccagcttgggtggcagagtgagaccgcgtctcaaaaaacaacaacaaccggtggctcatgcctgtaatcccagcactttgggaggccgaggtgggcagatcacgtgaggtcaggagttcgagaccagcctggtcaacacagtgaaacc

SEQ ID NO: 16890 - DNA, 201 bp, Homo sapiens
gtgtgtgacagagtttcagtcttgtttcccaggctggagtgcaatggcgcgatctcggctcactgcaacctctgcctcctgggttccagcaattctcctgytcactgcaacctctgcctcctgggttccagcaattctcctgcctcagcctcccaagtagctggaattacaggcatgcaccaccatgcaccaccatgcccg

SEQ ID NO: 16891 - DNA, 201 bp, Homo sapiens
tgcttgaacccaggaggcagaggttgcagcgagccaagatcatgccactgcactccagcttgggtggcagagtgagaccgcgtctcaaaaaacaacaacaaccggtggctcatgcctgtaatcccagcactttgggaggccgaggtgggcagatcacgtgaggtcaggagttcgagaccagcctggtcaacacagtgaaac

SEQ ID NO: 16892 - DNA, 201 bp, Homo sapiens
agttaatagatgggtgagcaggtaaagacactagcaatggagttttttgtttctattcactgttgcatttattaagtggaggctttgtgccaaaagttttycccctatattacctcatgacttaaaaatttcttacttattatgtttgttgtttcttttacttaatagaatgaaatccctatgagggcaagggtttttctg

SEQ ID NO: 16893 - DNA, 201 bp, Homo sapiens
ttctatgtttttctgtgtacttactattaccagttagttttgtaccttcaggtgattatttattgctcattaatgtcattttctttctgattgaagtactycctttagcatttcttgtaggacaggtctggcattgatgaaatccctcagcttttgtttgggaaagtttatttcttcatgtttgaaggatattttcactgg

SEQ ID NO: 16894 - DNA, 201 bp, Homo sapiens
atgcaccaccatgcccggctaattttgtatttttagtagagacagggtttctccatgttggtcaggctggtcttgcactcccagcctcaggtgatccgccygcctcggcttcccaaagtgctgggattacaggcatgagccactgtgcccggctgacaatgtgatttttaaaagtagaaataaactttcaattaaatgtct

SEQ ID NO: 16895 - DNA, 201 bp, Homo sapiens
caaagaaactgagtgaatctcttaggtgctctaacgatcagtcactaggatttgactggtgtctgaatgtcagtaaatgttaagatttgccttaataaaakattttggcaataaagatcttttatttgaaagattcttggggataaagtaaatttggcatgtggtgtgaaataaatcatggataagagtgaaaggaacaat

SEQ ID NO: 16896 - DNA, 201 bp, Homo sapiens
ttgcttgaacccaggaggcagaggttgcagcgagccaagatcatgccactgcactccagcttgggtggcagagtgagaccgcgtctcaaaaaacaacaacaaccggtggctcatgcctgtaatcccagcactttgggaggccgaggtgggcagatcacgtgaggtcaggagttcgagaccagcctggtcaacacagtgaaa

SEQ ID NO: 16897 - DNA, 201 bp, Homo sapiens
ataaagttggtatcctaatactcaaagctagaaagctacaggtaactaggtaaatgaagacacaggtaaattaaaaatgaatatatttgaaacaactattgttttcagcaaagagttgaggaaaatattgctaattcagcattattttgactcaaatattgatatttaacaaaatagtatctaagatttatgcagtaatac

SEQ ID NO: 16898 - DNA, 201 bp, Homo sapiens
catcctcattggtcatcagagaaatgcaaatcaaaaccacaatgaaataccatctcacaccagttagtatggcgatcattaaaaagtcaggaaacaacagrtgctggagaggatgtggagaaatagaaacacttttacactgttggtgggactgtaaactagttcaaccattgtggaagacagtgtggtgattcctcaaga

SEQ ID NO: 16899 - DNA, 201 bp, Homo sapiens
ggctcactttttgtgcttctcttctttcaaggatcatggccccttaagagtacttgtgtgtgtgtatatgtatatgcatacatatatgtgtgtatatgtawgtatttcagcttttatagttattttctatggcaggtttagttttttgtaagctacagtgtcatggacagatatggaagtccctacagtatattctgaatg

SEQ ID NO: 16900 - DNA, 201 bp, Homo sapiens
ttcctgaccatgttaattgtaattattttaaaatccctgtgtgataactctggtatctgagtcactcatggatctgctcctggttttttttttttttttttcctttttttcttttttgggcgggggtaatttcatcctgtttttagtatgtctcgtaagttttgatcagatgctaggtatttaggataaaaatgattgatg

SEQ ID NO: 16901 - DNA, 201 bp, Homo sapiens
aaggctagtaaaacatgtgctatgtataaaaccaatttcagctcaaatctgtatagtttcaaagccctgtgtttcccaccacacctcactgctgagtgtakgaaggagttacaactccaagagaattattttgtgtagcagcttgtggtacagctcagagtaaaacgaacctaatgacgggggcaaattagagagacctcg

SEQ ID NO: 16902 - DNA, 201 bp, Homo sapiens
attaagagactctttctttattttagttgcagatttaaaatctcagcactcaaatggactttagagttaaccaagttgtaaattctaactccacatttgagaaaactaatgattaagtggatttcccaggtttttccagcaaattaattacatggtttagtgtaccacattttcttttaagttggttttgaattgtattcc

SEQ ID NO: 16903 - DNA, 201 bp, Homo sapiens
tactataaatgcaaaacatgttagtctgttttattaaattcttcttgtatctttattattttattacttgtactttgagttcaatttgctgttttttttttcctagcattctgagatggaaacttagatcattgatttttaatctttctgattttgtattgtaattagaaatataaatttgcttctttttttttttttagg

SEQ ID NO: 16904 - DNA, 201 bp, Homo sapiens
ttgttcttgctctgttatcttgtatgatttctttggttgtctccttgtacttcgagacctcagatcacttatccgtggaggtcttttgtgatcacccagtyttactttattgcattccttattttaattgtttgtgtactacttatctgatctttctttatgtttttgttcctccctgctttcttccttctctgccttgct

SEQ ID NO: 16905 - DNA, 201 bp, Homo sapiens
aagtccacagtttgaggctgcctggaattatcaagctgtaatgccacatgacacatttcaaaatattttttcctatgtttatatgttttattttttactgrttagtcagtaagggatgccagtagatgagatgtttggtttaatttttcttacacatatcccagagtgctccagcaagacagtgtattgtccattacggga

SEQ ID NO: 16906 - DNA, 201 bp, Homo sapiens
attgcaggcatgagtcacagtgcccggccattgaaatatattcttaatatagtcagctttatagcagaaattgacagcgtagtatggtgaataggaagaaygttgaatttcaaaacaagattgaaatttaattccttgctttgccatccctggttttatgatgatatacataaaaggcatgtgattttagaatttctcaca

SEQ ID NO: 16907 - DNA, 201 bp, Homo sapiens; identical to SEQ ID NO: 2842

SEQ ID NO: 16908 - DNA, 201 bp, Homo sapiens
gtcttgccttaggaattgcagccaacattttgcacacagatttttgtgtaccttgtctctggttccctcctctgtaattttgtccttcaagtctcagtcaytgtggcagccctggaattcaacatttgtctcctcaagttattaagactgtgacttctccttgggttctgttctcccacatggcaatttgggaaatgtact

SEQ ID NO: 16909 - DNA, 201 bp, Homo sapiens
ccggctaattttgtgcttttagtagagatacggttttgccgtattggtcaggatggtctcgagctgctgacctcaggtgatccacctgccttggcctcccraagtgctggaattacaggcgcgagccactgcgcccggccgagaattgtttttaagtgatagcatactttaaaataatcacataaaacttaagtgatttgc

SEQ ID NO: 16910 - DNA, 201 bp, Homo sapiens
gattcagaatgcaagggttttccaattcagtagaaatgaccattatctattgctaatgttatatttcagtcactggttatttgctgttctcagaaagtcartgaaattctgtccttttgaaagccttttttctctctgttctaggcttctaataagagattatgccaatttcacatgcagctctgttctgtgttatatgtg

SEQ ID NO: 16911 - DNA, 201 bp, Homo sapiens
tcctaggttcaagcgattctcctgcctcagcttcttgagtggctgggattacaggcatgcaccaccatgcccggctaattttgtgcttttagtagagatasggttttgccgtattggtcaggatggtctcgagctgctgacctcaggtgatccacctgccttggcctcccaaagtgctggaattacaggcgcgagccactg

SEQ ID NO: 16912 - DNA, 201 bp, Homo sapiens
tgaaaccccatctctactaaaaatacaaaaaaaattagccgggcacggtggcgggcacctgtagtcccagctacttgggaggctgaggcaggagaatggcrtgaacccaggaggcagagcttgcagtgagccgagatcgcaccactgcactccagcctgggtgtctcaaaaaaataaataaataaataaataaaaataaaa

SEQ ID NO: 16913 - DNA, 201 bp, Homo sapiens
ggctggagtgcagtggcacgatctcggctcactgcaatctctgcttcctaggttcaagcgattctcctgcctcagcttcttgagtggctgggattacaggyatgcaccaccatgcccggctaattttgtgcttttagtagagatacggttttgccgtattggtcaggatggtctcgagctgctgacctcaggtgatccacc

SEQ ID NO: 16914 - DNA, 201 bp, Homo sapiens
ccttaggatgtatacatttaagatttaaggtaattttaaaccagtttaaataaatccttaaatgttgtaagaatagcacattcattctagtcttttgatgkcttatctttttaaaatacagtattatagattttaaaaaccaatttgtgtaaaaaaaaaaaagatttttaaaaagctcctgttatatcaaagtggtctgta

SEQ ID NO: 16915 - DNA, 201 bp, Homo sapiens
gggataattaactatagatgagaactgttttttttttttttttttttttgaggcagagttttggtcttgttgcccaggctggagtgcagtggcacgatctyggctcactgcaatctctgcttcctaggttcaagcgattctcctgcctcagcttcttgagtggctgggattacaggcatgcaccaccatgcccggctaatt

SEQ ID NO: 16916 - DNA, 201 bp, Homo sapiens
aagtgaagctatttgttttctttgtgcagattaacattagaagtacgccttattcttttttttaagtatgccttattcttttcatcatattgacaatttaraaaattttatcatataacttgtaattaagatccttaggatgtatacatttaagatttaaggtaattttaaaccagtttaaataaatccttaaatgttgta

SEQ ID NO: 16917 - DNA, 201 bp, Homo sapiens
tctgtaaaataagaataaatacttgtttattgagttgtgaggataaaatgagttaatttatgtaagacatttagaacagtgtctgacatgtagttaatgcwacctataaggatttgctattattaccatattatgtccattctaagacatatgtttgctattttaaagtttctgcagttgggatttaacttaacaactggt

SEQ ID NO: 16918 - DNA, 201 bp, Homo sapiens
attttatataatatgttaaaaaatatatatttttcttttgtagagattaggtctccctatgttgcccaggctgttcttgaactcctgggctgaagcgatcytcctgcctccgcatcccaaagtcttgggattgcaggcatgagtcacagtgcccggccattgaaatatattcttaatatagtcagctttatagcagaaatt

SEQ ID NO: 16919 - DNA, 201 bp, Homo sapiens
tatatatatttatatatatatatttaagtcatatatatatatttaagtcatatatatatatatttaagtcctatatatatttaagtcctatatatatatayacacctatatatacatatataggacttaatatataatatatataaattttatataatatgttaaaaaatatatatttttcttttgtagagattaggtctc

SEQ ID NO: 16920 - DNA, 201 bp, Homo sapiens
ttccttttccttacaatgataatgtggtcttttagtcataaaggaccacaatacaaattaagatacttttattgttcgtctttggccttttaaaacctgawactccatagaattcatggccatgtcaagaaaaaatgcacgtttgagcatagaagtctggttttccgaaattgttgatttagtgttattaaattaatccaa

SEQ ID NO: 16921 - DNA, 201 bp, Homo sapiens
tcaacctcctggtctgatcctcccacttcagcctcctgagtagctgggcccacaggtgtacaccaccatgcctggctaatatatatatatatatatatatatttatatatatatatttaagtcatatatatatatttaagtcatatatatatatatttaagtcctatatatatttaagtcctatatatatatacacaccta

SEQ ID NO: 16922 - DNA, 201 bp, Homo sapiens
cttggaaagttgttgttgttgtttttttaaagaatttaaaaattaatctagctttgagttggcatatcttattaacacagttgtagaaaacttatatttcstctactatagtttatgaatttcttggagaaaaatctaatactaatactcaaacttgatgcacaaacggattctttggcatgtttgtgtgtatgcccatct

SEQ ID NO: 16923 - DNA, 201 bp, Homo sapiens
tagaataaccttgcaaaagaatgaatactaatgatgttagatagtagcactgatgaggactttccacacatacctgtgtataccaggcagacagaatagcrtatacctaggtttagagctgtaatgttcaatatagtagcaactagccaaatgtagctatttaaatttaatttaattaaatttaatttctccaccactcta

SEQ ID NO: 16924 - DNA, 201 bp, Homo sapiens
ttaactttacggattaatatttgttctgccttgttcactggatattgtgagactgaaatgagaaaaagatgctttgaaaagtaatgtcacagctgggtgtygtggcacacgcctgtaatcccagcagtttgggaggccaaggtaggaagattgcctgagcctaggagttagcgaccagcctggacaacatggggagatccc

SEQ ID NO: 16925 - DNA, 201 bp, Homo sapiens
atagaattcatggccatgtcaagaaaaaatgcacgtttgagcatagaagtctggttttccgaaattgttgatttagtgttattaaattaatccaacaaackttttatcagacctcagagaaatatgtttggatttaagaaaaatatggacttcagagtttaccaaatataagagagctttgtttatagaatactatctttg

SEQ ID NO: 16926 - DNA, 201 bp, Homo sapiens
aacattaaatttactatcttaaccatttttgagtgtacaattcagtagtgttaactatattcacattgttgtgctacagatgtctagaactgtttcatctrcaatactgccctgtgactttttaaaaactaatttttttattgagatttccaagtgcatcagggacaaaggcagacattgcatattggtttcctgaattcc

SEQ ID NO: 16927 - DNA, 201 bp, Homo sapiens
acagtcaagatggattcttccctgggatgcaaggctggttcaacatatgcaaatcaataaatgtaatctatcacataaacagaaccaacgacaaaaaccayatgattatctcaatagatgcagaaaaggcctttggcaaaattcaacagcccttcatgctaaaaacacgcaataaactaggtattgatggaatgtatctca

SEQ ID NO: 16928 - DNA, 201 bp, Homo sapiens
agaagtctggttttccgaaattgttgatttagtgttattaaattaatccaacaaacgttttatcagacctcagagaaatatgtttggatttaagaaaaatrtggacttcagagtttaccaaatataagagagctttgtttatagaatactatctttgtagacagaagcattttaaataaatataaaagaaagccatactgc

SEQ ID NO: 16929 - DNA, 201 bp, Homo sapiens
tttgtaggactttttttctgtttctggttctacatagccttcatcaggaaacttggtgggaccatgtgactttaaaaaattgtggtaaaaaacacataacrttaaatttactatcttaaccatttttgagtgtacaattcagtagtgttaactatattcacattgttgtgctacagatgtctagaactgtttcatctgcaa

SEQ ID NO: 16930 - DNA, 201 bp, Homo sapiens
acccactgccaatatcatactgaatgggcaaaaactggaaacattccctttgaaaactggcacaagacaattatgccctctctcaccactcctactcaacrtggtgttggcagttctggccagggcaatcaggcaagagaaagaaataacgggtattcaattaggaaaagaggaagtcaaattgtccctgtttgcagatga

SEQ ID NO: 16931 - DNA, 201 bp, Homo sapiens
ttcagagtttaccaaatataagagagctttgtttatagaatactatctttgtagacagaagcattttaaataaatataaaagaaagccatactgctgatcktatataagcatcttattcaaatatattcaagcttctctttttaagcaacataccttaaaccctctagatcagtggttttatttttatttgcttttattta

SEQ ID NO: 16932 - DNA, 201 bp, Homo sapiens
ttctattcctgtcaagtacaaatttgtaggactttttttctgtttctggttctacatagccttcatcaggaaacttggtgggaccatgtgactttaaaaaattgtggtaaaaaacacataacattaaatttactatcttaaccatttttgagtgtacaattcagtagtgttaactatattcacattgttgtgctacagatg

SEQ ID NO: 16933 - DNA, 201 bp, Homo sapiens
tgaaaactggcacaagacaattatgccctctctcaccactcctactcaacgtggtgttggcagttctggccagggcaatcaggcaagagaaagaaataacrggtattcaattaggaaaagaggaagtcaaattgtccctgtttgcagatgacatgattgtacatttagaaaaccccatcgtctcagcccaaaatctcctta

SEQ ID NO: 16934 - DNA, 201 bp, Homo sapiens
cttactcctgggctctagtgatccttctgcctcagcctcctgagtagctgggactgcagacatgtatcaccatgcctagctatttttttttttttttttttggtagagacaagtcttactatgttgtccacgctggtcttgaactcctgggctcaagccgtcctcctgccttggcctcccaaagtgctaggagtacaggca

SEQ ID NO: 16935 - DNA, 201 bp, Homo sapiens
tttcatttgtttagattcaaagagctaatttagatccaagcaaagtactgcatgctttcctgtagtcagtaatacaacccagtgtatttggattgcatcawtaaagcctgacttattttttaacttaaatcttattcattgtcaactttacaatatcaaacatgaaaattctattacattcattcttaacctttaatatca

SEQ ID NO: 16936 - DNA, 201 bp, Homo sapiens
gagagctacccttttgcagatttaccaattaaaaaaaaaatgctacattgcttgcttactctctctgccactcactctccccatgcatattcaggcacatrtacgtattcatgttattatgtcttctgaaccattggagactcagttgtacacatcatgttcttttacaatgaaaatcttaatgtgtaatttttaagaaca

SEQ ID NO: 16937 - DNA, 201 bp, Homo sapiens
cttttaaaaaatcgaatgacaaagtttatataaaaaacttaaagcttaccctattcctcacctctggtttttaatggtttactctgatgaaatagtttcargtttacaaaaaagttgcaacaatgacacagagagctacccttttgcagatttaccaattaaaaaaaaaatgctacattgcttgcttactctctctgccac

SEQ ID NO: 16938 - DNA, 201 bp, Homo sapiens
taattggaaaaaggttttttcatttcatttataactctacccgtatagtatagatggattgatatcaacttaaaatggttgtgtttaacatatttatcaaygatgaagatgtacaaagtttgtttgctcattaagttttcatttgtacttatgaattgagaaatagtttggattataaaattatcatctcaaattatctta

SEQ ID NO: 16939 - DNA, 201 bp, Homo sapiens
agaatataactccaaaatatatgttatctaaaaaattatgacaagatgttgccatttctaatgtgcttaaaatttatctcttaggaaatataaatgattcrcatatataaatatataagaacagcatgctttctactcattcatctgctctcaaaagcaagttttatattaaagtttatatttttgtagaccttatttact

SEQ ID NO: 16940 - DNA, 201 bp, Homo sapiens
ttaacagggtgccaagatgtgttgaatctaaattgttgacaatttctgtagataaatggaagattttgcctttcatttaaaataattttaaaaaaattccrtgaggacagttggattttgatttggtcagcagtacatttggaaaaggtgtatggttttaatcaagaattagtcatatctgtggaagtacctcatctggag

SEQ ID NO: 16941 - DNA, 201 bp, Homo sapiens
aagatgtgttgaatctaaattgttgacaatttctgtagataaatggaagattttgcctttcatttaaaataattttaaaaaaattccgtgaggacagttgrattttgatttggtcagcagtacatttggaaaaggtgtatggttttaatcaagaattagtcatatctgtggaagtacctcatctggagcaagttcttatct

SEQ ID NO: 16942 - DNA, 201 bp, Homo sapiens
aagttcttatctagtttgttctgtttagactttatttgtagtttgtagtgtcacgctgaaaaaaattggagtgagtttaggaaggagcaaacaggatggtrgaggaactaaagctgttatgtttcacgagaaattagggtacaaggaaggaaggtcatgacagttgtctctaaagtagtccagattggttagtatgactgg

SEQ ID NO: 16943 - DNA, 201 bp, Homo sapiens
attacaagggaattaggtagcctgattagagtggagaataaaatagatataggatttgaacatctttcaagacttctaattccactgcagcattctcttgraagcggttgttattcttatgatagtctggaaaaaaaatgtttctttacttttttagggagattactgggtgataaatgttagtgataatgttatgtgata

SEQ ID NO: 16944 - DNA, 201 bp, Homo sapiens
tttaacattaaccattgctttatgtttttaattttcaaattttcatcaaacttcagtttttctgaattatatttcacaagtgtttgaaacaactaaatatrtttacttttaatggcaaaaactgcagttacttttgcaccagcttaatacaaagtacctttaatgtgcaccacataaaaataaatgaaattaataagccct

SEQ ID NO: 16945 - DNA, 201 bp, Homo sapiens
ttgacgaatagtcaccataaagtttgttattcaaacatgaacattcattttaattgaatgactgaatactttaatactgattggcatgaaactgattactrtaatgcctgagtaagacctttgatgtaggggagaaacattttttaataagttactatttctttcttttctagttggtagctggcagtgttgtgatggctt

SEQ ID NO: 16946 - DNA, 201 bp, Homo sapiens
gctaggagtacaggcatgagccaccatgcctggcctgttttatttttaatatgatgtactttttaagctattataattttagaattattgttaattttaayattaaccattgctttatgtttttaattttcaaattttcatcaaacttcagtttttctgaattatatttcacaagtgtttgaaacaactaaatatgtttac

SEQ ID NO: 16947 - DNA, 201 bp, Homo sapiens
cattgagtggaaagtgtgtgtgcggcatgtgaagagaaggccagtgaggaatcttagtaaagtctacattgaagagagtaggagaattggaacttacttasaaaactaagaagggagaattcagtttggggaaaccatgaaagttgattgtacaagtttttgaattgtgtttaaggtataaggaaagggcgaaacttaatt

SEQ ID NO: 16948 - DNA, 201 bp, Homo sapiens
tccacaatagttgaactagtttacatttccaccaacagtgtaaaagcattcctatttcttcatagcttcgccagcatctgtcgtttcttgactttttaatygccattctgactggcatgagatggtatctcattgtggttttgctttgcatttctctaacgatcagtgatatggagctttctttcatgtttgttggccaca

SEQ ID NO: 16949 - DNA, 201 bp, Homo sapiens
ccttgcaaaagaatgaatactaatgatgttagatagtagcactgatgaggactttccacacatacctgtgtataccaggcagacagaatagcatatacctrggtttagagctgtaatgttcaatatagtagcaactagccaaatgtagctatttaaatttaatttaattaaatttaatttctccaccactctagtcacatt

SEQ ID NO: 16950 - DNA, 201 bp, Homo sapiens
atttttctcctttgcaggtgacttgattttttttttctgcatgctaaaaaaacctgtttaaaaagtctttgagaattaatcaggttacatctcaacgtgarttattccatatgatctccaggttcacttcttccttttattttagggaattttcttttctttttgtaattttaaaaattcgatgtttacattttttttctg

SEQ ID NO: 16951 - DNA, 201 bp, Homo sapiens
ctgtgaagaaatctgaagatagccaaagatttttctcctttgcaggtgacttgattttttttttctgcatgctaaaaaaacctgtttaaaaagtctttgaraattaatcaggttacatctcaacgtgagttattccatatgatctccaggttcacttcttccttttattttagggaattttcttttctttttgtaatttta

SEQ ID NO: 16952 - DNA, 201 bp, Homo sapiens
catgattgtacatttagaaaaccccatcgtctcagcccaaaatctccttaagttgataaacaacttcagcaaagtgtctcaggataaaaactcaatgtgcraaaatcagaagcattcctatagaccaagaacagacaaacagaaagccaaattaatgagtgaactcccattcacaattgctatgaagagaataaaatacct

SEQ ID NO: 16953 - DNA, 201 bp, Homo sapiens
tacatttccaccaacagtgtaaaagcattcctatttcttcatagcttcgccagcatctgtcgtttcttgactttttaatcgccattctgactggcatgagrtggtatctcattgtggttttgctttgcatttctctaacgatcagtgatatggagctttctttcatgtttgttggccacataaatatcttcttttgagaag

SEQ ID NO: 16954 - DNA, 201 bp, Homo sapiens
aaatatgtgattctcagctgaggctgtatcttttaaaatgttttgaaaatacctttgtacagaaagcaacactggccacacctaagaaagcgatgcttccmctccccctccttgccctcacttctctttcccctctcacacagtccctttctctcaaagccattccccatgtctccacctcaatggcctgtggtagtttag

SEQ ID NO: 16955 - DNA, 201 bp, Homo sapiens; identical to SEQ ID NO: 2833

SEQ ID NO: 16956 - DNA, 201 bp, Homo sapiens
atccatttggtgattgcacagtcctctgtgagcttaagggaattcgttgcaaaccatctcatggcaggcatacttctgccattaaaaatatctacacactrtatatttagtgtgccctttcttatataattatcaatcatagaaaacaaatttagcatcaaagggaaggcctgcagaccttaaaaaacatttttttaagtt

SEQ ID NO: 16957 - DNA, 201 bp, Homo sapiens
tctaaaacttagaaatttttctgaatttttttatgttatttggtttgccttttagtagttaattacagctgattagcctaaagtaagtgctatctactgcyttcaccaaaatttagatagattctaataaagccacaaattatttagcctacagtttttaaatattttcccagtgattttacctttattatatatgaacag

SEQ ID NO: 16958 - DNA, 201 bp, Homo sapiens
agctccaagtagtaccaccagagaagcttccagggattagaaacatttggctattgacctgcagtctaatggaattgtacagaaacaaggagacccctgtkctggaagtggtcattaaatctctcttgagtccacattttctcatttataaaaccgtaatattacttgccttttaaaaaatcgaatgacaaagtttatata

SEQ ID NO: 16959 - DNA, 201 bp, Homo sapiens
ggtttgtgaacatctacgatgttttctcttagatttttgtcagatttggggccaggcactgcggctcacgcctgtaatcccagcactttgggagggtgagktgggcggatcgcttgaggccaggagttcgagaccagcctggccaacatggtgaaaccccgtctctactaaaaatacaaaaattagccgggcgtggtggct

SEQ ID NO: 16960 - DNA, 201 bp, Homo sapiens
ttgatgatccattgttctagaacaagtacggagcttgttgcctctactattagcaaaatgtttagactgaattaacctgtatatcggcatcaatctgtttygcaaattaatttacttttatggtttgtgaacatctacgatgttttctcttagatttttgtcagatttggggccaggcactgcggctcacgcctgtaatcc

SEQ ID NO: 16961 - DNA, 201 bp, Homo sapiens
agagtatgattaacttacttctaactatgtaatctgcttctcatattaggttcctgttgctagagcaagtattctttggctaattggagaaaactgtgaaygagttcctaaaattgcccctgatgttttgaggaagatggctaaaagcttcactagtgaagatgatctggtaaaactgcagatattaaatctgggagcaaa

SEQ ID NO: 16962 - DNA, 201 bp, Homo sapiens
gcttcgacctcccaggctcaggtgactctcccatctcagcctcccaggtagctgggactacaggtgcatgccactgtgcctggctaattttttttttttttgttttactagaaatgggatttcaccatgttgcccaggctggtcctgaactcctgaactcaggcaatctgcctgcctcagcctcccaaagtgctgggatta

SEQ ID NO: 16963 - DNA, 201 bp, Homo sapiens
taatgtctttttacgtctttgacataaaaatgtactttatttacatagtatcatttaccattatatattttatatagttgtatttattgatttcaaaatgstataaatattaatggcacacaggactatttttaaagaacaaaaattttcatgtaatgagaaagactgcatttggagttttagatcgttatgtgtttcttc

SEQ ID NO: 16964 - DNA, 201 bp, Homo sapiens
tttcatttaaaaaatctcccagttaaatgtaccaggtctaatttatttccacattttgaaaaggaatttatttgttgccagcagcagttttttgggatcaytattacgatgatgacattggtgttgctgctgatacatatacatttgaaagatgttgatctattaaactttcttcatttaacctctgttgattttgaggca

SEQ ID NO: 16965 - DNA, 201 bp, Homo sapiens
ttttattcttttggttctttttctacctttctttaataccccttttaaaattttcattcagtaattttattcgaagggcaccttgcaatttagtcttcacrtctgattatttttgctctcttgatttctttcctgttgtcaatcaatcctgatttcttttgttaatttataactttaaaaaatttataatttatatttata

SEQ ID NO: 16966 - DNA, 201 bp, Homo sapiens
ttttatctttgaaatatagtacttttgcaaggtacttcaggattacttgatatgggtcaattgttttgccttggtactcagtgagtcctttcaaaatgtasattcagaatttttattatctctggcaaagtgtttttttttaagattataattttaaatattaattctgttattttttttctttttcagggattcctattt

SEQ ID NO: 16967 - DNA, 201 bp, Homo sapiens
atttcaccttgaactgctgctttggcctgcttctccctccggttctttcactgcaggtctcagacacccttttcagcaacctgcagcagctactggatccsctgagactgactggccatgacagcaccaactctgaggcagaagcaagcagcctaaatctctctctctttttttttttagagaatgaatcatatctgcaaa

SEQ ID NO: 16968 - DNA, 201 bp, Homo sapiens
tttttgaatttttattcattttcttcttgtgaattaaattacaaatctaaaacttagaaatttttctgaatttttttatgttatttggtttgccttttagyagttaattacagctgattagcctaaagtaagtgctatctactgccttcaccaaaatttagatagattctaataaagccacaaattatttagcctacagtt

SEQ ID NO: 16969 - DNA, 201 bp, Homo sapiens
atatgcaacatgatctatcactttttctcagttgtgtttagggtttcatggctaaacttttttatatatatataataagattggtagtcaaagtggtaaaygaaagattagattattctacgtattgacggttatgtatataagcctccatcagaagcatgatttattcattgctatgagtttcaagcattgcagaattag

SEQ ID NO: 16970 - DNA, 201 bp, Homo sapiens
cctcagcctctaagcatgctcaggtttctttaggtgttattcctttgcttcttcattctcaggaagcttctgctttctgttccttcttccattgccaatcytcccttcacccttcaactcactgcattgtgtagtcttcctgcaatctgaacagccttgctaagattaacagttatacttctttttatcccttatcttatt

SEQ ID NO: 16971 - DNA, 201 bp, Homo sapiens
ataattgatattgacacaagaaccaatgaaaccagagaatttagaaatgtagaaattttgtatgtcataaaggtgacatttcaaatccgtggggaaagaayagaccatgcagtaaatggtgtgaggaccattatttggaaaaaatcaaggtagcttcctcccacaaattataccaaaacaagttccatgtggatttattat

SEQ ID NO: 16972 - DNA, 201 bp, Homo sapiens
aaaaaatgcacaagaaaagtcaacatttttagtgaaaaaagtctttctctataataatttaaaaatattccttaaagccacaagaatatttttattctgtrtaattgatattgacacaagaaccaatgaaaccagagaatttagaaatgtagaaattttgtatgtcataaaggtgacatttcaaatccgtggggaaagaac

SEQ ID NO: 16973 - DNA, 201 bp, Homo sapiens
ctcaaaaaaaaatcagagacagagaaaaacatagaattaataaaacagtagtgagcaaagcattctacgaaatttatcaacgtataaaaataattgttgayataatgtgaaaaataaatattaacaataaattggaaccaaaatccccacagagacaagtgcaaggaggagtgatggtatactagggttcttgttatgtct

SEQ ID NO: 16974 - DNA, 201 bp, Homo sapiens
atctcttgtggaacttttggttctttttggaatcaaaaattgcttcattttaaatttgcttactttatcatgtcactatatgaagcattccaagttctccrttggaatattaaatattctccaaatattattttatgtgcagttgttgtgatacttcttgtctacccaatgtcagttctacccctcccacttatttaaata

SEQ ID NO: 16975 - DNA, 201 bp, Homo sapiens
tgcagttgttgtgatacttcttgtctacccaatgtcagttctacccctcccacttatttaaataacaggatcctgattttgttcagagtagttatatgccyaatgaaaaataatcaacgtactaaattcctttagagtcagaaatgggtccacatctggaaattgggattctggggaagctattgtttttctgacagactt

SEQ ID NO: 16976 - DNA, 201 bp, Homo sapiens
tcttgtctacccaatgtcagttctacccctcccacttatttaaataacaggatcctgattttgttcagagtagttatatgcctaatgaaaaataatcaacrtactaaattcctttagagtcagaaatgggtccacatctggaaattgggattctggggaagctattgtttttctgacagacttatttgacatatgtatatt

SEQ ID NO: 16977 - DNA, 201 bp, Homo sapiens
taaaatatgagaaattatcataaatttgtatatcaaaatttatatacataaggaagaagttatctttagtattaaaaaccatttatttgaagtaatatttsctggaagattcaaatatatttcttcgagtctgtgcttatatgtaagagttaaccaaatttgccgtttacttttttaaatcctattctaggtcaatactag

SEQ ID NO: 16978 - DNA, 201 bp, Homo sapiens
gaatgggtgaacttaagtcaattgagattatctagtctagggagtagaaagtcaaaaagcatgaagatgaacagagctcaagagacttaagaggcctgtgygatgacatcaagtgcaccaacacacataatacatattccaggaggaaaggagagagagaaaggggcaaatagaatggctgaagaaaaaaatggctgaaaa

SEQ ID NO: 16979 - DNA, 201 bp, Homo sapiens
ttcctggagtcttcaccctctgttctaatctgattgcttactaggcctgcacagttccaatctgtttttctagaacttaatttcatgtctcttctgtgttraatcctatttcttaggctttcttcttctctctctctttctctctctgtctctctgtctctgtctctgtctgtctctctcctttcttttggttttcctggc

SEQ ID NO: 16980 - DNA, 201 bp, Homo sapiens
tgatttttcaaccatttagaaatgtgaaagtcattattagtgaacaggcattgcaaaaatagacagtggaccagatttggcctctaagcatggtttgctgktgcctgcttaataccgagcatgaaataagatgctcattaaatatttgttcattatgtgttcaagtatttccacaaatatatttttaatatatattattac

SEQ ID NO: 16981 - DNA, 201 bp, Homo sapiens
taagttttcttgggttgatgtccttcagaaacaccaatttttcttagataagtaacttcatacattttcatataaagtacatagaaaaaccattcctagtrtagtagagctatattctgaaaaaaaaaatttttttagacaaaataaatcccctttcctcttcaccctccatccccatgattctgtgtatgtcctgctgaa

SEQ ID NO: 16982 - DNA, 201 bp, Homo sapiens
ctcttcaccctccatccccatgattctgtgtatgtcctgctgaaaattcatgtacttgtctagcatggggcttatagtatgctgtatgtaagcactaggtratggtgctggttagttatccatttgacatgctgaccattttctaatttgaacagttctagccatgttgttggaattaaaaatttagggccagacattgac

SEQ ID NO: 16983 - DNA, 201 bp, Homo sapiens
atagctaatgaactagcacagagaactctagatggaagaagacaaagaagagagatatataggtgactgtatatttacacatgattatgaggttggtgcaraaataattgtggtttttaccacaatggcaaaaacctcaattcctttgcaccaacctaataaatgtatagcaatagactaggaatgtctaaccaaagtgct

SEQ ID NO: 16984 - DNA, 201 bp, Homo sapiens
catgtttattgctttaatataaaaaatacataaatggaaaactgcatttgaatttgatgagctcattgctggttttgttggagtgatttattttttccctkatatgaaaagctactattgacacagtgagatggaagttaactgtctgttttttggaaaccagtatttttggttttaaaatctgagtagatcatttaattt

SEQ ID NO: 16985 - DNA, 201 bp, Homo sapiens
ccactctgggcaaggcatagctgaacacaaggcagcagacaactgcagacatcagtgtacctgtctgacagctctgaagagagcagtggttctcccagctyggtgtttgagctctgagaacagacagatggcctcctcaagtgagtccctgacccccgtgtagcctaactgggagacacctcccactaggggccgacagac

SEQ ID NO: 16986 - DNA, 201 bp, Homo sapiens
cctcccaagtagctgggactacaggcacctgccatcatgcctggctaatttttttgtatttttttgtatttttaatagagatggggtttcaccgtgttagycaggatggtctcgatctcctgatctcatgatccgtccgccttggcctctcaaagtgctgggattacaggcatgagccaccgtgcccggccagatgtttgt

SEQ ID NO: 16987 - DNA, 201 bp, Homo sapiens
caaaggaagaatttggtaacttttaggtagataactgagatttgcaccggaatgattatctggatagtggtacccagttaaccaagatagaaaataaggargaggaaaggacaatgacattgaaattttctttggaacatgttactctgaggtgcttttggaacatcaagttagagatgtccagtaagaaggtaaaatcca

SEQ ID NO: 16988 - DNA, 201 bp, Homo sapiens
aacttttagtggggtctttaaaagtaactttcttttacaaaaacgtaaagtttattttataccttgaagagtctttttctctttcattttatacttatctytttctgtgaacctctatagagataaagctaaaattattaagtctctatatactataaaaaaatcaaactaaaggttgagggtaactatatgcagtgaaaa

SEQ ID NO: 16989 - DNA, 201 bp, Homo sapiens
aaataattcactggtttttaaaaaacagcaattaaaaatatctcaatttagtaagtgagtctgtgtgtgctaatggagcatttgtttgtttacacaccaartgacatgtaatggatagttggaagtacagtgtggaatgtaagctatagatttagagacctaatgtctgagaagtaatacctaaatatatttcagccttcc

SEQ ID NO: 16990 - DNA, 201 bp, Homo sapiens
tttacttcgtagcaataggtaggtcatgattttatatatattttttcttttgtattccttcaaaagtaatgtttgaacaaatgtaatctttcaggcatttmatatataactctgactatattttaatcaatcgatcagtaagatttcatacttaaggggattattataaaagtctttatgcatttatctcaaacttaatga

SEQ ID NO: 16991 - DNA, 201 bp, Homo sapiens
attgtattagggcccaccctaatggcctcattttaatgtaaacacctctttaaaggccctgtctccaaatatagtcatatttggaggttaaggcttcaacrtaagaatttagggttggggggcacagtttggcccataacaaccaagctgtaaaccttacagtgacatatggagattttgtttgctccacatcctcaccaa

SEQ ID NO: 16992 - DNA, 201 bp, Homo sapiens
tgtaggtggttatggcagttgctcagctgtattggcacatatcaccaaaatctgaagctggcataatttctaaatcactagtgcgtttacttcgtagcaayaggtaggtcatgattttatatatattttttcttttgtattccttcaaaagtaatgtttgaacaaatgtaatctttcaggcatttaatatataactctgac

SEQ ID NO: 16993 - DNA, 201 bp, Homo sapiens
gttaacttcatattttaggagcactttattataaaatttgttttaactattcttcatgatgaatcacgtctaatttattggtattttataggaaaagtgcrttaaaaagacacacatctaagatttactaaaaacttttcattattacatttaagagtctcattcacttgaaattattgctaattctttgtcattattgta

SEQ ID NO: 16994 - DNA, 201 bp, Homo sapiens
aatagatttaccttgtactgttttttttttttttaagttgctcaagaggtctcatgctttcatttcttttttgttgttgttgagacagtcttactctgtcrcccaggctggagcgcagtggcgcgatctcggctcactgcaagctccgcctcccgggttcacgccattctcctgcctcagcctcccgagtggctgggacta

SEQ ID NO: 16995 - DNA, 201 bp, Homo sapiens
aataaaaatccgtttcctcagattttatcaatgcaaaattctggaaggtaaaatgcaagtaaatttaaggggtgtgtgtgtgtgtgtgtgtgtgtgtgtgttacaccagctttaaccgatttttctaccttgaataaagtggatttacataattaatatcttatttcatatgacacattttaaaactcaagaagtatgtta

SEQ ID NO: 16996 - DNA, 201 bp, Homo sapiens
gaataaaaatccgtttcctcagattttatcaatgcaaaattctggaaggtaaaatgcaagtaaatttaaggggtgtgtgtgtgtgtgtgtgtgtgtgtgtgttacaccagctttaaccgatttttctaccttgaataaagtggatttacataattaatatcttatttcatatgacacattttaaaactcaagaagtatgtt

SEQ ID NO: 16997 - DNA, 201 bp, Homo sapiens
aaaattagctgggtgtggtgatgcactcctgtaatcccagctactcaggaggctgaggcaggagaatcacttgaatccaggaggcggaggttgcgtgagcsgagatcacactactgcattccagcctgggtgacagagtgagactctgtctcaaaagaaagaacaaacaaacaaaaacataataaaattaaagaaaaataa

SEQ ID NO: 16998 - DNA, 201 bp, Homo sapiens
agaaaatctgtaaaaacagtccaatcagctttttgaattcagaaaatagtcaaaggtttacagcaaccattcaaacatttaagaaaatggggcctgaaacycaggagaaaagatttgtggcatttaaacttaccctcactctatcctcccttctctgcctcagtgacaggggctggatggaacagagtagattctgttcgc

SEQ ID NO: 16999 - DNA, 201 bp, Homo sapiens
tgttctgggtaaaagagtacaaggggaccaggaacagggtttttacctaaagcagaagggagagagggtgggagaagtatgttatttgagtggataaggargaatactgagaaggactgcccgctttcaaactgaggttcaaggagtctaagagcttctttgctggtttcttcctttcttcatgttgggaaaagggcttgt

SEQ ID NO: 17000 - DNA, 201 bp, Homo sapiens
atagaacgtattcctaaaactccttttccacctagtgttaattagaaagttgacaagtgtcattttcaactttattatgtttacatattttatcatttttwaaaaaaattaagctcagtactatattttatgcagatcctgtttattttttatttgatgtacactttaacctcattgatccaagcttttataggtgtcgta

SEQ ID NO: 17001 - DNA, 201 bp, Homo sapiens
tcaataaaaagaaaaaaagaaacaagaatggctgatattgaattttttccttgaaatacattatacaaatcgatacataaaattatgggtaataacagcayatttgataagaagccttcagaaatgctgggaacatggaccaaaagcctgtcagatactcttttattagttagaataaaaagaatagagtaaaatgatcct

SEQ ID NO: 17002 - DNA, 201 bp, Homo sapiens
caggctgtgtcatctaagttgctgattcattccaatttttaaaatttgttgtggaaatgttcacattaaaaaaaatcagctcatactgacctttgtgaaaygctttaaagaactctgttaaaaaatgttagttaaaaataagttttcttgggttgatgtccttcagaaacaccaatttttcttagataagtaacttcatac

SEQ ID NO: 17003 - DNA, 201 bp, Homo sapiens
aaacaaaatgaaattaatctacatcatcacttggtcctcatattgtgcttatgagaagtttatgtattctggaattcttatatattgacaaagtttaatayaatcggagttttggttaactcaataataccagtgtgtaaactaattgaaataatatcttttagacctatgtgaaaagccaggataaacaatttgcagcag

SEQ ID NO: 17004 - DNA, 201 bp, Homo sapiens
tcttttaaggcttgtattaaatagaatgtttttctaatttaagtttacattttacgaagcatattgcatttgaattgaattatacatatttagtatgaatratttctatctttttcagaaatagttgttgctgaaagtgtggttgttataaagaaattactgcaaatgcaacctgcacaacatggtgaaattattaaacat

SEQ ID NO: 17005 - DNA, 201 bp, Homo sapiens
agaataaaaatccgtttcctcagattttatcaatgcaaaattctggaaggtaaaatgcaagtaaatttaaggggtgtgtgtgtgtgtgtgtgtgtgtgtgkgttacaccagctttaaccgatttttctaccttgaataaagtggatttacataattaatatcttatttcatatgacacattttaaaactcaagaagtatgt

SEQ ID NO: 17006 - DNA, 201 bp, Homo sapiens
caaatttggaagcgcactcatggttatgctttcacatagtcttttaaggcttgtattaaatagaatgtttttctaatttaagtttacattttacgaagcayattgcatttgaattgaattatacatatttagtatgaataatttctatctttttcagaaatagttgttgctgaaagtgtggttgttataaagaaattactg

SEQ ID NO: 17007 - DNA, 201 bp, Homo sapiens
caacttcttttcagttttctcatcagtaaatttgaaataacagaagctgtctcttaagatcctttttaggctttatttaagtaaaaaacacacagtaaatscttaaaaaaaatcaaaatcctgcctagactattaatttagactcctaactgatgtatctgcctttgatttctcccttactccaccttacatactgccact

SEQ ID NO: 17008 - DNA, 201 bp, Homo sapiens
ttctagaccatcggtttttgctgtatgaatattttctaagatattctcttcgaaatcaattttaatgagatttcctatgtgtttattttttgataactgaygaaaattcataaatacaggattaattcctagatatacattaaattaattaatagctgtaaaacttttgtaatagttaaaaccttttctatgttaatatta

SEQ ID NO: 17009 - DNA, 201 bp, Homo sapiens
aactttgggaggccaaggcaggaggatcacttgaggccaggagttcaagatcagcctgggcaacatagtaagactctgtctttacaaaaaaaaaaaaaaaaggccaggcgcagtgactcacacctgtaatcccagcactttaggaggccaaggcgggtagataacttgaggtcaggagttcgagactagcctggccaacat

SEQ ID NO: 17010 - DNA, 201 bp, Homo sapiens
atttgctttaatattcttagtttgaaatttttaagccatcattacatttcacagtttcaaccaagctacaaacattacctaaattttcagtgtttagtttrcctctttttcacatcctctgtgttttcatgtctaaattatcttatttcctagactctcttgagcctgagggatccattacagtttcaatgggtattgact

SEQ ID NO: 17011 - DNA, 201 bp, Homo sapiens
acatttatttccttctcattttcagtacctatagagataatattagaaaacatgacatttctcaggaagatatgtatttctgaaacaaatgggtataatgygttcattggtgtatgcgcagaattaatttgtgaaaaagaaaaccttgaaacagaatagttaggttactttgtaatttgctttaatattcttagtttgaaa

SEQ ID NO: 17012 - DNA, 201 bp, Homo sapiens
atccctgccccccagcaaaaaaaaaaaaaatgagtatgtttgtaatattaatatatgcttggaggttacagaaaaatttcttttttttttcttttcttttytttttttttttttttgagacggagtctcgctctgtcgcccaggctggagtgcagtggcgcgatctcggctcactgcaagctccgcctcctgggttcacgc

SEQ ID NO: 17013 - DNA, 201 bp, Homo sapiens
tggcagatcgattgaactcaggagtttgagaccagcctagccaacatggtgaaaccccaactctttaaaagatacaaaaaattaggcggtcatggtggtgygcaccttaggtcccagctacttgtggggctgaagtgggaggatccaccaggaggtggaggttgcagtgagctcatatcacaccaccgcactccagcctgg

SEQ ID NO: 17014 - DNA, 201 bp, Homo sapiens
gattcagttatttacttgagaagaattgagcatggattttggtatagcaaatactgagttttaaattttcactctggctatgaataaatgattttttttttaacagatcaagaagttggtatatgtttacctggttcgatatgctgaagaacagcaggatcttgcactcctgtccataagcacttttcagcgagctctgaa

SEQ ID NO: 17015 - DNA, 201 bp, Homo sapiens
aaattgcttacccagtacatattaaatctcggcaagtatgatcaaaactacgacatcagagaccgtacaagatttattaggcagcttattgttccgaatgwaaagagtggagctttaagtaaatatgccaaaaaaatattcctagcacaaaagcctgcaccactgcttgagtctccttttaaaggtattatcagaatataa

SEQ ID NO: 17016 - DNA, 201 bp, Homo sapiens
gtattttatctagatgctggagaagtttggcgtaatatgacttgtataaacttaggaaacaaggttaaaaaagtaatcaaacattttctttttctttgtgktttttttttttttttttttgagacagagccttgcttcatcacccagacttgaggacagtggcactatctcaggtcactgcaacctccacttcctgggttc

SEQ ID NO: 17017 - DNA, 201 bp, Homo sapiens
gtttttatatttccagcaccaattccagctatctccaactttttcccctcatttcttgtgttctttgagtatataactttttttttaattttaaatttttwaaatttttgagacagagtctctttccagttgcccaggctggagtgcagtggcacaatcctgcctcactgcagcttcgacctcccaggctcaggtgactct

SEQ ID NO: 17018 - DNA, 201 bp, Homo sapiens
cacagggaggggaacatcacacaccagggcctgttgggggttgggggagtaggggagggctagcattaggagaaatacctaatatagatgacagggtgatkggtgtagcaaaaccaccttggcacgtgtatacctatgtaacaaacctgcacattctgcacatgtatcccagaacttaaagtattttaaaaaaaaaaagat

SEQ ID NO: 17019 - DNA, 201 bp, Homo sapiens
tagattttgtttttaaggttttgtggagccattcaacattgaagagtaattggaaaaaggttttttcatttcatttataactctacccgtatagtatagadggattgatatcaacttaaaatggttgtgtttaacatatttatcaatgatgaagatgtacaaagtttgtttgctcattaagttttcatttgtacttatgaa

SEQ ID NO: 17020 - DNA, 201 bp, Homo sapiens
aagacagtgcggcaattcctcaaggatccagaaccagaaataccatttgacccagcaatcccattactgggtatatacccaaaggattataaatcattctrctataaagacatatgtgcacgtatgtttattgcagcactatttacaataacaaagacttggaagtaacccaaatgtccatcaatgatagactggataaag

SEQ ID NO: 17021 - DNA, 201 bp, Homo sapiens
ttagtgccatcactacagttgtgttcaatagtagtggagatggtgggcattcttgccttgtttcagtctaaaggaaatgcttacattgtgtttgcattaaraaagatgctggccctgaagattttatctttgaaatatagtacttttgcaaggtacttcaggattacttgatatgggtcaattgttttgccttggtactca

SEQ ID NO: 17022 - DNA, 201 bp, Homo sapiens
atctgtgtaaaattggaatgtctgtttccaaaatacaccagaaagtaaaaaatattgaatacttgttcatcacaggtatttaatatttgttgaatgactgttgaattaatttgttacattcttggtgatagtaattaagtgtgtagtatcgtttttaatgtctccctcacccccctgcagtggtttcatgctcagtgttca

SEQ ID NO: 17023 - DNA, 201 bp, Homo sapiens
tatctgtgtaaaattggaatgtctgtttccaaaatacaccagaaagtaaaaaatattgaatacttgttcatcacaggtatttaatatttgttgaatgactgttgaattaatttgttacattcttggtgatagtaattaagtgtgtagtatcgtttttaatgtctccctcacccccctgcagtggtttcatgctcagtgttc

SEQ ID NO: 17024 - DNA, 201 bp, Homo sapiens
gaatcgctcgaacccgggaggcggaggttgcagtgagccaagattgtgccactgcgttccaggctgggcgacagagtgagatactgtcttaaaaaaaaaaattctgaaagaaattaggattgggtgacacagtggcccaggtgttaggagatggctgtagcaagggagaaggagtaaaatttgatgatgctttagatagaa

SEQ ID NO: 17025 - DNA, 201 bp, Homo sapiens
atattaatatagttattgtgctttcccttgattaatattagcatgctatgtatttttccatctttttacttttaacctgcctttatctttatgtttatggkgaatttcttataggcagcacatagttgagtcatgggttttaatctactttgccagcctttgtcttttaatcagcatactgatttacatttaatctaatta

SEQ ID NO: 17026 - DNA, 201 bp, Homo sapiens
tattaatatagttggattttaagctgtcattttacttgcttttatatgtttcatgccttttttgttccttatttctcctttattgctttttcttagattargtgaatatgttctagtgaacattttaattcttttcatggtttttttactatatatttttgaaaatattgtcttatacatggagattatacttgtagtttc

SEQ ID NO: 17027 - DNA, 201 bp, Homo sapiens
ttcatgttgccgtttcatagccaaaccgactttattccacatgtttaaccttactcccaacccttaacccctggcaactgctaatctttctgtttccatarttttgttatttcaagaatgttatataaatggaattatatggtatataaccttcattgtagattatccattttgtcattctataatgtccttctctgttgt

SEQ ID NO: 17028 - DNA, 201 bp, Homo sapiens
aagtcacttttaaacattttgcaagagtctcaggccacagcaggttgcagagattgtttcatcctggtgtaaatcttgagatggcactagcacccttcaggctgccttggaattcagaaggcaagtgggtatattcagtgtcttttatgtgactactctaaatgccaaggtaataaaggtgagaggtgacaggataaagaa

SEQ ID NO: 17029 - DNA, 201 bp, Homo sapiens
taatgtcttgcaaaactctaatacagtattacaaccaggatattgacattgatacagtcaaaactgagaacatttccatcacagggaatcttcatgttgcygtttcatagccaaaccgactttattccacatgtttaaccttactcccaacccttaacccctggcaactgctaatctttctgtttccataattttgttatt

SEQ ID NO: 17030 - DNA, 201 bp, Homo sapiens
tcctctcttccaccatatgaggtagctgtccacacaccaggaggagggccttcaccatgaattgaatcacctgccccttgatcttggacttttcagcccckagaactgtgagaaataaatgtctcttgtttcaggcacctaccctgtggtattttgttataacagcctgagttgactagtgcagtgtcttagattatgtgg

SEQ ID NO: 17031 - DNA, 201 bp, Homo sapiens
tctgaaaaaaggcaagttgagaaaaaaatctttaacctgtggctaagtggttaacatggtaagatcaaggaatagaggtgacctatgggggatgtgagttrctagtgtactagtatcttagatggggcttttgtacccactttatatttctcaaaactactgaggaaaaggattccagctcatcttaggatgctatcatca

SEQ ID NO: 17032 - DNA, 201 bp, Homo sapiens
tttcactgtgttagccaggatggtctcgatctcctgacctcatgatccacccgtctcggcctcccaaagtgctgggattacaggcatgagccaccgcgccyggtgtctttcatttcttagtttttgacaagctctatctatctcacataggatggtgataaaataagaaaatggatgtaaggtcatgatacagaccaccac

SEQ ID NO: 17033 - DNA, 201 bp, Homo sapiens
ttgatgagcttgcagcccggctcagtcgtggctgacagcactgattggggcgcagtacgctctctgctccttttattacagacagtaattaaagcagctckccctgccacttccataacaaacacagcataatgccctaattatgactttattaatttaagtcaggatttaatgattttaaaagtgatttatattgttttt

SEQ ID NO: 17034 - DNA, 201 bp, Homo sapiens
tataggcatgcactaccatgcttggctaattttttgtatttttaatagagaggggtttctccatgttgcccaggctggtctcgacctcctgggctcaagcsatccacccacctcagcctcccaaagtgctgggattacaggcatgggcaaccgtgcccagccacacacactaaattctaatcccagtggaatatttgtggt

SEQ ID NO: 17035 - DNA, 201 bp, Homo sapiens
tgggaggcggaggttccagtgagccaagatcacaccactgcactccagcctgggtgacagagtgatattccactacaaaaaaagaaaaaagaaagaaaaaragaatcagtcaagctgttagaggcatgaggggagggtatactaggcagaataaagttatggaggagggaaagagcttgctactaccagaaataatgattg

SEQ ID NO: 17036 - DNA, 201 bp, Homo sapiens
gactccttttaagcatccataactagcattgattgaagttgtttcagtgtaatgagttccccaaacaatacattatggttcaaaatgaagcagttgtgtamgagcctcataatacatttataaatcctcaagtatgaggcaacttctttctgagggataattttaggggggaaactttttttcatatttggcatctaggga

SEQ ID NO: 17037 - DNA, 201 bp, Homo sapiens
agctatttttcatatgtttcttggctgcatgtatatctttttttgagaagtgtctgttcataccatttgcccactttttaatggggttgttagtttcttgwaaatttgcttaagtttcttgtaggttctggatattagccctttgtcagatggacagattacaaaaatgttctcccattctgtaggttgtctgtttgctct

SEQ ID NO: 17038 - DNA, 201 bp, Homo sapiens
gggacactttgataggctattgctattgtgaactggactattaaaatgcttactttaaaagcttttcctgttgtacttattatcccacaaaatattatttktattttacaatctaacatgtgaccagattcagttatttacttgagaagaattgagcatggattttggtatagcaaatactgagttttaaattttcactct

SEQ ID NO: 17039 - DNA, 201 bp, Homo sapiens
tgtttatccagagttatcgataatcataaataactgtattctcatcttgatctgtttttttccaacagacaaaattgcttacccagtacatattaaatctyggcaagtatgatcaaaactacgacatcagagaccgtacaagatttattaggcagcttattgttccgaatgaaaagagtggagctttaagtaaatatgcca

SEQ ID NO: 17040 - DNA, 201 bp, Homo sapiens
atatctttttttgagaagtgtctgttcataccatttgcccactttttaatggggttgttagtttcttgtaaatttgcttaagtttcttgtaggttctggawattagccctttgtcagatggacagattacaaaaatgttctcccattctgtaggttgtctgtttgctctgatgatagttttgtttgcggtgcagaagctct

SEQ ID NO: 17041 - DNA, 201 bp, Homo sapiens
ttttacaatctaacatgtgaccagattcagttatttacttgagaagaattgagcatggattttggtatagcaaatactgagttttaaattttcactctggytatgaataaatgattttttttttaacagatcaagaagttggtatatgtttacctggttcgatatgctgaagaacagcaggatcttgcactcctgtccata

SEQ ID NO: 17042 - DNA, 201 bp, Homo sapiens
ctatatttattccttgacatttgaggtaatatgccaattaccttgagctctgattatgattgttctctgttatatacagctcatattgtttattttatatktttccctatttttaatagatagagatcatttccagcttggcaccttatctcatactctcaacattaaagctactgggtacctggaattatctaattggcc

SEQ ID NO: 17043 - DNA, 201 bp, Homo sapiens
tataggccgaaggataggaagaagcaaccccatttgtaatccacttgaatttgggcacccagagtggtacaaagaaaagccacaaagcaaatgtagcttcygcagtttttatcatttgtcctatcaggttccttatcaaaggaatatgggaaattggctagcaagtagtcttacggatttttgctattgtcgaaaattggc

SEQ ID NO: 17044 - DNA, 201 bp, Homo sapiens
gaagtcataagggagcaaaagatcggaagggacaccaaattgttatggttacctgagggggacttttcttttctttctttttttttttttttttttgagayggagtcttgctctatcaccaggctggagtacaatggtgcaatctcggctcactgtaacctccgcctcccaggttcaagtgattctcctgtctcagcctcc

SEQ ID NO: 17045 - DNA, 201 bp, Homo sapiens
ggtgcattgttaacaatataccaaagatctctgatgttacatggaatgttatagaccacagaggcttgttttattcgctcttttaggtaggctgctcttayactaagtaaatccagtgactgtatgatggtatttccccctgctgcaaatgttccttacacatctttaatttcgttttggctatagagaccctatgcaggt

SEQ ID NO: 17046 - DNA, 201 bp, Homo sapiens
catggcctagcttttctctgggaatctccatttggatcttgaagtcctgttgtaaatctgttcagcatggccccattcataatggctgataattctgtcttgacgaaatcattgttactaccaagattgtttgtgtgaagctcacctgttccttttaggccattctgttttcatcctcattttccttcctcttatggggcc

SEQ ID NO: 17047 - DNA, 201 bp, Homo sapiens
atagtctatctcatgtacacatatgcttgtattattagaaaattgagatttttttttcctgtttagggtagaatcttaagtgtctgatcctctcaactcasttatatgtgttttcctttcttccatctttgttcctgctcctcccttcgttgtctaattcttttccagagctattttattaagtaattttaaaaagtgtag

SEQ ID NO: 17048 - DNA, 201 bp, Homo sapiens
agaattataataacatttttttttttgagatggagtctcactctgtcgtccaggctgcagtgcaatggcgcggtctcggctcactgcaacctccgcctccygggttcaagcgattctcctgcctcagcctccggagtagctggggttacaggtgcctgccaccacgcctggctaatttttgtatttttagtagagatgggg

SEQ ID NO: 17049 - DNA, 201 bp, Homo sapiens
aaattgagatttttttttcctgtttagggtagaatcttaagtgtctgatcctctcaactcagttatatgtgttttcctttcttccatctttgttcctgctsctcccttcgttgtctaattcttttccagagctattttattaagtaattttaaaaagtgtagtgatttgaaatatagtgtgctataccatatctgtgtgat

SEQ ID NO: 17050 - DNA, 201 bp, Homo sapiens
tagaatcagaattataataacatttttttttttgagatggagtctcactctgtcgtccaggctgcagtgcaatggcgcggtctcggctcactgcaacctcygcctcccgggttcaagcgattctcctgcctcagcctccggagtagctggggttacaggtgcctgccaccacgcctggctaatttttgtatttttagtaga

SEQ ID NO: 17051 - DNA, 201 bp, Homo sapiens
tgtgctataccatatctgtgtgatattttagaaatgttatgcaatattatacaatgccctgatctctgtggaaaatttactgtccaaatagaattgtctayaacaatttggtattattttcagctatcatttattcctcaagctttttgagactctcttctgtttctggtgttgtattcacagtattgtgctatgtgtatt

SEQ ID NO: 17052 - DNA, 201 bp, Homo sapiens
acctcgtctctactaaaaatacaaaaattagccagtggtggcatcaggtgcctgtaatcccagctactcgggagactgaagcaggagaatcgctcgaaccygggaggcggaggttgcagtgagccaagattgtgccactgcgttccaggctgggcgacagagtgagatactgtcttaaaaaaaaaaattctgaaagaaatt

SEQ ID NO: 17053 - DNA, 201 bp, Homo sapiens
aggccttaagcttgcttttgaattcagttatgttgttaatgattaagtttgccagaactctaaatctctgaatgagaattcatttatatttactttatttrtttaaacaggcaaaagaatggaccccagcaggaaaagcaaagcaagagaattctgctaagaagttttattctgaatctgaggaagaggaggactcttctg

SEQ ID NO: 17054 - DNA, 201 bp, Homo sapiens
gtgcgggggcgggaatcccactcatccagactgcccggattcctcagagctagcgaggggaaggactaagtgcactgatccaccaagaccatggctgcccytccccagagtggctttgttccagggagatcagagttctgtccctaaacccctggctggagttgctgaaattcctgcagggaggcccagctcagtgaggag

SEQ ID NO: 17055 - DNA, 201 bp, Homo sapiens
catattcctatgttaactgccagacaaggttttatcatgcttctcactcaccttttctccttagaaacttatgggataagatccatgctcactctaacggyttaaaagtccttctatcattgggcaccagtatattccagcctcaatgcttgcctctccttgccttgagcttatagtctgttagtattctatctcaaatgt

SEQ ID NO: 17056 - DNA, 201 bp, Homo sapiens
tctttatgagttttaggctccagatttgtagggtttataatatctaatttatacatttgctgtttgtgtcgagagaaagaactattgtatataaaaccctyagcacagtgcctaacaccacatgggatgtgattaaaaattccaaataagaaataagtactcaaaaagatgtaaagatacaatatctgtgtaaaattggaa

SEQ ID NO: 17057 - DNA, 201 bp, Homo sapiens
agtagttgtattattgttttagtttgctacagttgccatgacaaaataccacagattgggtggcttaaacaacagaaatttattttctcacagttctgatrtctagaagtgcaagatctcaaggtgttggcaggtttggtttctcttgaggcctctgtcctttgcttacaggtggccatcttctcactgtgtccgcatatt

SEQ ID NO: 17058 - DNA, 201 bp, Homo sapiens
gccgggctggtcacaaactcctggcctcaagtaatctgccagccttggcctcccaaagtgccgggattacaggcagtagttcttcttaattcatgtccctyctttcttatatcatatataatctattttcagaataaatcccaaatctagcccattctcactgtgctcactatctttcctctgcataattgctgtagcctt

SEQ ID NO: 17059 - DNA, 201 bp, Homo sapiens
ctaagaagttttattctgaatctgaggaagaggaggactcttctgatagtagcagtgacagtggtgggttttataatttattggcatatattatttacatrgtagattacattctatatctcagaaacaaggcctaatccataatattcagcaggtagttttaagtgaagtttgtattatcaaaataatccctttcattta

SEQ ID NO: 17060 - DNA, 201 bp, Homo sapiens
tattttgcatttgctgaggagtgttttacttccgatgatgtgatcgattttagagtaagtgccatgtggcactgagaagaatgtatattctgttgttttgsggtggagagttctgtagatatccatcagatccacttgatccggagctgagttcaagttctgaattatcttcttaaattttgtgtctcgatgatctgtcta

SEQ ID NO: 17061 - DNA, 201 bp, Homo sapiens
ttaggaacattcttgcacaaatctttttatgtttttgtatatgttgggtcaatacctagatatagaattattggatcataaggtggatatattttggttcygcaagaacctgtcagtctttttcccaaagtagttgtattattgttttagtttgctacagttgccatgacaaaataccacagattgggtggcttaaacaac

SEQ ID NO: 17062 - DNA, 201 bp, Homo sapiens
ctaggacttccagtggtatgttgaataacagagatgacagtgggcaaccttgtcgtgttccagagcttataggaaagactttcagttttttcccattcagwatgatactagctgtgaggtttgtcatatatagtttttattatgttgatgtatgttccttctattcccagttttttgagggtttttatcatgaaaggatgt

SEQ ID NO: 17063 - DNA, 201 bp, Homo sapiens
agagaattctgctaagaagttttattctgaatctgaggaagaggaggactcttctgatagtagcagtgacagtggtgggttttataatttattggcatatrttatttacatagtagattacattctatatctcagaaacaaggcctaatccataatattcagcaggtagttttaagtgaagtttgtattatcaaaataatc

SEQ ID NO: 17064 - DNA, 201 bp, Homo sapiens
cgttttgtcaaagatcagatggttgtagatttatggtcttatttctgagttctccattttgttccattggtctatgtgtctgtttttgtaccagtaccagkctatttgggttactgtagccttgtagtatagtttgaagtcaggtagagtgataccgccagctttgttctttttgcttaggattgtcttggctatacgggc

SEQ ID NO: 17065 - DNA, 201 bp, Homo sapiens
aacacagaatatttttccattttttggtgtccttttcaatttccttcttcagtgttttatagttttcactatagagatagttcacttctttggttaagttwattcctgggtatttaattttgtgtgtggctagtgtaaatgggattacttttaaaatttctttttcaccttgttcactgttggcatatagaaatgctcctg

SEQ ID NO: 17066 - DNA, 201 bp, Homo sapiens
caaagtgctgggattgcaggtgtgagccacggtgcccaatcacatttaagtttttattccatcttgagttaatttttgtataaggtgtaaggaaggggtcyagtatcaattttctggatatggctagccagttttcccagcaccttttattaaatagggaatctttccctattgcttgtttttgtccgttttgtcaaagat

SEQ ID NO: 17067 - DNA, 201 bp, Homo sapiens
agagtctgaccttcctaggttaataggttctcaacgtggccgggcgcggtggctcacacctgtaatcccaacactttgggaggccgaggcaggtgggtcarctgaggtcaggagttcgagaccagcctggctaacatggtgaaaccccgtttctactaaaaatataaaaaattagcctggggtggtggcgtgtgcctgtaa

SEQ ID NO: 17068 - DNA, 201 bp, Homo sapiens
ccatagtggttgtactaatttatattcccaccaacagtgtgcaggggttcccttttctccacatcctcaccagcatttgttgttgcctgtctttcttttgrgtataagccattttaactggggtgagatgataactcattatagtttagatttgcatttctttgatgatcagtgatgttcagcatcttttaatatgcctgt

SEQ ID NO: 17069 - DNA, 201 bp, Homo sapiens
caggtgtggtggtgggtgcctgtaatcccagctgctcgggaggctgaggcaggagaattgcttgaacccaggaggcagaggttgcagcgagccaagatcaygccactgcactccagcttgggtggcagagtgagaccgcgtctcaaaaaacaacaacaaccggtggctcatgcctgtaatcccagcactttgggaggccga

SEQ ID NO: 17070 - DNA, 201 bp, Homo sapiens
caagccatccttctacctcagcctcctgagtagctgggactacagccacctgccaccacaccctaatttttatatttttgttggtagatatggctaatttrttggctaattttttaatttttgttggtagagctagggtttcaccatgttgcccaggctggtctcaaactcctgggctcaagtgagccaccacactcaacc

SEQ ID NO: 17071 - DNA, 201 bp, Homo sapiens
ttgtacatctcctaagacatacttctttccttatcgccaggacctcttctaggtgacatccgcatccttcatcaaggggaatccatgtccctaagtcacarttcacttaaatgcaaggcaacacagccagcttttagaggccacagtcccatctctgaaatatgtagaacagcttacggtttccctcatacaattttgtaa

SEQ ID NO: 17072 - DNA, 201 bp, Homo sapiens
aggcggaggttccagtgagccaagatcacaccactgcactccagcctgggtgacagagtgatattccactacaaaaaaagaaaaaagaaagaaaaaaagartcagtcaagctgttagaggcatgaggggagggtatactaggcagaataaagttatggaggagggaaagagcttgctactaccagaaataatgattgtctg

SEQ ID NO: 17073 - DNA, 201 bp, Homo sapiens
aagtcacaattcacttaaatgcaaggcaacacagccagcttttagaggccacagtcccatctctgaaatatgtagaacagcttacggtttccctcatacamttttgtaaggttcatggcctagcttttctctgggaatctccatttggatcttgaagtcctgttgtaaatctgttcagcatggccccattcataatggctg

SEQ ID NO: 17074 - DNA, 201 bp, Homo sapiens
tttctctgggaatctccatttggatcttgaagtcctgttgtaaatctgttcagcatggccccattcataatggctgataattctgtcttgacgaaatcatygttactaccaagattgtttgtgtgaagctcacctgttccttttaggccattctgttttcatcctcattttccttcctcttatggggcccattccatcttc

SEQ ID NO: 17075 - DNA, 201 bp, Homo sapiens
gaacgcatggagtggcttgtatgctctgctaagtagtatggaccttgtcctgcagaggaaagggaaaccacttttaatagtagtataatttaccagatttkcagtttagaatattcattttttaagtccattgactttttgagcagctgttaataagaggaatcatttttgcttccatgtacgaaatagggacttttccta

SEQ ID NO: 17076 - DNA, 201 bp, Homo sapiens
caccattgagcactaagtgaaccagacactgtctgcaatcccggcacctctggaggccaaggctggcggatcactcgcggttaggagctggagatcagccyggccaacacagcgaaaccccgtctccaccaaaaaaatacgaaaaccagccaggcatggcggcgcgcgcctgccatcgcaggcactcggcaggctgaggca

SEQ ID NO: 17077 - DNA, 201 bp, Homo sapiens
tcttgatctgttcaattctaataacttcacctccactgaacttcagtttttcgtcctttcaattctgaaatcttaactcactcccttacttgtgcctatcmtgctcctcaggcccttcatgcctccagctgtttatgtttagcctagattaaaacaaccctgaaagataggtgctagtgtccccatttcacagacttgaaa

SEQ ID NO: 17078 - DNA, 201 bp, Homo sapiens
tttttccaacagacaaaattgcttacccagtacatattaaatctcggcaagtatgatcaaaactacgacatcagagaccgtacaagatttattaggcagcktattgttccgaatgaaaagagtggagctttaagtaaatatgccaaaaaaatattcctagcacaaaagcctgcaccactgcttgagtctccttttaaaggt

SEQ ID NO: 17079 - DNA, 201 bp, Homo sapiens
aggccaaggcaggtggctgggaggtggaggttgtagcgagccaagatcatgccactgcactccagcctgggcaccattgagcactaagtgaaccagacacygtctgcaatcccggcacctctggaggccaaggctggcggatcactcgcggttaggagctggagatcagcccggccaacacagcgaaaccccgtctccacc

SEQ ID NO: 17080 - DNA, 201 bp, Homo sapiens
aacaaccctgaaagataggtgctagtgtccccatttcacagacttgaaaattgagatcccttcagcttcagtaacttttctggtgttacaaggctagtaaracatgtgctatgtataaaaccaatttcagctcaaatctgtatagtttcaaagccctgtgtttcccaccacacctcactgctgagtgtatgaaggagttac

SEQ ID NO: 17081 - DNA, 201 bp, Homo sapiens
tcctcacttcctagacggggtggcggccgggcagaggctgcactctggacgctttgggaggccaaggcaggtggctgggaggtggaggttgtagcgagccragatcatgccactgcactccagcctgggcaccattgagcactaagtgaaccagacactgtctgcaatcccggcacctctggaggccaaggctggcggatc

SEQ ID NO: 17082 - DNA, 201 bp, Homo sapiens
cagtaacttttctggtgttacaaggctagtaaaacatgtgctatgtataaaaccaatttcagctcaaatctgtatagtttcaaagccctgtgtttcccacsacacctcactgctgagtgtatgaaggagttacaactccaagagaattattttgtgtagcagcttgtggtacagctcagagtaaaacgaacctaatgacgg

SEQ ID NO: 17083 - DNA, 201 bp, Homo sapiens
ccagacgatgggcggccaggcagagacgctcctcacttcctagacggggtggcggccgggcagaggctgcactctggacgctttgggaggccaaggcaggyggctgggaggtggaggttgtagcgagccaagatcatgccactgcactccagcctgggcaccattgagcactaagtgaaccagacactgtctgcaatcccg

SEQ ID NO: 17084 - DNA, 201 bp, Homo sapiens
tctagaccatcggtttttgctgtatgaatattttctaagatattctcttcgaaatcaattttaatgagatttcctatgtgtttattttttgataactgacraaaattcataaatacaggattaattcctagatatacattaaattaattaatagctgtaaaacttttgtaatagttaaaaccttttctatgttaatattag

SEQ ID NO: 17085 - DNA, 201 bp, Homo sapiens
gggcagctagactggcttctagaatttgttcgtctctgatagaatctagattctagaccatcggtttttgctgtatgaatattttctaagatattctcttygaaatcaattttaatgagatttcctatgtgtttattttttgataactgacgaaaattcataaatacaggattaattcctagatatacattaaattaatta

SEQ ID NO: 17086 - DNA, 201 bp, Homo sapiens
ctggagtgtagtggcactacctcggctcactgcaacctccaccttctgggttcgagcagttctcctgcctcagcctcctgagtagctgggactaccatcaygcccagctaattttttgtatttttttttagtagaggcgggtttcactgtgttagccaggatgatcttgatttcctgacctcgtgatccacccacctcggc

SEQ ID NO: 17087 - DNA, 201 bp, Homo sapiens
aatatttttacaatttagttaatattcttatatgagatctgctcagggattttttattcccttcaagaggaagggacactttgataggctattgctattgkgaactggactattaaaatgcttactttaaaagcttttcctgttgtacttattatcccacaaaatattatttttattttacaatctaacatgtgaccagat

SEQ ID NO: 17088 - DNA, 201 bp, Homo sapiens
atttcaaaatttactattatgtgtagtgattctgaagatggggagaaggaaaatgaaaaatctaaaacttcagattcttcaaatgacgaatctagttcaawagaagacagttcttccgattctgaatcagagtcagaacctgaaagtgaatctgaatccagaagagtcactaaggtaagagattatacatttgttgtaatt

SEQ ID NO: 17089 - DNA, 201 bp, Homo sapiens
cttgaacccaggagttccagaccagcctgggcaacatagtgagaccttgtctctataaatgaaaatgggaagaaaaaacaaaaaacactgggcccagagtyagaagacctggatttaagttgatgttttccatttgtagtagtgcttccttgttcaagttgctgatctcttcaaacctcagtttcctcatttctagacggg

SEQ ID NO: 17090 - DNA, 201 bp, Homo sapiens
tatctaatttatacatttgctgtttgtgtcgagagaaagaactattgtatataaaacccttagcacagtgcctaacaccacatgggatgtgattaaaaatyccaaataagaaataagtactcaaaaagatgtaaagatacaatatctgtgtaaaattggaatgtctgtttccaaaatacaccagaaagtaaaaaatattga

SEQ ID NO: 17091 - DNA, 201 bp, Homo sapiens
tacctcattaatgtattctggaatttaaaaacaatttttttataaactgcttatataaaggagttaaagttcatatttcaaaatttactattatgtgtagygattctgaagatggggagaaggaaaatgaaaaatctaaaacttcagattcttcaaatgacgaatctagttcaatagaagacagttcttccgattctgaat

SEQ ID NO: 17092 - DNA, 201 bp, Homo sapiens
cctcatttctagacgggatgtgataatacttgcctcttttgtgaggatctcatgagatggtgtacttcaaagtgatttctaaactaggatattaactaacsctatttgggaaagttggtgaagacttcactgaggtagtgacactttagatcttaaagcctgaggtttttgccagggggaggaaagatggattctttaggc

SEQ ID NO: 17093 - DNA, 201 bp, Homo sapiens
tttcctagttttagttggcagattttataatgcatgtctctatcagtgaactagtatgatataaaattcttatttggaaattctccatatttgtttttggsaagtatgtatgcatagtaaaataatgactgctatctagttatttttttcctcccagttgaaaagagtttgtggtttatctacttacagtcgctttcttga

SEQ ID NO: 17094 - DNA, 201 bp, Homo sapiens
ttatgaatagtaggtagtaaagtatgggaatggatgaaatcacccagggaagacttttcttgttagacgagaaggcagtttggacaaaacccaggggacamcaggatataaagtatgaatggaagaactagaaaaagagactgagctcagaagggtgggaaaacacaggaaggtttaaaaaagaagatgctaacaggaaaa

SEQ ID NO: 17095 - DNA, 201 bp, Homo sapiens
catcttagacattgtttactcatttgagaaatggagagagggacaaatactgtttcgttcatttttaaataaggaatgaaaattaaaacaactagatgatrtggagtgttcagtgataaaaataattactttgaagaataaaattagtgcctttttaagtgtattaataatgtatattattatgtggtccttgaagtttct

SEQ ID NO: 17096 - DNA, 201 bp, Homo sapiens
aggatagaattgaatttgaatgggttctaatttatttggttatgggtaataccttttttattacctcattaatgtattctggaatttaaaaacaatttttktataaactgcttatataaaggagttaaagttcatatttcaaaatttactattatgtgtagtgattctgaagatggggagaaggaaaatgaaaaatctaaa

SEQ ID NO: 17097 - DNA, 201 bp, Homo sapiens
tatattccagcctcaatgcttgcctctccttgccttgagcttatagtctgttagtattctatctcaaatgttttaagcttattactacctcttatttttcytagttttagttggcagattttataatgcatgtctctatcagtgaactagtatgatataaaattcttatttggaaattctccatatttgtttttgggaagt

SEQ ID NO: 17098 - DNA, 201 bp, Homo sapiens
tagaaatgcagctgagtgagattcatttacttagagggatgttattgaatatactttcttaaaaatacaattttattaatagtaacgcattatatttgacmtacctcaaagagtcattgtgtctcactatgggttctaaacttgtttgtgtttaagtccattttttattaatacttaattttatctagtgtctgtaccata

SEQ ID NO: 17099 - DNA, 201 bp, Homo sapiens
tatctcattgtgtattttcagtttatgtagttgctcagtgaatatttcttaaatatttatatagataaatcgttcacacattctgctcatattaaagactrtgatttgtgtgaaggtgcctagcaaagtgtttggctcataattttgcttaataaaatattttcagatccttttactcaattcagtgatttagattccatt

SEQ ID NO: 17100 - DNA, 201 bp, Homo sapiens
aatattttcagatccttttactcaattcagtgatttagattccattaacatttgctctctcattagccaatgttgttaaaaaatgaagcatgactgattcygtggaccctatacagaaggaaaccctcatctggtatctccattgtattgtagtacagcatcaccctgaagctaattttgtgtagttcacttgggtctttg

SEQ ID NO: 17101 - DNA, 201 bp, Homo sapiens
aactcaagaagtatgttaaatgtgttaattaaatttaactgaaaaaattataaataaggaacatggggaatatggttctattttcattctaaagatatacgtaactgaaaagtgtacagtattaaataaaagtggttctaacagagtattacattttagattaatattttttaaaacaaaagttttatttctaatatgcaa

SEQ ID NO: 17102 - DNA, 201 bp, Homo sapiens
gggttccatttatgatttaattcttgaaatatatttcaaattaaataagattttactacattgaatagaaatttgatgaaatactgcctgtaaacagagtsttactttccaacagattataaaaccttttatcttattttgctttgcttgcatatctccttgaaggagagttggttctgacttctacattttgtcttaata

SEQ ID NO: 17103 - DNA, 201 bp, Homo sapiens
taaaaccttaactatatttgatcactaaatatgttcattttaaaagtaaagtagaatactttttagtaaaatagtaaagtagaatatgattgtattgacarttagcatattcagtttatatttgctttttcttgttaaactgaatttatcatataagataaatacatttctttgctcttagtgaatcaggtcccagtaata

SEQ ID NO: 17104 - DNA, 201 bp, Homo sapiens
ggcatggtagctggacaaatgagagaagaatgaataaggccctgtctcagtttgttttatgctgctataacaaaaaacctgagactgggtaatttctaaakaatataattttatttctcacatttttggaggccaggaagtccaagattgagtcacaggcaggtttagtttcctggtgagggctgctctttgcttctaaga

SEQ ID NO: 17105 - DNA, 201 bp, Homo sapiens
acttcctataggcatgaaaatgcatgtttttaatccaataggtaaatattaattctcatttaaaaccttaactatatttgatcactaaatatgttcatttwaaaagtaaagtagaatactttttagtaaaatagtaaagtagaatatgattgtattgacaattagcatattcagtttatatttgctttttcttgttaaact

SEQ ID NO: 17106 - DNA, 201 bp, Homo sapiens
atgtatttgttatactactctagtaagagcttagcttatttccacaaaagatacctagaaatctctcactaacggaaaagcctaaatcagaataaaaatcygtttcctcagattttatcaatgcaaaattctggaaggtaaaatgcaagtaaatttaaggggtgtgtgtgtgtgtgtgtgtgtgtgtgtgttacaccagct

SEQ ID NO: 17107 - DNA, 201 bp, Homo sapiens
ctcacatttttggaggccaggaagtccaagattgagtcacaggcaggtttagtttcctggtgagggctgctctttgcttctaagatggtccgttgttgccrcatcctctggaggggagtaatgctgtgtccttactgggcagaaggtggaagggcaagagaatggaagactgtgaagcctcttttgcaagggccttaatct

SEQ ID NO: 17108 - DNA, 201 bp, Homo sapiens
ctgcaggaatgcaagcagaaaccatggaaagaaattttaataagccaactggaaaaattacaattgatctatgatgcttaaaatttttgtcaaaacaggaraattagctgagtcaggtggtatactgttttgagttaatgactgtaataaatagttttgtataaatctttccagacggactgtttatcccttgttctttcc

SEQ ID NO: 17109 - DNA, 201 bp, Homo sapiens
attaaaaaaacctgcctgtaataccgaattcatttaaatccagcagttttctctcagatactaagagaaaatgtgaaaaataatactgtgatgctttatayttaatggcttatcatttttgctgtactttcttttcttctttgttttccttttttgggatagagtctgtctctgtcacccaggctggggtgcagtggtgcg

SEQ ID NO: 17110 - DNA, 201 bp, Homo sapiens
agcagaggcattcctgagagtttacctctcttttttatccttttaccatcaacacttgaatgtgttgtttcatggaatcatccaagtagaaatgtcttcaytctagccctccattcccttttacctacaggcagaagtcacttacataaatgctatataagcaccattttatgatgaattaagggccattttaccttgaag

SEQ ID NO: 17111 - DNA, 201 bp, Homo sapiens
atgattttgttttactgagaaactttggagtgagcagtgtagccatttatagtcttcagtgctttctgatctaggcttgatgttgcttccaactttttagygactacacatggtagttttagctttagaagttggcagacgaggccgggcgcggtggctcacgcctgtaatcccagcactttgggaggctgaggcgggctt

SEQ ID NO: 17112 - DNA, 201 bp, Homo sapiens
gtacatgttcccttctcgtaacctcttggttgacgccttagaggcaattattggtaactgtttaatttcagttactctggtggttataaattttactttgrataaaacattttgctttatttattaatttaagttgatatcagttgacctcaattcaaggaaaaattattcatcgattgtgtaagtgctatttgagggtct

SEQ ID NO: 17113 - DNA, 201 bp, Homo sapiens
aatattggacaaatttatccctgtttcttttgttgaccaaataatagactgggattcatgattttataagcagaccttgatgatcttatcagtttgatatrtttccagtgttgtagatgctaatacataaagagcaaaaacagttttgatttggaatcatagtacctaattgatctgtttctttttctgtattatctgtgg

SEQ ID NO: 17114 - DNA, 201 bp, Homo sapiens
aattttaatacttctttatccacaagacagtaatactgattttcatctcacttttaatattaacaaaatgatgattatgttatccatcttaaaaattgaartatgttttgaattattaatatgtaagtcttatgttacataatgctcttaaattgatgaaattttactatccttgtcaactttaattttataaagttaatt

SEQ ID NO: 17115 - DNA, 201 bp, Homo sapiens
tttttggctttgaggaccatatggtcttcactgtaactatttctgccattatagcacaaaagcagcaacagataatggagaaacaaataggtatgggcagstagactggcttctagaatttgttcgtctctgatagaatctagattctagaccatcggtttttgctgtatgaatattttctaagatattctcttcgaaatc

SEQ ID NO: 17116 - DNA, 201 bp, Homo sapiens
tattagaactattaaaattattctttgacgaatagtcaccataaagtttgttattcaaacatgaacattcattttaattgaatgactgaatactttaataytgattggcatgaaactgattactataatgcctgagtaagacctttgatgtaggggagaaacattttttaataagttactatttctttcttttctagttgg

SEQ ID NO: 17117 - DNA, 201 bp, Homo sapiens
gtgggagtgacccgattttccaggtgccgtctgtcacccctttctttgactaggaaagggaactccctgaccccttgcgcttcctgagtgaggcaatgccwcatcctgctccggcttgcgcacagtgcgctgcacccactgtctggcactctctagtgagatgaacctggtggtacctcagatggaaatgcagaaatcacc

SEQ ID NO: 17118 - DNA, 201 bp, Homo sapiens
gtacaatggtctgaaagtttatatcccccaaagttcatgtggtgaaacctgatcacccatgtgatggtattaggaggtaggacctttgggaggtgattagrtcataagggtggagcctttataaatgaactttatgctcttagaaaagagatccctgagagctagcttgctgcttctgccatgtgaggacacagtgagaag

SEQ ID NO: 17119 - DNA, 201 bp, Homo sapiens
gtgttgaaatttaacctggtgaaataaacacatcagaatttacttctcttcagaatagtattttctagacatattagaactattaaaattattctttgacraatagtcaccataaagtttgttattcaaacatgaacattcattttaattgaatgactgaatactttaatactgattggcatgaaactgattactataatg

SEQ ID NO: 17120 - DNA, 201 bp, Homo sapiens
tcgtcaacgtcattctccgtccagctttgttctgttgctggtgaggagctgcgttcctttggaggaggagaggcactctgctttttagagtttccagtttytctgctctgttttttccccatctttgtggttttatctacttttgatctttgatgatggtgatgtacagatgggtttttggtgtggatgtcctttctgttt

SEQ ID NO: 17121 - DNA, 201 bp, Homo sapiens
tcgtctaatttttttttaaagtttttaacttatttgccattggtttgtatttcctcctgtagcttggagtagtttgatcatctgaagccttcttctctcarctcgtcaacgtcattctccgtccagctttgttctgttgctggtgaggagctgcgttcctttggaggaggagaggcactctgctttttagagtttccagtt

SEQ ID NO: 17122 - DNA, 201 bp, Homo sapiens
aacatattatgttcgtttcacctgtccaattcaacagagacaaattaatttctttttcattttgctgattatatttatgaaattaataattggtaacttasagagaatcattataactgattgaacatggtttgataaaactgtcactgtctgttgatgccatgcagaaaacagcttcagtctattggactctgagacaat

SEQ ID NO: 17123 - DNA, 201 bp, Homo sapiens
gtatttcctgaatccgaatgttggcctttcttgctagattggggaagttctcctggataatatcctgcagagtgttttcccacttggttccattctacccrtcactttcaggtacaccaatgagacgtagatttggtcttttcacatagtcccacatttcttggaggctttgttcgtttctttttgttcttttttctctaa

SEQ ID NO: 17124 - DNA, 201 bp, Homo sapiens
ctctcctctggcttgtagagtttctgccaagagatcagctgttagtctgatgggcttccctttgtaggtaacccgacctttctctctggctgcccttaacrttttttccttcatttcaagtttggtgaatctgacaattatgtgtcttggagttgctcttctcaaggagtatctttgtggcgttctctgtatttcctgaat

SEQ ID NO: 17125 - DNA, 201 bp, Homo sapiens
tcagcatttgcttgtctgtaaagtattttatttctccttcacttaggaagcttagtttggctggatatgaaattctgggttgaaaattcttttctttaagmatgtggaatattggcccccactctcctctggcttgtagagtttctgccaagagatcagctgttagtctgatgggcttccctttgtaggtaacccgacctt

SEQ ID NO: 17126 - DNA, 201 bp, Homo sapiens
ttagtgcttcctttaggagctcttttagggcaggccgggtggtgacaaaactctctcagcatttgcttgtctgtaaagtattttatttctccttcacttakgaagcttagtttggctggatatgaaattctgggttgaaaattcttttctttaagcatgtggaatattggcccccactctcctctggcttgtagagtttct

SEQ ID NO: 17127 - DNA, 201 bp, Homo sapiens
gtgtcttttaattggagcatttagcccatttacatttaaagttaatattgttatgtgtgaatttggtcctgtcattatgatgttagctggttattttgctygttagttgatgcagtttcttcctagccttgatggtctttacattttggcatgttttttgcagtggctggtactggttgttcttttccatatttagtgctt

SEQ ID NO: 17128 - DNA, 201 bp, Homo sapiens
gatgggtcttgactctttatccaatttgccagtctgtgtcttttaattggagcatttagcccatttacatttaaagttaatattgttatgtgtgaatttgrtcctgtcattatgatgttagctggttattttgctcgttagttgatgcagtttcttcctagccttgatggtctttacattttggcatgttttttgcagtgg

SEQ ID NO: 17129 - DNA, 201 bp, Homo sapiens
aaagtctgttttatctgagactaggattgcaacccctgcctttttttgttttccatttgcttggtagatcttcctccatccctttattttgagtttatgtrtgactctccacgtgagatgggtttcctgaatacaacacactgatgggtcttgactctttatccaatttgccagtctgtgtcttttaattggagcatttag

SEQ ID NO: 17130 - DNA, 201 bp, Homo sapiens
cacagtttcaaccaagctacaaacattacctaaattttcagtgtttagtttgcctctttttcacatcctctgtgttttcatgtctaaattatcttatttcytagactctcttgagcctgagggatccattacagtttcaatgggtattgacttttgtgattctactcagactgccagtttccagttgtggtaagttcaatt

SEQ ID NO: 17131 - DNA, 201 bp, Homo sapiens
ttttcatgtctaaattatcttatttcctagactctcttgagcctgagggatccattacagtttcaatgggtattgacttttgtgattctactcagactgcyagtttccagttgtggtaagttcaattgttcttctattttttatataacctgtaaaggatagcagatcaaaaactaagctttcaacagcttttgtgtgtgt

SEQ ID NO: 17132 - DNA, 201 bp, Homo sapiens
gtttagattcaggttatgtatccttggctgggatactaccataggtgatgcatgcttcttgaactattacatttggaggcataggttgtccatcttcatgrtgttaattttcctagtcacagggttgtccagtttctctgtggtgtcatttctgttttttttttttttttttttcaaattatctgtggggagacactgaga

SEQ ID NO: 17133 - DNA, 201 bp, Homo sapiens
aaggtctctcttttttctcttccaggtttgcagctaaaactgtgcacagtgggtcattgatgctagtcacagtggaactgaaggaaggctctacagcccarcttatcataaacactgagaaaactgtgattggctctgttctgctgcgggaactgaagcctgtcctgtctcaggggtaacctgcttacatctggactttag

SEQ ID NO: 17134 - DNA, 201 bp, Homo sapiens
gggggggttttgctgaaggggaagtgaaaggaagtcacaaaaatagtattgagcaaagaattataagtgtacatacatcataagaaattgagactattcaytttttaaaaatattgggcattttgcataatagagtgtgttttaaggcttcaattaaagagtatacattctttagttagtaagaatttgcgtagccattta

SEQ ID NO: 17135 - DNA, 201 bp, Homo sapiens; identical to SEQ ID NO: 2844

SEQ ID NO: 17136 - DNA, 201 bp, Homo sapiens
gttacaggtgtccgtgtgtctaattaaatgactataaatctaagaacatctggttctgtttttcagagagtgaatctggaagtgaaagtggagaacaaggygaaagtggggaggaaggagacagcaatgaggacagcagtgaggactcctccagtgagcaggacagtgagagtggacgggagtcaggcctagaaaacaaaa

SEQ ID NO: 17137 - DNA, 201 bp, Homo sapiens
cacacctcaaatttggaagcgcactcatggttatgctttcacatagtcttttaaggcttgtattaaatagaatgtttttctaatttaagtttacattttaygaagcatattgcatttgaattgaattatacatatttagtatgaataatttctatctttttcagaaatagttgttgctgaaagtgtggttgttataaagaa

SEQ ID NO: 17138 - DNA, 201 bp, Homo sapiens
attttcactctggctatgaataaatgattttttttttaacagatcaagaagttggtatatgtttacctggttcgatatgctgaagaacagcaggatcttgyactcctgtccataagcacttttcagcgagctctgaaggtaaataatggagtgagtaggcaaatagctacaaggtttctgcagagttgaaagtgtgtcagt

SEQ ID NO: 17139 - DNA, 201 bp, Homo sapiens
ttttcactctggctatgaataaatgattttttttttaacagatcaagaagttggtatatgtttacctggttcgatatgctgaagaacagcaggatcttgcmctcctgtccataagcacttttcagcgagctctgaaggtaaataatggagtgagtaggcaaatagctacaaggtttctgcagagttgaaagtgtgtcagtt

SEQ ID NO: 17140 - DNA, 201 bp, Homo sapiens
attttagtagaaactttagttttggtctgtgattgagaaaatttaatgtaaaaaatagtatagattagaaagataaactttgactcaattatatttaacgycctactctttgttggcctttagttgtttgtaatgcacttaatactgttttctttttaaaagatttacaaattttttctgaatatctaaccaaactgtgaa

SEQ ID NO: 17141 - DNA, 201 bp, Homo sapiens
agataaactttgactcaattatatttaacgccctactctttgttggcctttagttgtttgtaatgcacttaatactgttttctttttaaaagatttacaawttttttctgaatatctaaccaaactgtgaacagttcaggcttaggggcactgtattctagttcatggatatatacattttgtaagtacagtagaccgaat

SEQ ID NO: 17142 - DNA, 201 bp, Homo sapiens
gtacacaaaattcattttaaaatcttttgctttagtaatttatacttgtttgctaaatagtcatccataccttataacttctacattgtgaaatgtggatyatggggattgacacatgtaacttaaggaggtagaggattaaggaatgtaaataaaaatggaaaggacatcaccatcttccacttggcacaatttcagtag

SEQ ID NO: 17143 - DNA, 201 bp, Homo sapiens
taaatagtcatccataccttataacttctacattgtgaaatgtggattatggggattgacacatgtaacttaaggaggtagaggattaaggaatgtaaatmaaaatggaaaggacatcaccatcttccacttggcacaatttcagtaggaatggaaatgggttacaaagcctttggaggccagtttggctatacctctcag

SEQ ID NO: 17144 - DNA, 201 bp, Homo sapiens
gaatacgttagactgggtaatttataaacagcagaaattagttgttcgtagttctggaggctgggaagtccaagatcaaggtgccagcgtatttgatgatwggtgagggctagctctgcttcagagatagtgacttctgtttcctcatgtgacagaaggaggaaacaccatccctcataccacttttataagggcaataat

SEQ ID NO: 17145 - DNA, 201 bp, Homo sapiens
gctcactgctattcctagtgtacagagtggctcctggcagttagtgggcacccagtaaatattgcttgaattaataaaacatataagggcatatacaaaartttcattgcagcattgttcagtggttagctctggcctccttgtgatgtaggactaacctgggaacagacaagaataagactttcattttatattttgtat

SEQ ID NO: 17146 - DNA, 201 bp, Homo sapiens
gaaaaacagataaactggcaattagattgccgcattatagatgaaatgaggagaaatgcacaaaatactgttcagtatcaaggttcctaatccacctagcrgtatcaaaatttaacttttgagttgagtttaagaaagcatcagttggccaggcctggtggctcacacttgtaataccagcactttgggaggccgaggcgg

SEQ ID NO: 17147 - DNA, 201 bp, Homo sapiens
ccggtggattaagatgtatatgatttgaaagtgttcttctattaaaatttatgaatttctcatatactttttaacataagttcattttagaatgattgtcsttctcattttaaactgacacaatgtgagctttgttattgtcttgattctttttctgaatattatgaacaaagtactgaatttttagattagaatttaggt

SEQ ID NO: 17148 - DNA, 201 bp, Homo sapiens
atatcaatatgctttctatgtttcaggcatattttatattcctggaaattaaacaatatattttaggaccccataccatgtgctctcagtaggacgatcayaaatcagtgatcatattctagtgttcttttataggaaatgtaaacctatgtcattacattgttagtacaactgacagtgaaatatttaaaaaatctctgt

SEQ ID NO: 17149 - DNA, 201 bp, Homo sapiens
ttgtctataaaattgggatggtacaaatacttttgggagtcatttaattctcaaaggatgaaatgacttgatatacgtaaaagcatttagaactgtgcctracacatgataggcattactgggtttagtgatgatgctggtgctgatgatgccaatgatgcagatgatgcagcaaattacaaattaaataacaacatatta

SEQ ID NO: 17150 - DNA, 201 bp, Homo sapiens
ccaaacaccccaggttaacattctgacatatcagtttagattctcttcatatgcaaatccccccttccaaattggattctactgagaaactgttttatcayttgctttctcctctgtttaaagtacatgttcttagttggtgtggtggctcatgtctataatctagcactttggaggccaaggcgggaggattgcttaagc

SEQ ID NO: 17151 - DNA, 201 bp, Homo sapiens
gggtgctcctgtattgggtgcatatatatttaggatagttagctcttcttgttgaattgatccctttaccattatgtaatggccttctttgtctcttttgrtctttgttggtttaaagtctgttttatctgagactaggattgcaacccctgcctttttttgttttccatttgcttggtagatcttcctccatccctttat

SEQ ID NO: 17152 - DNA, 201 bp, Homo sapiens
ggacttgctttatgaatctgggtgctcctgtattgggtgcatatatatttaggatagttagctcttcttgttgaattgatccctttaccattatgtaatgrccttctttgtctcttttgatctttgttggtttaaagtctgttttatctgagactaggattgcaacccctgcctttttttgttttccatttgcttggtaga

SEQ ID NO: 17153 - DNA, 201 bp, Homo sapiens
tgtcaattttggatctttcctgctttctcttgtgggcattcagtgctataaatttccctctacacactgctttgaatgtgtcccagagattctggtatgtkgtgtctttgttctcgttggtttcaaagaacatctttatttctgccctcattttgttatgtacccagtagtcattcaggagcaggttgttcagtttccatg

SEQ ID NO: 17154 - DNA, 201 bp, Homo sapiens
agtttgtatttctgtgggatcagtggtgatatcccttttatcattttttattgcatctatttgattcttctctcttttcttctttattagtcttgctagcrgtctatcaattttgttgatcttttcaaaaaagcagctcctggattcattgatttttttgaagggttttttctgtctctatttccttcagttctgctctga

SEQ ID NO: 17155 - DNA, 201 bp, Homo sapiens
tgatcaatctcctgaacctgtcttttccacaatggctgcaaaatggtaatgtttcagctgcaactccctctgctgttctgctctttggcttcttggcctaragctctgtgttcactgatccttcactaaccatctcaatgatgcctaggtacttcctagtcatagtattatcggcaatttttgttttctgaatttaatctt

SEQ ID NO: 17156 - DNA, 201 bp, Homo sapiens
tgttttggtaccagtaccatgctgttttggttactgtagacttgtagtatagtttgaagtcagatggcatgatgcctccagctttgttcttttggcttagrattgacttggcgatgcggactctttcttggttccatatgaactttaaagtagttttttccaattctgtgaagaaagtcattggtagcttgatggggatgg

SEQ ID NO: 17157 - DNA, 201 bp, Homo sapiens
gatttgcatttctctgatggtcagtgatgacgagcattttttcatgtgttttttggctgcataaatgtcttcttttgagaagtgtctgttcacatccttcrcccactttttgatggggttgtttgtttttttcttgtaaatttgtttgagttcattgtagattctggatattagccctttgtcagatgagtaggttgcaaa

SEQ ID NO: 17158 - DNA, 201 bp, Homo sapiens
ttatttatcaatattatttatcttctcctctcttcaaacagaagcagaattagatggctttatgaaagtagatcctatacctaatttattggctaaaaagkcctgtgtattagattattggcttcaagattttcaatttctttatttaaaatgtaaagaacttatttttgtactcttattttttattttttgagacatgtc

SEQ ID NO: 17159 - DNA, 201 bp, Homo sapiens
ctccagcacctgttgtttcctgactttttaatgattgccattctaactggtgtgagatggtatctcattgtggttttgatttgcatttctctgatggtcaktgatgacgagcattttttcatgtgttttttggctgcataaatgtcttcttttgagaagtgtctgttcacatccttcgcccactttttgatggggttgttt

SEQ ID NO: 17160 - DNA, 201 bp, Homo sapiens
ccaagtctttgctattgtgaatagtgccgcaataaacatacatgtgcctgtgtctttatagcagcatgatttataatcctttgggtatatacccagtaatsggatggctgggtcaaatggtatttctagttctagatccctgaggaatcgccacactgacttccacaatggttgaactagtttacagtcccaccaacagtg

SEQ ID NO: 17161 - DNA, 201 bp, Homo sapiens
agagatggggtcttgccatgttgcccaggctagtcttgaactcctaggctcaagcaatccgcctgcctcatcctcccaaggtgctggaattggaggcgtgyaccactgtgcttggccccttccttctttttaaaatattctcaacttttattttctgtttttttctaagttgtttttcttcatttaaaaaaaaacttcttt

SEQ ID NO: 17162 - DNA, 201 bp, Homo sapiens
gtagtaatatgtaaaaatatgagaagcaattacatgtctatccctccttgcagctgagtttgttgatttttactcaaatctgcatactcttaagtactctycaaaagagttgccttatttgtgcaattttttttttttttttttttttttgagacagagtcttgctctgtcacccaggctgcagtgcaggggcatgatctt

SEQ ID NO: 17163 - DNA, 201 bp, Homo sapiens
agttaataatatgttataaacacgacatgttagcggtgagttagtcaatgatgtggaaaggatataacttccaatcccatatctcatacctcccattcatstgtaactacaaagaacaagttcttatgtatcctttcagaaattttttaaaaaaattaaacgatcatatatatactattctctatgtatcttgctttccac

SEQ ID NO: 17164 - DNA, 201 bp, Homo sapiens
cgtggctaaataagttaataatatgttataaacacgacatgttagcggtgagttagtcaatgatgtggaaaggatataacttccaatcccatatctcatamctcccattcatctgtaactacaaagaacaagttcttatgtatcctttcagaaattttttaaaaaaattaaacgatcatatatatactattctctatgtat

SEQ ID NO: 17165 - DNA, 201 bp, Homo sapiens
gggtagatagatgtacaaaggaatgaataaacatgcatttagaacttacctgaaaagttacgtgttgcatgggaaggcaacatattatgatccaagttagmagaagcagtttctaattctatagtggttctaccattcactttttatgaccttgtcaatattaatctccctgtggctcagtttccagtgtcttcaatatta

SEQ ID NO: 17166 - DNA, 201 bp, Homo sapiens
aattaaaaatgaatatatttgaaacaactattgttttcagcaaagagttgaggaaaatattgctaattcagcattattttgactcaaatattgatatttarcaaaatagtatctaagatttatgcagtaatacatgttaactgatcatatttgaatctacgtaatgaagaaggtagacctaaaagaacttaataaaagtta

SEQ ID NO: 17167 - DNA, 201 bp, Homo sapiens
aggggagtaatgctgtgtccttactgggcagaaggtggaagggcaagagaatggaagactgtgaagcctcttttgcaagggccttaatctcattcatgaarggaggagccctcatgactaaatcttaaaggccccacctcttaatgctatcatattggccattaagtttgaacatctgaattttggagaggacacattgaa

SEQ ID NO: 17168 - DNA, 201 bp, Homo sapiens
ccccttagtttttcaatttcctacctctcagcctttgtttatagcattctgttatccaacaattaactggcttctttctttcctcttattcaaatctcacycttacttaaaaattggacttcattccctcctgttcatgaagcctcctcttccactccttctccagtgatccttgttttgcccctgactctgtgacacttg

SEQ ID NO: 17169 - DNA, 201 bp, Homo sapiens
acctaaaagaacttaataaaagttaatgtattttgagggtaaagtaggtgttatggtattaactttcctaaatctttactgttttggtgacaggcaaagargaatttgggaagaaacatgtaatttatatcagaattttaaatagatccttatgacatacgtgagaagctgcatattacatcaggttgaaacagtgcctag

SEQ ID NO: 17170 - DNA, 201 bp, Homo sapiens
cttgctcatttgcagctaggcttcttgggaagctttatgctctgtgtcctatctatttttctctaattttcacttttcctctgactcttacttttgccttkgtgattttttttctccacctcccctctctttgtttttgtccccttccccaaaactctttctgcctagatatctctctgacatccttcatcccttcgtgcc

SEQ ID NO: 17171 - DNA, 201 bp, Homo sapiens
ttccctgaacctcagaattattagtttctcttcctatattaatgcagtatttgttgttgaagactagcttttctgttaaccatgaagagcaaaacctttayctttaatattgagattctgttttcttgtttttagtttcagagagcaggtgcttgttctgggcactctgggaatttgggctttagatgagcaaaccaagtt

SEQ ID NO: 17172 - DNA, 201 bp, Homo sapiens
aacaaattaataacaatttaaaagttaatgaataaaagatgcttttgattttaaactctaatagtatgtcatcttttaaatgtagtgataagtgctataarttaatgtttttcttagctcattttgatttttagttatgaaatattgcaaacctatggaaaagtacataatagcataaatacatatgtgtatatctaccac

SEQ ID NO: 17173 - DNA, 201 bp, Homo sapiens
ctatgaagcggattgttggggtaggtaaaatactcatttacttcaattttggaaaaatggacaagcagtgatcatattattatatatatatataaaaataygttaaataccaagtctaatattctgtttgcccttaatattaacttagaatttcctgtccaaaaatgttaaagaaaaaagtacattattgaagtgtcaaaa

SEQ ID NO: 17174 - DNA, 201 bp, Homo sapiens
aaaaaaaacttcgtattttatatgaaatgttctaggattgagtaattttaagcacgttgtccaacgtgtttaacgtgtctaatgagacagttgaatgttartagtttcattttctcatagtaggaaacagagcttttgtgagggacatggtacagtctgtatcgtcaggatctgccctattcattactacgaacatctagc

SEQ ID NO: 17175 - DNA, 201 bp, Homo sapiens
atatataaaaatacgttaaataccaagtctaatattctgtttgcccttaatattaacttagaatttcctgtccaaaaatgttaaagaaaaaagtacattaytgaagtgtcaaaaatcaagaaacttaggttttaattttatcttttctctgttttaatttccctgtatctaatttcaaggtatttctactatgagaatgag

SEQ ID NO: 17176 - DNA, 201 bp, Homo sapiens
ctctgtgtatctgtcagtggttacagaaatgtcacgttcaccatggttaacagttactttagatggaatggtttcagaatgacttgttgattgttttggtwcttttctgtaatgtttaaatgttttataataatataatgataactttttaaaacaaattattactataaaaatgagcaaaaggacaagaactggaaaaat

SEQ ID NO: 17177 - DNA, 201 bp, Homo sapiens
taaagaatgattttttttgtcctttcacagcctaaatgttctgagcatactttcatctgttttttaaattctcttactaccaatagaaacactttattcastttagaagcctagaacttctaataaatattattaaatataagagcattcaccagtgttcagctgtaaagcaaaacataaacaattgattaataagttatg

SEQ ID NO: 17178 - DNA, 201 bp, Homo sapiens
cccaaagtgcttgattataggcatgattcaccatgctcagcctctggatgcttttaagatttttctcattgtttcttgttttcagcagtttgactatgctstacctggtgtagttttatgtttgtcctttttttctaagatttttaaatatgtgggtttatgtttttcataggttcagaacaattcttaaccattatctct

SEQ ID NO: 17179 - DNA, 201 bp, Homo sapiens
cttgttgattgttttggttcttttctgtaatgtttaaatgttttataataatataatgataactttttaaaacaaattattactataaaaatgagcaaaasgacaagaactggaaaaattaatttatggtataacaaatcagaatagtgcttactcgtaggagaattagtgcttataaggaaatacaagagtagcttctgg

SEQ ID NO: 17180 - DNA, 201 bp, Homo sapiens
ctcttttcctttcttgatatattaaagtccaaataacaggtatcagcatgctctgttaaaaagtgaggtggtatgaaaatcaaatatattaaagtcaagtwctaattgtatctgtaggacatctgtaagtgacttgatccttgctttcatgtttatgtcatttggcagtataggggcaattttgaggattccattgtaaat

SEQ ID NO: 17181 - DNA, 201 bp, Homo sapiens
ttgattgttttggttcttttctgtaatgtttaaatgttttataataatataatgataactttttaaaacaaattattactataaaaatgagcaaaaggacwagaactggaaaaattaatttatggtataacaaatcagaatagtgcttactcgtaggagaattagtgcttataaggaaatacaagagtagcttctggggtg

SEQ ID NO: 17182 - DNA, 201 bp, Homo sapiens
tatgaaaatcaaatatattaaagtcaagtactaattgtatctgtaggacatctgtaagtgacttgatccttgctttcatgtttatgtcatttggcagtatrggggcaattttgaggattccattgtaaatttttgatttgttaatgttatgctctatacataggagtatttatgggcaggcagttcttgctttgcatggct

SEQ ID NO: 17183 - DNA, 201 bp, Homo sapiens
gatggttacaaaaagtatgcaaaaacaatttaaggaattttgtacaattattaagatgtttttattacatattttaataagataaaatatggtataatgtmagatggaaaaaaggatacaaaatgttatatatataatctaaattttgtaaaattgtacaattgtactgttttcaaatacaaggaaattgaaagagtagaa

SEQ ID NO: 17184 - DNA, 201 bp, Homo sapiens
atttttgttggtagatatggctaatttattggctaattttttaatttttgttggtagagctagggtttcaccatgttgcccaggctggtctcaaactcctrggctcaagtgagccaccacactcaaccagattcctttttattgacccatctgatatctgtctttctagatcaccactactaattaattgggtgatattga

SEQ ID NO: 17185 - DNA, 201 bp, Homo sapiens
ttgacttaggaagtcttattatggtgtaaaagctactataataagttgttcccttacataaataaataaatgaccaatattactagaggctataagcagcwtgggggaaaaatggaagaagtcttttatcctagttttcagagggcatcagcagcttgcttttatgaaaaagtaacagctaaatgcactgcaaataatttg

SEQ ID NO: 17186 - DNA, 201 bp, Homo sapiens
ggtttactcatctattaaatgggaacaataatagctacacacgcttcatagagactttgtgatactaaaataagacagtgttataaacttcagaaaataawaccactaccacgtggctaaataagttaataatatgttataaacacgacatgttagcggtgagttagtcaatgatgtggaaaggatataacttccaatccc

SEQ ID NO: 17187 - DNA, 201 bp, Homo sapiens
gaattgtctttagctctgcctaacttgattgattttattttttatctgcttctaatgtgcataaaatcttctaatctaaagtaaatgatttagtgtttctyggtttatttttcccatatattatgaattctatttggcttatagttaaaattgtacacatgtagccttcttgttaaaactatgctttttcaataaaataac

SEQ ID NO: 17188 - DNA, 201 bp, Homo sapiens
atattctgagacttggtttactcatctattaaatgggaacaataatagctacacacgcttcatagagactttgtgatactaaaataagacagtgttataarcttcagaaaataataccactaccacgtggctaaataagttaataatatgttataaacacgacatgttagcggtgagttagtcaatgatgtggaaaggata

SEQ ID NO: 17189 - DNA, 201 bp, Homo sapiens
cttaggctttaatgcatattgagtccagatacagagtattagatctgatttgctgttggtatgcagtttgcttagatgtctactgattttgcctttgacaratttaaataaatgaaattgatgtttttgtagggtttactttggactgttgcactgtgcagtgggctggtgttgaaacacaatagcttttaaattgaactg

SEQ ID NO: 17190 - DNA, 201 bp, Homo sapiens
atgaagaggcacgggctccttcctcattgtgaattcctttctcttgtgctcaggagttcagggttgctgctatgaaaatatgcttcagacatgattttgtyagcatactgttatacatctgatcatctttagttatgaagatttaaatctcttgtgttctaataattccaggtttgataactgatctgtcttgtttattat

SEQ ID NO: 17191 - DNA, 201 bp, Homo sapiens
aagcagaagggagagagggtgggagaagtatgttatttgagtggataaggaggaatactgagaaggactgcccgctttcaaactgaggttcaaggagtctwagagcttctttgctggtttcttcctttcttcatgttgggaaaagggcttgtggggtgtctgtataaactggccataaaaatatgggacaataagttgtgg

SEQ ID NO: 17192 - DNA, 201 bp, Homo sapiens
tttgaggttgtagtgagcaatgattgcaccaccgcactccagcctggatgacagagtaagaccctgtctttaaaaaacaacaacaacaacaaaacaacccrtactacctgtggattgctctgacaggatttcacataatgtttaatgggacagatgggatttcatatcttaacaactgaaagatgttattctgtaaaaact

SEQ ID NO: 17193 - DNA, 201 bp, Homo sapiens
tcccagtcttcaaaggcatctttacctcccagtcttggattattccatatgtatggttcattcctctgtgttttcaccataaaaatgcataacaattatarggtctttatcttgtttttaagaaactcagactttatttggagagattaggctaatgtgaactaaccgtcagtaattcaagtatacaattagtgttaaatt

SEQ ID NO: 17194 - DNA, 201 bp, Homo sapiens
cctgaaaacttgtcttcctttctcaccttttatctagagagtcaccttcaaagggcagaatcgctggtactgcagctttttcaaatatcaggaacttcaaycaaataaaatgaaaaaggacatattctcctatgctttccacctatgaaccttacttttccctcagggcccaaatgtggctcccctcaattcctatgctcc

SEQ ID NO: 17195 - DNA, 201 bp, Homo sapiens
gagcccaggagtttgaggttgtagtgagcaatgattgcaccaccgcactccagcctggatgacagagtaagaccctgtctttaaaaaacaacaacaacaamaaaacaacccatactacctgtggattgctctgacaggatttcacataatgtttaatgggacagatgggatttcatatcttaacaactgaaagatgttatt

SEQ ID NO: 17196 - DNA, 201 bp, Homo sapiens
gtgggagttgtgggagtttggggcgaatgtgtgtaggggtctctagtagttttcaaactttagtgaaaaggaaaccacttggtgagcttagatcccacccstgaagacactgattgaattggacttgggctgggctcaggagtctgaattttgagcatcgtcttctagtttatttaccgttcgccggatcagactttaata

SEQ ID NO: 17197 - DNA, 201 bp, Homo sapiens
cccaggagtgtcattctaaaacactgcaattttaggaaaagccagtctgtccaatatctaaggacaatgggtcaatattgagcatgttttccttcagtgcytgagccactttattagggcagaatcctgggtccatctttcttctggaaggagagagaacagaagtgatagcaagacctcttcccacctggccaccttacc

SEQ ID NO: 17198 - DNA, 201 bp, Homo sapiens
accatcaaacccaggagtgtcattctaaaacactgcaattttaggaaaagccagtctgtccaatatctaaggacaatgggtcaatattgagcatgttttcyttcagtgcctgagccactttattagggcagaatcctgggtccatctttcttctggaaggagagagaacagaagtgatagcaagacctcttcccacctggc

SEQ ID NO: 17199 - DNA, 201 bp, Homo sapiens
cagaagataaccattaatagatacaaaaatatggtgagaattcagtattcacaaaggaaaataaaggaacaaatagcagttttacaaagccagaaaaaaawtaagaaagaaagaaaacaaatgtaaaataaataataagtatttaaaagtaataaagatggaagaaataaaatcaaatatttctcatcttgaatatgaatg

SEQ ID NO: 17200 - DNA, 201 bp, Homo sapiens
ttttccccaatgttttgttgtagtagtttcatggttggaggtcttagatttaagtctttaatccattttgattttatatttgtatatgctgagagataggkatctaattttgttttcctgcatatggatatccagttttcctagcaccatttattagagactgtcttttcctcagtgtatgctcttcgcatctttctcagt

SEQ ID NO: 17201 - DNA, 201 bp, Homo sapiens
acttaaaaatttcttacttattatgtttgttgtttcttttacttaatagaatgaaatccctatgagggcaagggtttttctgtcatttttgttcattgctrtgtcacaaatgcgaatggagaaccagatgagaatagagctacagaatcaaaaggaggagggaatttcaagatgaaagagtagtggtcatgggtatcagat

SEQ ID NO: 17202 - DNA, 201 bp, Homo sapiens
cgcaccacttggatagtagcatcttttattggagtggttctctatgcctaaagaggtgcctgtgttttggaattttttggtagggctccataaaggtccarccttcccttcgttgaatatttttatacatccttttttgggcatgtatctctgattggaaattgctattccttatcacttttccagtccatgatttcctgg

SEQ ID NO: 17203 - DNA, 201 bp, Homo sapiens
acttggatagtagcatcttttattggagtggttctctatgcctaaagaggtgcctgtgttttggaattttttggtagggctccataaaggtccagccttcmcttcgttgaatatttttatacatccttttttgggcatgtatctctgattggaaattgctattccttatcacttttccagtccatgatttcctggatgtaa

SEQ ID NO: 17204 - DNA, 201 bp, Homo sapiens
tgtatgaacctaagatggaatttcaaattaatgaaaataatttcactgggataatttgaataagtttgttaaaataaagagatgaaacttttttagtttawatgatgactttctagtccatctataatttttatttattctagtaaatgttatttgttttccttatgtatattagattttttcaattaacaaaatatttac

SEQ ID NO: 17205 - DNA, 201 bp, Homo sapiens
ttgcttaaacccggaaggcggaggttgcagtgagccaagatcgcgccactgcactccagcttgagcaacaagagcgaaactccgtctaaaaaaaaaaaagsgttcccaaggcaatccccaaatgtcataataccataatggagatatactatctgtgattctttaacacctaataacaagtcagaggttttctgtggaaat

SEQ ID NO: 17206 - DNA, 201 bp, Homo sapiens
atttattttctcccttttctgtcagtctgccagttctctcttagccttcctattatgtgtgtattatattttttggatccatcctctgtttgcctctgtcwtctcccctgtcaaattgacctctctaacctttcctgtcatttttaggattttttttgagctggcattgaagtcagtttagaatttttgacattatccttt

SEQ ID NO: 17207 - DNA, 201 bp, Homo sapiens
gtttgtctgctatttattttctcccttttctgtcagtctgccagttctctcttagccttcctattatgtgtgtattatattttttggatccatcctctgtytgcctctgtcttctcccctgtcaaattgacctctctaacctttcctgtcatttttaggattttttttgagctggcattgaagtcagtttagaatttttga

SEQ ID NO: 17208 - DNA, 201 bp, Homo sapiens
aggaggaaggattcagtcaaaattgggattgacagggtagagaggctccaaggcctttatgttcagtaataacatagggttgatgtcacctattccatttytttcccttcctcccgccctcaaattggatactagaactatgcaggaaaagcgactcagtgaaacaaaaaacataaggtcctcaggaagcaccaggatctg

SEQ ID NO: 17209 - DNA, 201 bp, Homo sapiens
gaactatgcaggaaaagcgactcagtgaaacaaaaaacataaggtcctcaggaagcaccaggatctgcagaatcagggactgaaaaacccttattgtacasaaaggattattgcttagtctgcccagcaaagttggccatttttgtactgggcatatctaaatcaggcagaagtcactgcacgccaaacctgaaagcttgt

SEQ ID NO: 17210 - DNA, 201 bp, Homo sapiens
ggagtgcattgtgcaatctcggcttactgcaacctctgcccctggggttcaagcttctcctgcttcagtctcctgagtagctgggattacaggtgcccccsctccccagccccaccatgcccagctagtttttgtatttttaatagagatggggtttcaccatgttggtcaggctggtctcgaactcctgatctcaggtga

SEQ ID NO: 17211 - DNA, 201 bp, Homo sapiens
atcaaagagagacggtacctttggtgaaaccattgtttagctggttttcacttcatccagttaccagccaatcaaaagtttttccaccgatcatattttcrtaccattgattgtattaacctagtttaaatcaaatctaaaatatgtgtgcttattacaattattgaatggttgcatgtgagggttgttgggttttgtaaa

SEQ ID NO: 17212 - DNA, 201 bp, Homo sapiens
cgaagatgaaataaagactaagagtatccatttctaacatgtttactttaatgaaatgttaatagacgttgtgtaggctgaagggaaatgataccagatgkatatttaggcggaccaatcaaaatggtaaatacgtataaaggactaattttattcttaagttatcccactatctgagaggtttttaatatgggtggctaa

SEQ ID NO: 17213 - DNA, 201 bp, Homo sapiens
atgttcaccgacacattgtaagagcaaaaaaaaaagaaaaagaaaaaaaaaaaagaaaattggaaactacatctatcactagaatagatacataaattgtrgcatgcatatacaatggaatactgtgccagttgttaaaatgaatgaactggaaatacctgttagacaaatctcaaaaacaatagtaagaaacatcacagg

SEQ ID NO: 17214 - DNA, 201 bp, Homo sapiens
gcaactggcgaacaccaaatccaaattctggttacctctgatgccagaagcaaaaaggaaagcaatctgggatgggtatacttgtgattgtcattcagatktttaaagttttactcatgatgctcgatgggggagggatgttggattttgtttttgttttaatctattctttatacttctttgcctgaattattttatata

SEQ ID NO: 17215 - DNA, 201 bp, Homo sapiens
gtccgggttttgtgcttccaaattctattccttttcttccatatctttctgctttcctttagaattatatactaaatcaatctttgtatataccgtatgtkgtaaactccttagaattatttaattaatgaactgcatttatatgtcctgtaaaatcttatttgctccatggtaggtcttttgcttcttagatggtgcaaa

SEQ ID NO: 17216 - DNA, 201 bp, Homo sapiens
ttctggaagatagaacaggacctttttttattcccagtgcttaatacataataggtgctcatcaaatgtgtttggaatgaattaacccttcctattttccagagtcatcagtatagaacccattaacactgctgtcagtttaaagaactccattggtgtttgagtgtttatttatttttattttatttattttaagttcca

SEQ ID NO: 17217 - DNA, 201 bp, Homo sapiens
ttagccatgtagttgattgtggatggtacctttttaaaaaacattcagtaagaagaattgacagtattctaacatgagtttaaagcaggatttgcctttgrcaaagccagacacagatggtctgactttcagatggtggaatactagctgtattacttaaggcttgcattttgcaatgtattcatgaatatagtcaataaa

SEQ ID NO: 17218 - DNA, 201 bp, Homo sapiens
gacaaagatctcttagagaagatatacatatgtaaccttggaactgagtctggaagatgagtttgcctaggtggctggagtagaagaatgacgctcctagmagaggaactagtatacctgaaggcttggggtgtggaagaactggagtattgctgaaacagtatttcaatgtagggtttaagtataacatgtgtaaccaga

SEQ ID NO: 17219 - DNA, 201 bp, Homo sapiens
ctagagcaagtattctttggctaattggagaaaactgtgaacgagttcctaaaattgcccctgatgttttgaggaagatggctaaaagcttcactagtgargatgatctggtaaaactgcagatattaaatctgggagcaaaattgtatttaaccaactccaaacaggtgagaggcaaatgttagtcaacctatctaatac

SEQ ID NO: 17220 - DNA, 201 bp, Homo sapiens
atttctttcttttctagttggtagctggcagtgttgtgatggcttttgaagaagtatgcccggacagaatagatctgattcataaaaattaccgcaagctrtgtaacttactagtggatgttgaagagtgggggcaggttgtcataatccacatgctaactcgatatgctcggacacagtttgtcagcccttggaaagagg

SEQ ID NO: 17221 - DNA, 201 bp, Homo sapiens
gcatatttaaggaagactcatttgtctcttgttcttttactaaagcaggcaaccaatataaatgcaagcataattatccattattttggcactgattgatrcatatttattggtgtaagtatatacacttttagtttgatactggcaagaggcccttgttaggaggagcagcatgacacagtgtttacagtgacattgcca

SEQ ID NO: 17222 - DNA, 201 bp, Homo sapiens
gtgatccacgctcctcggcctcccaaagtgctgggatgacaggcgtgagccaccgcacctggccacaatttctacttttaggattgtactatgtcttgtcrctcagtctacttctctgtctgtatgccctcctgtagtgatctcatccctttccaaatgcatattgctaaccagtgctgtctcctgtattctgtagccttt

SEQ ID NO: 17223 - DNA, 201 bp, Homo sapiens
ttttttgggcgggggtaatttcatcctgtttttagtatgtctcgtaagttttgatcagatgctaggtatttaggataaaaatgattgatgaagctttgggwgatagcttcttccatacagggctgggtttttgtttttgtttttttttccagccaagcaaatagaatgtaagcagatcattctgatcttgtcaaagctcag

SEQ ID NO: 17224 - DNA, 201 bp, Homo sapiens
aagccacgttacgtagggttaaattaaaatccatctgatgagaatttatggtttgtagggcaggactcctcaggccccttaggaatttgggcaagagagaraaaagtcagagtttagtcctcacaagtacagaggaataatctgaaactattcatgagattttaccttggatttttaaattaagacgttgtttgttaccct

SEQ ID NO: 17225 - DNA, 201 bp, Homo sapiens
gactggggactccgggaaacatctaaaaggcttaaaaactttgtctaacttcagccgggcatggtggctcacacctgtaatcccagcactttgggaggctraggcaggtggatcacaaggtcaggagtttgagacgagcctgaccaacatggtgaaaccccgtctctactaaaaatacaaaaattagccaggcatggtggc

SEQ ID NO: 17226 - DNA, 201 bp, Homo sapiens
gccaccaccaccccacccagcacacctccaacctcagccagacaaggttgttgacacaagagagccctcaggggcacagagagagtctggacacgtgggggagtcagccgtgtatcatcggaggcggccgggcacatggcagggatgagggaaagaccaagagtcctctgttgggcccaagtcctagacagacaaaaccta

SEQ ID NO: 17227 - DNA, 201 bp, Homo sapiens; identical to SEQ ID NO: 2868

SEQ ID NO: 17228 - DNA, 201 bp, Homo sapiens; identical to SEQ ID NO: 2869

SEQ ID NO: 17229 - DNA, 201 bp, Homo sapiens
ggctcacgcctctaatcctagcactttgagaggccaaggcgggcagattgcctgagcacaggagttcgagaccagcctggccaacatggtgaaaccctgtytctgtcaaaaatacaaaaaattagccaggtgtgttggcgcgtgcctataatcccagctgctcgggaggatgaggttcaaagaatcacttgaacccgggag

SEQ ID NO: 17230 - DNA, 201 bp, Homo sapiens
ggcagattgcctgagcacaggagttcgagaccagcctggccaacatggtgaaaccctgtctctgtcaaaaatacaaaaaattagccaggtgtgttggcgcrtgcctataatcccagctgctcgggaggatgaggttcaaagaatcacttgaacccgggaggcagaggctgcagtgagctgagatcatgccactgcactcca

SEQ ID NO: 17231 - DNA, 201 bp, Homo sapiens
cctgtctctattaaaaatacaaaaattagccagccgtggtagcgagcgcctatgatcccagctactccggaggctgaggccagagaatcacatgaacctgsgaggtggaggctgcagtgagccgagatcacgccactgcactccagcctgggggacagagcaagaatctgtttcaaaaaaaaaaaaagaaaaataggaagg

SEQ ID NO: 17232 - DNA, 201 bp, Homo sapiens; identical to SEQ ID NO: 2896

SEQ ID NO: 17233 - DNA, 201 bp, Homo sapiens
gaggccaaggcgggcggatcacttgaggtcaggagtttgagaccagcctggccaacatggtgaaaccctgtctctattaaaaatacaaaaattagccagcygtggtagcgagcgcctatgatcccagctactccggaggctgaggccagagaatcacatgaacctgggaggtggaggctgcagtgagccgagatcacgcca

SEQ ID NO: 17234 - DNA, 201 bp, Homo sapiens
tgcactccagcctgggtgacagagcaagactttgtctccaaaaaaaggaactagacgggttcatttaaacccctgactgcagccctttgacatacatccarttgaggactggggactccgggaaacatctaaaaggcttaaaaactttgtctaacttcagccgggcatggtggctcacacctgtaatcccagcactttggg

SEQ ID NO: 17235 - DNA, 201 bp, Homo sapiens; identical to SEQ ID NO: 2898

SEQ ID NO: 17236 - DNA, 201 bp, Homo sapiens
ggggaggccaaggcgggcggatcacttgaggtcaggagtttgagaccagcctggccaacatggtgaaaccctgtctctattaaaaatacaaaaattagccrgccgtggtagcgagcgcctatgatcccagctactccggaggctgaggccagagaatcacatgaacctgggaggtggaggctgcagtgagccgagatcacg

SEQ ID NO: 17237 - DNA, 201 bp, Homo sapiens; identical to SEQ ID NO: 2901

SEQ ID NO: 17238 - DNA, 201 bp, Homo sapiens
tctcaaaacaaacaaacaaacaaacaaaatacagaagctgaggcgggaggaacatttgaaccggattcggaggctgcagtgagctatgattgcaccactgygctccagtctgtgtgacagtgagaccctgtctcttacacacacacacacacacacacacacacatgcacacacacagagagagagaaattagaagatact

SEQ ID NO: 17239 - DNA, 201 bp, Homo sapiens
tctattgaacccgggagggggaggttgcagtgagccgagatcatgccattgcactccagcctgggcgacagagtgagactccttctcaaaacaaacaaacraacaaacaaaatacagaagctgaggcgggaggaacatttgaaccggattcggaggctgcagtgagctatgattgcaccactgcgctccagtctgtgtgac

SEQ ID NO: 17240 - DNA, 201 bp, Homo sapiens; identical to SEQ ID NO: 2903

SEQ ID NO: 17241 - DNA, 201 bp, Homo sapiens
agcaagaccctgcctctacaaaaaaaaaattttttttaattagccaggcttggtgacatgcatctgtagtctactcaagaagctgaggtgaggccaggcayggtggctcacgcctgtattcccagcactttgggaggtcaaggcgggtggatgacctgaggtcaggagttcaagaccagcctggccaacatggtgaaaccc

SEQ ID NO: 17242 - DNA, 201 bp, Homo sapiens
ccagctactcgggaggctgaggcaggagaatcacttgagcccgggaggtggaggttgcagtgagccgaacgaaattgagccacttcaccccagcctgggcraaagagtgaaattccattcaaaaaaaaaaaaaaaaaaaaaggatgaggactgggatgaactggtggctgggtgtggggaaaatggaagtgaaggaaggcc

SEQ ID NO: 17243 - DNA, 201 bp, Homo sapiens
gggatacccaaaagccaagagcgagagagagcctggcttccagaaatagtggagaagccaggagaactaggtgaaaacccagtgctgggttgccatcagcragagctggagccatttccaacgaaccatcttgtcgtcttcacagctgagttcaccacgcccgatggccattactacgacatcctggaactgccctaccac

SEQ ID NO: 17244 - DNA, 201 bp, Homo sapiens
ctgcccaagtaagccaccccgctatctccccgacctaccaacccctctctcctggctccctaaagtcaccgcccccaggttgaatttcccagatctgtgaygcttgcaggacatgcatgtgtgggaggctgatgggaaactgtggcctgggtttgattatgagtcttgcaatcatccctccccctgtttctgctggagggc

SEQ ID NO: 17245 - DNA, 201 bp, Homo sapiens
tgtagtcccagctacttgggaggctgaggtgggaggatcacttgagtccagcagttcaaggctgcagtgagctatgtttgcaccaccacactccagcctgrgtcacagaacaagacctcatctctaaaaaacaaacaaaaaccaaatccacatatcctaaaaaatgctccttttcagcattctcttctctatggacaaagg

SEQ ID NO: 17246 - DNA, 201 bp, Homo sapiens
ctctactaaaaatacaaaaaaaattagccaggcgtggtggcaggcgcctgtagtcccagctactcgggaggctgaggcaggagaatggcatgaacccaggmggcagagcttgcagtgagctgagatcgtgccactgcactccagcctgggcgacagagagagactccgtctcaaaaaaaaaaaataaaagaattcatggaa

SEQ ID NO: 17247 - DNA, 201 bp, Homo sapiens; identical to SEQ ID NO: 2915

SEQ ID NO: 17248 - DNA, 201 bp, Homo sapiens
cctgtaatcccagcccaacactttgggaggtctaggcgagaggaaggcttgaggcctggagtttgagaccagcctggccaacataacaagacctcatctcytcaaaaaatttaaaaaccagccgggcatggtggtgcacacctgtagtcccagctacttgggaggctgaggtgggaggatcacttgagtccagcagttcaa

SEQ ID NO: 17249 - DNA, 201 bp, Homo sapiens; identical to SEQ ID NO: 2889

SEQ ID NO: 17250 - DNA, 201 bp, Homo sapiens; identical to SEQ ID NO: 2918

SEQ ID NO: 17251 - DNA, 201 bp, Homo sapiens
ctgtttctcagcctggaaaacgggcttgggaccatggaaccctgtttcctcgcctgatggctcctaagttccctgactgtgaaaaggcctcctaaagaaaracccaagttgttcccacagtgggaagtaaacttaagaaacatgcttatcaggctgggcatggtggctcccacctgtaatcccagcgctttgggggaccaa

SEQ ID NO: 17252 - DNA, 201 bp, Homo sapiens; identical to SEQ ID NO: 2890

SEQ ID NO: 17253 - DNA, 201 bp, Homo sapiens
gcaggacatgcatgtgtgggaggctgatgggaaactgtggcctgggtttgattatgagtcttgcaatcatccctccccctgtttctgctggagggcagggracagctcttcctgaccacacccccacattgactatccccagaatacccagcaaaagcccccaaaaggagagtcagagaaatgagggaggtgggggcccaa

SEQ ID NO: 17254 - DNA, 201 bp, Homo sapiens
gagagagagcctggcttccagaaatagtggagaagccaggagaactaggtgaaaacccagtgctgggttgccatcagcgagagctggagccatttccaacraaccatcttgtcgtcttcacagctgagttcaccacgcccgatggccattactacgacatcctggaactgccctaccacggggacaccctcagcatgttca

SEQ ID NO: 17255 - DNA, 201 bp, Homo sapiens
ggcagcatagcaagaccctgcctctacaaaaaaaaaattttttttaattagccaggcttggtgacatgcatctgtagtctactcaagaagctgaggtgagsccaggcacggtggctcacgcctgtattcccagcactttgggaggtcaaggcgggtggatgacctgaggtcaggagttcaagaccagcctggccaacatgg

SEQ ID NO: 17256 - DNA, 201 bp, Homo sapiens
agcctcacatgtcctctcctctctgtcccggtgcagacaagggcatggcccccgccctccggcatctgtacaaggagctcatggggccatggaacaaggaygagatcagcaccacagacgcgatcttcgtccagcgggatctgaagctggtccagggcttcatgccccacttcttcaggctgttccggagcacggtcaagc

SEQ ID NO: 17257 - DNA, 201 bp, Homo sapiens
ttgaacctgggaggcggaggatgcagtgagccaagatcacacctccgcactccagcctgggcaacagagcaagactccatctcaaaaaaaaaaaaaaaaaaggcggtggagacacccagcactggttccctcctagagaaggggagagagccgagcccaaacacaggctatttttggagttgtgttgtttggagagcaacc

SEQ ID NO: 17258 - DNA, 201 bp, Homo sapiens
ccaagctcctggaggaaaccaggtctcagaggatgtccctaaacttttaaggttcatattcaggaaaacaaacaacttccagctgggcttagtggctcacwcctgtaatcccagcactttgggaggccgaggcaggaggatcgcttgagcccaggaatttgagaccagcctgggcaatataatgagactgtgtctctacaa

SEQ ID NO: 17259 - DNA, 201 bp, Homo sapiens; identical to SEQ ID NO: 2871

SEQ ID NO: 17260 - DNA, 201 bp, Homo sapiens
caacattctgagtgcccagctcatcagccactggaaaggcaacatgaccaggctgccccgcctcctggttctgcccaagtaagccaccccgctatctcccygacctaccaacccctctctcctggctccctaaagtcaccgcccccaggttgaatttcccagatctgtgatgcttgcaggacatgcatgtgtgggaggctg

SEQ ID NO: 17261 - DNA, 201 bp, Homo sapiens; identical to SEQ ID NO: 2872

SEQ ID NO: 17262 - DNA, 201 bp, Homo sapiens
gctcacacctgtaatcccagcactttgggaggctgaggcaggtggatcacaaggtcaggagtttgagacgagcctgaccaacatggtgaaaccccgtctcyactaaaaatacaaaaattagccaggcatggtggcaggcgcctgtaatcccagctattcgggaggctgaggcaggagaattgcttgaaccccggagacaga

SEQ ID NO: 17263 - DNA, 201 bp, Homo sapiens
tgacacggctggtgctggtgaatgccctctacttcaacggccagtggaagactcccttccccgactccagcacccaccgccgcctcttccacaaatcagayggcagcactgtctctgtgcccatgatggctcagaccaacaagttcaactatagtaagtccaagagccccttccccacagcccacagcaactgcatctcat

SEQ ID NO: 17264 - DNA, 201 bp, Homo sapiens; identical to SEQ ID NO: 2874

SEQ ID NO: 17265 - DNA, 201 bp, Homo sapiens
gagtttgagacgagcctgaccaacatggtgaaaccccgtctctactaaaaatacaaaaattagccaggcatggtggcaggcgcctgtaatcccagctattygggaggctgaggcaggagaattgcttgaaccccggagacagaggttgcagcgagccgagatcgcgccactgcactccagcctggcaatagagtgagactc

SEQ ID NO: 17266 - DNA, 201 bp, Homo sapiens; identical to SEQ ID NO: 2876

SEQ ID NO: 17267 - DNA, 201 bp, Homo sapiens; identical to SEQ ID NO: 2904

SEQ ID NO: 17268 - DNA, 201 bp, Homo sapiens; identical to SEQ ID NO: 2877

SEQ ID NO: 17269 - DNA, 201 bp, Homo sapiens
tccccagacccggaaaggaccccgcagccctctcggcacagagcagctctgtctgtgctcagccatcacccactccccacctgtttctcagcctggaaaaygggcttgggaccatggaaccctgtttcctcgcctgatggctcctaagttccctgactgtgaaaaggcctcctaaagaaaaacccaagttgttcccacagt

SEQ ID NO: 17270 - DNA, 201 bp, Homo sapiens; identical to SEQ ID NO: 2906

SEQ ID NO: 17271 - DNA, 201 bp, Homo sapiens; identical to SEQ ID NO: 2879

SEQ ID NO: 17272 - DNA, 201 bp, Homo sapiens; identical to SEQ ID NO: 2936

SEQ ID NO: 17273 - DNA, 201 bp, Homo sapiens; identical to SEQ ID NO: 2880

SEQ ID NO: 17274 - DNA, 201 bp, Homo sapiens
tctttccctgccagctgtgagaaaacaaagcctaaggcagattaaaaagcaggagggctgctcagtgtggttgcccttggtatctgtttactgaaaaaatycaaaacaaacatccgacgcttccacccactgaaacttcctgtgactctgctatcagctgttgccatggattctcccaactgaaccccaccacatacacta

SEQ ID NO: 17275 - DNA, 201 bp, Homo sapiens
gcacctgtagccccagttacttgggagactgaggtgggaggatcacttgagcccatgagttcaaggctgcagtgagccatgaaggtgccactgcactcccrcctgggcgacagagggagaccctgtctctaagaaaaacggcgggggtgggggtggtgccagtgccagcatccctctgttctaagacattgtcccttctct

SEQ ID NO: 17276 - DNA, 201 bp, Homo sapiens; identical to SEQ ID NO: 2909

SEQ ID NO: 17277 - DNA, 201 bp, Homo sapiens
gaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctaccaagctc

SEQ ID NO: 17278 - DNA, 201 bp, Homo sapiens
gaaccctcaattcagcataagcctcacatgtcctctcctctctgtcccggtgcagacaagggcatggcccccgccctccggcatctgtacaaggagctcayggggccatggaacaaggatgagatcagcaccacagacgcgatcttcgtccagcgggatctgaagctggtccagggcttcatgccccacttcttcaggctg

SEQ ID NO: 17279 - DNA, 201 bp, Homo sapiens; identical to SEQ ID NO: 2888

SEQ ID NO: 17280 - DNA, 201 bp, Homo sapiens
tggctcaggtgaggctccacgggtgtcgcctccatcgcccttcaggataactggtccccagacccggaaaggaccccgcagccctctcggcacagagcagytctgtctgtgctcagccatcacccactccccacctgtttctcagcctggaaaacgggcttgggaccatggaaccctgtttcctcgcctgatggctcctaa

SEQ ID NO: 17281 - DNA, 201 bp, Homo sapiens; identical to SEQ ID NO: 2891

SEQ ID NO: 17282 - DNA, 201 bp, Homo sapiens; identical to SEQ ID NO: 2867

SEQ ID NO: 17283 - DNA, 201 bp, Homo sapiens
aatgactgggtgaagacacacacaaaaggtgagcaggcagggaaaggaaacccatttcctgggcctcaagagaaagggaatttggaaataaatccacatawcccagttgggtgcagtagttcacacctgtaatcccagcccaacactttgggaggtctaggcgagaggaaggcttgaggcctggagtttgagaccagcctg

SEQ ID NO: 17284 - DNA, 201 bp, Homo sapiens
ctctactaaaaatacaaaaattagccaggcatggtggcaggcgcctgtaatcccagctattcgggaggctgaggcaggagaattgcttgaaccccggagayagaggttgcagcgagccgagatcgcgccactgcactccagcctggcaatagagtgagactccatctcaaaacaacaacaacaacaacaacaacaaaatcg

SEQ ID NO: 17285 - DNA, 201 bp, Homo sapiens
ctttctttcttttttgattttgcactggacggtgacgtcagccatgtacaggatccacaggggtggtgtcaaatgctattgaaattgtgttgaattgtatrctttttcacttttgataaataaacatgtaaaaatgtttcaaaaaaataataaaataaataaatacgaagaatatgtcaggacagtcactgccttcacctt

SEQ ID NO: 17286 - DNA, 201 bp, Homo sapiens
aagaagagagagagaaagaaagagagagaagaaagaaagaaagaaagaaagaaagaaagaaagaaagaaagaaagaaagaaagaaaaagaaaggaaagaargaacgaacgaaccaggcctccctctccaaccttcacctccgtccctattctggccacttgattcgggggacacctggtaggggatggggaaaggtgggag

SEQ ID NO: 17287 - DNA, 201 bp, Homo sapiens
tgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctaccaagct

SEQ ID NO: 17288 - DNA, 201 bp, Homo sapiens
tcatagtctcagcccgcatggcccccgaggagatcatcatggacagacccttcctctttgtggtccggcacaaccccacaggtgagcctggaacccatcaygttccacatcctcccacccattctttctctcaggaactagtcccgacagatgcagacatccctctatccctgagagggctctgggcagggaacccataac

SEQ ID NO: 17289 - DNA, 201 bp, Homo sapiens
gcagaacaaattagccctaactctgcagtatacagttcaaaaactgctcatccatgctgagatggctctagaggaaaaagagttcttcaaaaagccccctyaccacagaggaggcttgttccaggaaatgccccatttaacagactctcagctattgtgaggacaaaaatgatgtagactcacagcacgagacctgcccag

SEQ ID NO: 17290 - DNA, 201 bp, Homo sapiens
actctgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctacca

SEQ ID NO: 17291 - DNA, 201 bp, Homo sapiens
gactctgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctacc

SEQ ID NO: 17292 - DNA, 201 bp, Homo sapiens
aagggggattgcttgaggccagaagttgaataccagtctgggcagcatagcaagaccctgcctctacaaaaaaaaaattttttttaattagccaggcttgktgacatgcatctgtagtctactcaagaagctgaggtgaggccaggcacggtggctcacgcctgtattcccagcactttgggaggtcaaggcgggtggatg

SEQ ID NO: 17293 - DNA, 201 bp, Homo sapiens
ggggacagagcaagaatctgtttcaaaaaaaaaaaaagaaaaataggaaggaaggaaggaaaggaaaggaaagaagagagagagaaagaaagagagagaagaaagaaagaaagaaagaaagaaagaaagaaagaaagaaagaaagaaagaaagaaaaagaaaggaaagaaagaacgaacgaaccaggcctccctctccaac

SEQ ID NO: 17294 - DNA, 201 bp, Homo sapiens
gggaaaggagccgtggaccagctgacacggctggtgctggtgaatgccctctacttcaacggccagtggaagactcccttccccgactccagcacccaccrccgcctcttccacaaatcagacggcagcactgtctctgtgcccatgatggctcagaccaacaagttcaactatagtaagtccaagagccccttccccaca

SEQ ID NO: 17295 - DNA, 201 bp, Homo sapiens
atcccagcactttgggaggctgagaagggggattgcttgaggccagaagttgaataccagtctgggcagcatagcaagaccctgcctctacaaaaaaaaawttttttttaattagccaggcttggtgacatgcatctgtagtctactcaagaagctgaggtgaggccaggcacggtggctcacgcctgtattcccagcact

SEQ ID NO: 17296 - DNA, 201 bp, Homo sapiens
gggggacagagcaagaatctgtttcaaaaaaaaaaaaagaaaaataggaaggaaggaaggaaaggaaaggaaagaagagagagagaaagaaagagagagaagaaagaaagaaagaaagaaagaaagaaagaaagaaagaaagaaagaaagaaagaaaaagaaaggaaagaaagaacgaacgaaccaggcctccctctccaa

SEQ ID NO: 17297 - DNA, 201 bp, Homo sapiens
tgaacccgggaggcagaggctgcagtgagctgagatcatgccactgcactccagcctgggtgacagagcaagactttgtctccaaaaaaaggaactagacrggttcatttaaacccctgactgcagccctttgacatacatccaattgaggactggggactccgggaaacatctaaaaggcttaaaaactttgtctaactt

SEQ ID NO: 17298 - DNA, 201 bp, Homo sapiens
tgggggacagagcaagaatctgtttcaaaaaaaaaaaaagaaaaataggaaggaaggaaggaaaggaaaggaaagaagagagagagaaagaaagagagagragaaagaaagaaagaaagaaagaaagaaagaaagaaagaaagaaagaaagaaagaaaaagaaaggaaagaaagaacgaacgaaccaggcctccctctcca

SEQ ID NO: 17299 - DNA, 201 bp, Homo sapiens
ccaacatggtgaaaccctgtctctgtcaaaaatacaaaaaattagccaggtgtgttggcgcgtgcctataatcccagctgctcgggaggatgaggttcaargaatcacttgaacccgggaggcagaggctgcagtgagctgagatcatgccactgcactccagcctgggtgacagagcaagactttgtctccaaaaaaagg

SEQ ID NO: 17300 - DNA, 201 bp, Homo sapiens
ttcggaggctgcagtgagctatgattgcaccactgcgctccagtctgtgtgacagtgagaccctgtctcttacacacacacacacacacacacacacacaygcacacacacagagagagagaaattagaagatactgaattggcagaagagaagggaaatagaaattaaaatactgaataggggagcagtgaacaggggat

SEQ ID NO: 17301 - DNA, 201 bp, Homo sapiens; identical to SEQ ID NO: 2908

SEQ ID NO: 17302 - DNA, 201 bp, Homo sapiens; identical to SEQ ID NO: 2883

SEQ ID NO: 17303 - DNA, 201 bp, Homo sapiens
attcggaggctgcagtgagctatgattgcaccactgcgctccagtctgtgtgacagtgagaccctgtctcttacacacacacacacacacacacacacacatgcacacacacagagagagagaaattagaagatactgaattggcagaagagaagggaaatagaaattaaaatactgaataggggagcagtgaacagggga

SEQ ID NO: 17304 - DNA, 201 bp, Homo sapiens; identical to SEQ ID NO: 2882

SEQ ID NO: 17305 - DNA, 201 bp, Homo sapiens
aaaggaggcagtggcccacagaggagcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggtaggagaaaagcaaactccctccaacctctta

SEQ ID NO: 17306 - DNA, 201 bp, Homo sapiens; identical to SEQ ID NO: 2886

SEQ ID NO: 17307 - DNA, 201 bp, Homo sapiens
gattcggaggctgcagtgagctatgattgcaccactgcgctccagtctgtgtgacagtgagaccctgtctcttacacacacacacacacacacacacacacatgcacacacacagagagagagaaattagaagatactgaattggcagaagagaagggaaatagaaattaaaatactgaataggggagcagtgaacagggg

SEQ ID NO: 17308 - DNA, 201 bp, Homo sapiens; identical to SEQ ID NO: 2914

SEQ ID NO: 17309 - DNA, 201 bp, Homo sapiens
ggattcggaggctgcagtgagctatgattgcaccactgcgctccagtctgtgtgacagtgagaccctgtctcttacacacacacacacacacacacacacacatgcacacacacagagagagagaaattagaagatactgaattggcagaagagaagggaaatagaaattaaaatactgaataggggagcagtgaacaggg

SEQ ID NO: 17310 - DNA, 201 bp, Homo sapiens
ctctgttgggcccaagtcctagacagacaaaacctagacaatcacgtggctggctgcatgccctgtggctgttgggctgggcccaggaggagggaggggcrctctttcctggaggtggtccagagcaccgggtggacagccctgggggaaaacttccacgttttgatggaggttatctttgataactccacagtgacctgg

SEQ ID NO: 17311 - DNA, 201 bp, Homo sapiens; identical to SEQ ID NO: 2919

SEQ ID NO: 17312 - DNA, 201 bp, Homo sapiens
ggcgcggcgactcacgcctataatcccagcactttgggaggctgagaagggggattgcttgaggccagaagttgaataccagtctgggcagcatagcaagrccctgcctctacaaaaaaaaaattttttttaattagccaggcttggtgacatgcatctgtagtctactcaagaagctgaggtgaggccaggcacggtggc

SEQ ID NO: 17313 - DNA, 201 bp, Homo sapiens; identical to SEQ ID NO: 2892

SEQ ID NO: 17314 - DNA, 201 bp, Homo sapiens; identical to SEQ ID NO: 2893

SEQ ID NO: 17315 - DNA, 201 bp, Homo sapiens
ctgaaatccagagattccctcagggccacatttgtccacctgactccagggtctcatcttcgtgtgttgctagtgtgattacctggggatgagaaatcctkctgggggagttgaggttaagaggatgaggactccaggtgctgtggctcacgcctgtaatcccagcactttgggaggccaaggcaggtggatcaggagttt

SEQ ID NO: 17316 - DNA, 201 bp, Homo sapiens
cggattcggaggctgcagtgagctatgattgcaccactgcgctccagtctgtgtgacagtgagaccctgtctcttacacacacacacacacacacacacayacatgcacacacacagagagagagaaattagaagatactgaattggcagaagagaagggaaatagaaattaaaatactgaataggggagcagtgaacagg

SEQ ID NO: 17317 - DNA, 201 bp, Homo sapiens
tctgtcccggtgcagacaagggcatggcccccgccctccggcatctgtacaaggagctcatggggccatggaacaaggatgagatcagcaccacagacgcratcttcgtccagcgggatctgaagctggtccagggcttcatgccccacttcttcaggctgttccggagcacggtcaagcaagtggacttttcagaggtgg

SEQ ID NO: 17318 - DNA, 201 bp, Homo sapiens
catgaattgacactctgtttctatcccttttccccttgtgtctgtgtctggaggaagaggataaaggacaagctgccccaagtcctagcgggcagctcgargaagtgaaacttacacgttggtctcctgtttccttaccaagcttttaccatggtaacccctggtcccgttcagccaccaccaccccacccagcacacctc

SEQ ID NO: 17319 - DNA, 201 bp, Homo sapiens; identical to SEQ ID NO: 2870

SEQ ID NO: 17320 - DNA, 201 bp, Homo sapiens
acacacgtacacacacagagcagcacacacacacacacacacatgcctcagcaagtcccagagagggaggtgtcgagggggacccgctggctgttcagacrgactcccagagccagtgagtgggtggggctggaacatgagttcatctatttcctgcccacatctggtataaaaggaggcagtggcccacagaggagcaca

SEQ ID NO: 17321 - DNA, 201 bp, Homo sapiens; identical to SEQ ID NO: 2873

SEQ ID NO: 17322 - DNA, 201 bp, Homo sapiens; identical to SEQ ID NO: 2875

SEQ ID NO: 17323 - DNA, 201 bp, Homo sapiens
aacccgggagggggaggttgcagtgagccgagatcatgccattgcactccagcctgggcgacagagtgagactccttctcaaaacaaacaaacaaacaaamaaaatacagaagctgaggcgggaggaacatttgaaccggattcggaggctgcagtgagctatgattgcaccactgcgctccagtctgtgtgacagtgaga

SEQ ID NO: 17324 - DNA, 201 bp, Homo sapiens
acatcgcgccattgcactccagcctgggagacaagagcaaaactccaactcaaaaaaaaaaaaaaaaaaaaaacaggaagaaaatatttagggttcataayttaagaacagagaaaaatattctagcccaaagaaagggttgggatctgagacttttgaagaaaggaaggagatacagaaaagagatttcatcctggaatg

SEQ ID NO: 17325 - DNA, 201 bp, Homo sapiens; identical to SEQ ID NO: 2878

SEQ ID NO: 17326 - DNA, 201 bp, Homo sapiens
atcacttgagcccgggaggtggaggttgcagtgagccgaacgaaattgagccacttcaccccagcctgggcaaaagagtgaaattccattcaaaaaaaaaaaaaaaaaaaaaggatgaggactgggatgaactggtggctgggtgtggggaaaatggaagtgaaggaaggccaaaagagacagagaaggcctggcgcggcg

SEQ ID NO: 17327 - DNA, 201 bp, Homo sapiens
tctattaaaaatacaaaaattagccagccgtggtagcgagcgcctatgatcccagctactccggaggctgaggccagagaatcacatgaacctgggaggtsgaggctgcagtgagccgagatcacgccactgcactccagcctgggggacagagcaagaatctgtttcaaaaaaaaaaaaagaaaaataggaaggaaggaa

SEQ ID NO: 17328 - DNA, 201 bp, Homo sapiens
gacctgtcaaaaaaaaaaaaagaaagagagagagagagagaagagagagaaagaaagaagaagaaagaaagaaagagagagagagaaagaaagaaagaaasaaagaaacaaagaaacaaagaaagaaaggaaaagaaaaaaaaaactaaggccaggcaaggtggcttatgactgtaatttcagcactttggaagattgagg

SEQ ID NO: 17329 - DNA, 201 bp, Homo sapiens
gaggtagaggttgcagtgaactgagaccacaccattgcactccagcctgggcaagaagagcgaaactttgtctcaaaaaaaaaaaaaaaaaaaaaaaaaaattggcggggcatggtggtgcacacctgtagtcccaactagcaactcctcaggaggctgagatgggaggatctcttgagcctgggaggtcgaaatgcagtg

SEQ ID NO: 17330 - DNA, 201 bp, Homo sapiens
gttcgagaccagcctggccaacatggtgaaaccctgtctctgtcaaaaatacaaaaaattagccaggtgtgttggcgcgtgcctataatcccagctgctcrggaggatgaggttcaaagaatcacttgaacccgggaggcagaggctgcagtgagctgagatcatgccactgcactccagcctgggtgacagagcaagact

SEQ ID NO: 17331 - DNA, 201 bp, Homo sapiens
ggaggtagaggttgcagtgaactgagaccacaccattgcactccagcctgggcaagaagagcgaaactttgtctcaaaaaaaaaaaaaaaaaaaaaaaaaaattggcggggcatggtggtgcacacctgtagtcccaactagcaactcctcaggaggctgagatgggaggatctcttgagcctgggaggtcgaaatgcagt

SEQ ID NO: 17332 - DNA, 201 bp, Homo sapiens; identical to SEQ ID NO: 2939

SEQ ID NO: 17333 - DNA, 201 bp, Homo sapiens; identical to SEQ ID NO: 2885

SEQ ID NO: 17334 - DNA, 201 bp, Homo sapiens; identical to SEQ ID NO: 2887

SEQ ID NO: 17335 - DNA, 201 bp, Homo sapiens; identical to SEQ ID NO: 2945

SEQ ID NO: 17336 - DNA, 201 bp, Homo sapiens
gagccatttccaacgaaccatcttgtcgtcttcacagctgagttcaccacgcccgatggccattactacgacatcctggaactgccctaccacggggacamcctcagcatgttcattgctgccccttatgaaaaagaggtgcctctctctgccctcaccaacattctgagtgcccagctcatcagccactggaaaggcaac

SEQ ID NO: 17337 - DNA, 201 bp, Homo sapiens
ccattgcactccagcctgggcgacagagtgagactccttctcaaaacaaacaaacaaacaaacaaaatacagaagctgaggcgggaggaacatttgaaccrgattcggaggctgcagtgagctatgattgcaccactgcgctccagtctgtgtgacagtgagaccctgtctcttacacacacacacacacacacacacaca

SEQ ID NO: 17338 - DNA, 201 bp, Homo sapiens
gccattgcactccagcctgggcgacagagtgagactccttctcaaaacaaacaaacaaacaaacaaaatacagaagctgaggcgggaggaacatttgaacyggattcggaggctgcagtgagctatgattgcaccactgcgctccagtctgtgtgacagtgagaccctgtctcttacacacacacacacacacacacacac

SEQ ID NO: 17339 - DNA, 201 bp, Homo sapiens; identical to SEQ ID NO: 2949

SEQ ID NO: 17340 - DNA, 201 bp, Homo sapiens; identical to SEQ ID NO: 2950

SEQ ID NO: 17341 - DNA, 201 bp, Homo sapiens
taattttcttataaatttgggtctgtgatctgttttgagttcatttttgtgtatggtgtaaggtaggggtctgaatccattcttttgcctgttgataacargtcggtctagcaccatttgttgaaaggactgttctttccctgattatattggtagcctgtagtattggtttttatatactattacaattttgggaaaatt

SEQ ID NO: 17342 - DNA, 201 bp, Homo sapiens
atttccctgtaagctgaattactcatttaaaaattttaacttctatatgggacccgaattagacactgctgaatcctgtacagccttactcataaataaartacttactgaatttccaccattcaaattcatttttcaggtgtgttgactctcacattagaaactgctcaactgataaagactttcatgttatttcactgc

SEQ ID NO: 17343 - DNA, 201 bp, Homo sapiens
cgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtt

SEQ ID NO: 17344 - DNA, 201 bp, Homo sapiens
ttcatttgtttgttttttgagacggtgtctcactcagtcgcccaggctggcgggcagtggcacgatctcggctcactgtaacctccacctcccgggttcaracgattctcatgcctcagtctcccaagtagttgggattacaggcgcatgctaccacgcccagctaatttttgtatttttagtagagatggggttttgcca

SEQ ID NO: 17345 - DNA, 201 bp, Homo sapiens
cttgaacccaggaggcagagggtgcagtgagctgagatctcaccattgcactccagcctgggcaacagagcgagactccgtctcaaaaaaaaaaaagaatraatcacaagaaatggttccttcactgttatactttaacatgatacagctttttaatgttttattttttgagagagagtctcactgtgttgcccaggctgg

SEQ ID NO: 17346 - DNA, 201 bp, Homo sapiens
ctttttgtttagaattcccacagctgctgctgctgctgcttttttttttttttaagagagaggagggaggcaggtctcatggtttcccttctcagtgtttrtgtcaaccattcatcagtcatctttgaaagaacctagtaacactcatttttcatcttgctgtattttttcccttctaggtgaggaaaatagcagctgaat

SEQ ID NO: 17347 - DNA, 201 bp, Homo sapiens
tacatgttcttaaagggtcatgaaacttactcatattatgggcctctgaatttacttaccttcaatgtgggttatcataatgaacatcatgatttccccarcattcctggaaaaagtcttccactggtaagtaaaggatttgatacatattctaattttgttttttcatttgtttgttttttgagacggtgtctcactcag

SEQ ID NO: 17348 - DNA, 201 bp, Homo sapiens
ttttatcaatgccttatctacatgttacataggaataatctagcgtcctacctgtgtaaaaaccaactctggaatactgaaactgagctacttaatattckgaaaatcaggacgggtgtggtggcttttttttgcctgtaatccgagcactttgagaagctgaggcaagaagatcgcttgaggccagttcagaacagcccc

SEQ ID NO: 17349 - DNA, 201 bp, Homo sapiens
tgagacggtgtctcactcagtcgcccaggctggcgggcagtggcacgatctcggctcactgtaacctccacctcccgggttcaaacgattctcatgcctcrgtctcccaagtagttgggattacaggcgcatgctaccacgcccagctaatttttgtatttttagtagagatggggttttgccatgttggccaggctagta

SEQ ID NO: 17350 - DNA, 201 bp, Homo sapiens
tcactgtaacctccacctcccgggttcaaacgattctcatgcctcagtctcccaagtagttgggattacaggcgcatgctaccacgcccagctaatttttktatttttagtagagatggggttttgccatgttggccaggctagtattttgtcagtccaagcagttcattaaaaaaaaaaaaaacaaaaagagcaagaata

SEQ ID NO: 17351 - DNA, 201 bp, Homo sapiens
agatcttttcgctagaagattcctgtgccctcaggtgggcgccctttcctctcaccactccctctcctccggagcgggccgaggtgagcgggtgccggccytggggctgcctgagtgctaggcagggtgtggtcctgggcatccttgggcctaccagcgagccctgctcagggtgtcgggcgccggcgggcagtactggcg

SEQ ID NO: 17352 - DNA, 201 bp, Homo sapiens
ggcctcaggcagtctttgtgcctcagcctcccaaagtgctggattaatggtgtgagccacagcacctggccaatagctttattgagattataattcaactrtcatgatttattcatttaaagtgtacagttcagtattttttagtatattcacagagttgtgcagctgtcaccaccatataaccttagaacatttcatcat

SEQ ID NO: 17353 - DNA, 201 bp, Homo sapiens; identical to SEQ ID NO: 2953

SEQ ID NO: 17354 - DNA, 201 bp, Homo sapiens; identical to SEQ ID NO: 2954

SEQ ID NO: 17355 - DNA, 201 bp, Homo sapiens; identical to SEQ ID NO: 2955

SEQ ID NO: 17356 - DNA, 201 bp, Homo sapiens; identical to SEQ ID NO: 2956

SEQ ID NO: 17357 - DNA, 201 bp, Homo sapiens
atgaaaatatatttccctgtaagctgaattactcatttaaaaattttaacttctatatgggacccgaattagacactgctgaatcctgtacagccttactyataaataaagtacttactgaatttccaccattcaaattcatttttcaggtgtgttgactctcacattagaaactgctcaactgataaagactttcatgtt

SEQ ID NO: 17358 - DNA, 201 bp, Homo sapiens
gactaaatgctagggggattctaatgcgcattcggttgcctcttccagagcacgtgtttgttttttgtttgtttgttttttgagactgcacgtgtttgtttgtttgtttgtttgtttgttttttgagactgagtctcactctgttgctcatgctggagtgcagtggcgcgatctccactcgctgcaacctctgcctcctgg

SEQ ID NO: 17359 - DNA, 201 bp, Homo sapiens
actaaatgctagggggattctaatgcgcattcggttgcctcttccagagcacgtgtttgttttttgtttgtttgttttttgagactgcacgtgtttgtttgtttgtttgtttgtttgttttttgagactgagtctcactctgttgctcatgctggagtgcagtggcgcgatctccactcgctgcaacctctgcctcctggg

SEQ ID NO: 17360 - DNA, 201 bp, Homo sapiens
aggcctgtaatcctagcacttcgggaggctgaggcgggaggatcgcttcagcccagaagtttgagaccatcctgagtaacatagtgagagccccccgtttmcacacacacacacacacacacacacacacacacactttttttaaattgaggaaacggtgagttgaacatgagcaattattccttatatatagtatttcct

SEQ ID NO: 17361 - DNA, 201 bp, Homo sapiens
tgtctcactcagtcgcccaggctggcgggcagtggcacgatctcggctcactgtaacctccacctcccgggttcaaacgattctcatgcctcagtctcccragtagttgggattacaggcgcatgctaccacgcccagctaatttttgtatttttagtagagatggggttttgccatgttggccaggctagtattttgtca

SEQ ID NO: 17362 - DNA, 201 bp, Homo sapiens
ttctaggagagagatatgcctgccaagtgaaaaataagcatgtgatggggtatctgggctaagtaatagaaggaaaataaagcagggtaaagggataataragtgatggtttgaggaaggggtagtatttttgggatggcctctctaataatcggacatctgaacagagatgaatgaagtgcagggggaggccactctgtc

SEQ ID NO: 17363 - DNA, 201 bp, Homo sapiens; identical to SEQ ID NO: 2972

SEQ ID NO: 17364 - DNA, 201 bp, Homo sapiens; identical to SEQ ID NO: 2973

SEQ ID NO: 17365 - DNA, 201 bp, Homo sapiens
  misc_feature (1)...(201): n = A,T,C or G, or insertion/deletion polymorphism (see Tables 1-2)
tatcatttgcctttaagtgggccctatgctttcatttctgcagtttcgcaaagtttttacatatataaaatgttttacattctatacgtaaaatatttaantatataaatcttgaagagtcgaactaaaaactaaaattattttttgcatattctgctatttcctttaggccctcacattcttagtcctgtttctactgtt

SEQ ID NO: 17366 - DNA, 201 bp, Homo sapiens; identical to SEQ ID NO: 2964

SEQ ID NO: 17367 - DNA, 201 bp, Homo sapiens; identical to SEQ ID NO: 2965

SEQ ID NO: 17368 - DNA, 201 bp, Homo sapiens
gtggggagactaattcgtagggcgaccatacttctcagttttcctggaatagttcaaaattctgcccctttcccccccatttcctaatttttagtaacacktctttcactatgtgtccaagtttggatgataaatttcatggtcaccctacttgatgtccagaattcaccagggcttcgtgaagaagatggagaggagtta

SEQ ID NO: 17369 - DNA, 201 bp, Homo sapiens
tttcctggaatagttcaaaattctgcccctttcccccccatttcctaatttttagtaacacttctttcactatgtgtccaagtttggatgataaatttcayggtcaccctacttgatgtccagaattcaccagggcttcgtgaagaagatggagaggagttattacccaacactatcaacaagaacaggccctttgacact

SEQ ID NO: 17370 - DNA, 201 bp, Homo sapiens
gctcgccaccacgcctggctaattttttgtatttttagtaaagacggggtttcaccgtgttagccaggatggtctcgatctcttgaccacgtgatccaccygcctcggtctcccaaagtgttgggattacaggcatgagccaccatgcccagcctgtttatctttgttaagccgtaatatatgtgcgattattaatttttt

SEQ ID NO: 17371 - DNA, 201 bp, Homo sapiens
tgatgggttaaccactcaatgggcttgctgtttctttatcagctcagttgtacttgcctgagaaatctgaaaagaaatgagaaggaaagtcataagcaacyggtgaaggaaatcagaaagaagagctttagttatgcaggggcatgaggccttgttcctgttcttcaaatggaactgaattttcatggaaggttttgatac

SEQ ID NO: 17372 - DNA, 201 bp, Homo sapiens
ttagcagttcactttaaactaagcaagaaactgcattccagttctgttttctcaaagtaaatccgttatatccgttgtaacagaatatcgggggaggaggaaggaaggaaggaaggaaggaagtaaagaaagaaggaaggaaaaggaagggaagggaagggaaaaagaagggaaaggaaaggaaggaaggaaggaaaaaag

SEQ ID NO: 17373 - DNA, 201 bp, Homo sapiens
gtctagcttaaaattgatttttaggaaagtgaagtagatgagaaggaaaggctggcctgtgtacaattctagaggcctacaattttcttactagccccccytaaagtctttcaaccctctcagcctttcttatttctcttcctcttcctcctttcctttgttctgcttctacttcctcctcttcctcgtagaggtcaggca

SEQ ID NO: 17374 - DNA, 201 bp, Homo sapiens
cagttcactttaaactaagcaagaaactgcattccagttctgttttctcaaagtaaatccgttatatccgttgtaacagaatatcgggggaggaggaaggaaggaaggaaggaaggaagtaaagaaagaaggaaggaaaaggaagggaagggaagggaaaaagaagggaaaggaaaggaaggaaggaaggaaaaaaggaca

SEQ ID NO: 17375 - DNA, 201 bp, Homo sapiens; identical to SEQ ID NO: 2966

SEQ ID NO: 17376 - DNA, 201 bp, Homo sapiens
tcaaaatgacttcaatcactttatgaaattatgcatatccagggacttataaaccagctgcctaaaagtaaatctagatttactgctctatgattgaaacygaagcagcaattactctcgcagattgtggaagaaaggatttggagtgatttaacctggtaacagattaattttgggatggagatatatgatcattaaaat

SEQ ID NO: 17377 - DNA, 201 bp, Homo sapiens
ttaccttccaaacacattttaagggaaatgtaatatcagctattattgctttacctcaaaatgctttatcataatagctggcaagagactgaggaaatgcwacaaacgataaccgtgttttgtgttagaagcggtaatgaaatggtaagacagtcttggatggggtataaagtagagaagaagtgagtaagatcaggactt

SEQ ID NO: 17378 - DNA, 201 bp, Homo sapiens
ttactgaactcttctaagtcttaatttcttgacctagaatctagtaatagaaaaattcccacttcacatgattgaaaaataacaagataataaggcataakgcctgccacagtaagtgctcatgtaaccttaggtattattattttattacaaatcaaagaatttttataaaaacttggagtatttattacaaataaaagt

SEQ ID NO: 17379 - DNA, 201 bp, Homo sapiens
aacatacgactatacaggaaaacaaactctggaagaaatatttgccagatggatatgacaaaacatttatgtttgtatggacataaagatggcaacaatarccattggagactaccaggcggggaaagtgaaagggggccgtggattgaaaaactacttattgggtattatgttcactgcatgggtgatgggatcatttgc

SEQ ID NO: 17380 - DNA, 201 bp, Homo sapiens
aaagtagagaagaagtgagtaagatcaggacttcaggcttctggtaggttgttggtgatgatgttgggggtaagatggctagccaagaaggcaagcaagtaaaaaacaaatgaggagcatcatacttgcctactttataagtttttttttttttaagttagagtttgacatcttggtatgataacttattttataaaatct

SEQ ID NO: 17381 - DNA, 201 bp, Homo sapiens
aacagggtaagggagatacatggagtgaagggagacaagagtcatggggagtgtgttattttatgcaggatagttaggaagggcctctctgataagatgtsttttgaacagaaaccagaaaaaaaatttctttcttgaaatagcttttgagatagaggaaaagcatatacagaaggcatgaagcaggcacgtgtttgttgt

SEQ ID NO: 17382 - DNA, 201 bp, Homo sapiens
ttgcttgagaccaggaaatcaaggctgaagtgggccacgttcacactgctgccctccagcctgggtgacacagcgagaccctgcctgaaaaaaaaaaaaaragagagaaaaagagacaaataaaataataatttatatgaagattaaatgctatttttcttattgcataattttttccacttattattatttctaagaaag

SEQ ID NO: 17383 - DNA, 201 bp, Homo sapiens; identical to SEQ ID NO: 2975

SEQ ID NO: 17384 - DNA, 201 bp, Homo sapiens
gcacaataaccatgggttggggtacctgtggaagggctggcttcgggaaagggacaacttctaggtatcttcttccccacctcatatttttgctgcccaagtgtttcagaaatccaagagaataattacagggctgttatagcactagacttcatgtttgattattactgactaaagtgaatcttttacaaaagatttcac

SEQ ID NO: 17385 - DNA, 201 bp, Homo sapiens
aaggaaaaggataagagtaagctttgggaagaaagcactgctcaggtgaaggacaaaaaggcaggtctccctgggttggaggaaggtggtaagtatggcckttgagttgagctgccatcatcctcatgcatggaagctgattttggtcattgcactatgccaaagcttgggaaatactactgtgacaatgctttagggatt

SEQ ID NO: 17386 - DNA, 201 bp, Homo sapiens
taatggattgttgaagaaaaaccccaaaagtactataaaagtgtcatcactttatgttagttaaaaaatataccacacaaggttagaatttttaatttgcygcagatactacaaagtgtcatttttcagcagactggagtgttttgagtttgtctattgatatcagttgtgtttgcatgcaatgtcaatcatttaggcttg

SEQ ID NO: 17387 - DNA, 201 bp, Homo sapiens
agaatctaccatatccactaacttaatttttcactctgcatgctggcattggtttctacctggccaatgaacatgctctcaaaagatgtggctcatacttmgcaaaaacaatgacttactcatcattctgaaacacttggggggcaggatttgattttcggatgttaaaatgtattactgggatacattctacctgttcat

SEQ ID NO: 17388 - DNA, 201 bp, Homo sapiens
acacatacacccacccacccacccacacacacacacagacacacgcgcattcatatatatacatacacacatatatatgcaggcacatctcattttattgtgctcactttattgtgcaagctttgcaaatatagcactttttataaattaaaagtttgtggcaaccctgcaccaaagtctatcagcatcatttttccaaca

SEQ ID NO: 17389 - DNA, 201 bp, Homo sapiens
gcaccatgcactcactacaccttcacgatgaactctatcatattatgcaagagccccctttttcctgccccatcattctttaatttttccagagcaagcaycatgctgacttccctgtgaactatgtccctgcttttctttagagttctatcgcttatatgcataaaacttcagaaataagctcaaacctagcattgtaat

SEQ ID NO: 17390 - DNA, 201 bp, Homo sapiens
gggataacggtggatagcaattttttggtgtgtgcatgattacagaaattataggtaggtagataggtatagatatattaatatatattgctatattacamagatacatatacatatgttatttttatgtatagatggaaacatactatacattttgttctgagacttgcttttttcacttaacactgtatcttgaatgtc

SEQ ID NO: 17391 - DNA, 201 bp, Homo sapiens
tatattgtacttagatccctgactggaactgtaggtagaaatgaaagagggctgagagaatgtgtaaatgaccatgtcccacatttgtatggtatttaatyatttttcagttagaataaaagctgttattatgttaaagaataatctatgttacaaataaatctgtgggctaaaaatcatatacaattaatgatgttttat

SEQ ID NO: 17392 - DNA, 201 bp, Homo sapiens
tatgataaatgggaaatcactccaactatttgaatagaagactaaagatgatgataatttttgccagattaaatccaaaatttgttgtagaacatctgcamatcctaacaataatagtttgggatttgaaaaaaattcattaatttggaagaaatagtactgagtaatgtgaaattctttgcaataacagaaataacatac

SEQ ID NO: 17393 - DNA, 201 bp, Homo sapiens
gcatctttatatttgtttacatttctcttgattgtaaatggcaccatgcatggtctgttaagagtatgtgtaagttttcataaatcttaactttttataayagatttgtgtgtattttatggtagtaaatgataaaacagactagcatctacatatattttatgcattcataacatacatttttcttatttttcaaaatat

SEQ ID NO: 17394 - DNA, 201 bp, Homo sapiens
tttcactatgtgtccaagtttggatgataaatttcatggtcaccctacttgatgtccagaattcaccagggcttcgtgaagaagatggagaggagttattrcccaacactatcaacaagaacaggccctttgacactatactgtttgtgtgggcatggataaaagagatttcagtgaaaacttagtatatcaattcaatgc

SEQ ID NO: 17395 - DNA, 201 bp, Homo sapiens
gaaacatgaaataaattttaagactttaatatattttatttaatcaagtatatctaaaatatcatttccacctgtaatcaatatgaaaaattttaattaagtatgatgtattttcttatactatgtctttgatattcaatgaatattttatacttacagcaaatgagctacctttcaaatgcccagcatccaaatgggaga

SEQ ID NO: 17396 - DNA, 201 bp, Homo sapiens
gtataatgattgtgttgctaaaggcccatgtgagtaccagaaacacatgcagaagacagacatattatgctgctacagaaaataatgagttcagggccagktgcagtggcccacacctgtaatcccaacactttgggagtttgagatccaagagttgaaaccagccagggcaacatggaaagaccctgtctctactaacaa

SEQ ID NO: 17397 - DNA, 201 bp, Homo sapiens
gctcaaggtaagactttttactaaagactcaatttgtgatgactaaatctagatatagtagcttatcatctgggagtgagaatcatcagttcacactgtawaatgattgtgttgctaaaggcccatgtgagtaccagaaacacatgcagaagacagacatattatgctgctacagaaaataatgagttcagggccaggtgc

SEQ ID NO: 17398 - DNA, 201 bp, Homo sapiens
acagtcttggatggggtataaagtagagaagaagtgagtaagatcaggacttcaggcttctggtaggttgttggtgatgatgttgggggtaagatggctasccaagaaggcaagcaagtaaaaaacaaatgaggagcatcatacttgcctactttataagtttttttttttttaagttagagtttgacatcttggtatgat

SEQ ID NO: 17399 - DNA, 201 bp, Homo sapiens
gtcaaaaatattcttgaaattttttgtatgaataacaatttctaagaaaattccacataaaatcacaaaatatgcacacatatatattgtacttagatccmtgactggaactgtaggtagaaatgaaagagggctgagagaatgtgtaaatgaccatgtcccacatttgtatggtatttaatcatttttcagttagaataa

SEQ ID NO: 17400 - DNA, 201 bp, Homo sapiens
tcttgaccacgtgatccacccgcctcggtctcccaaagtgttgggattacaggcatgagccaccatgcccagcctgtttatctttgttaagccgtaatatrtgtgcgattattaattttttattaacaaataatacacatggaataatatttagacaatagagaaaagtaattttgaaaaattactcataggtttatcaca

SEQ ID NO: 17401 - DNA, 201 bp, Homo sapiens
gacctcacgcaatgagtgcagatcttttctttgccaaaacaagcaaaagcaggttcttatagcatcactaccagaagggaatacatgaacaaatggaattsggtaggaggcatagctgtttatcaacatgcttccaagataatttttccctcctaatgacaaagcaaatttacatacgtgctctcaaagttttttttaata

SEQ ID NO: 17402 - DNA, 201 bp, Homo sapiens
tattattaattgctaacataatttttacaattaaaccaattgctttacagaacaacaacaatgtcatcacttttattttttgtagatatgaaaactgcttyatcaacctcatccagaagtcacccttattctagtgacagtgaggatgaatctgcagtgggggacagggaagcccacactgacagcagcacagatgaaagt

SEQ ID NO: 17403 - DNA, 201 bp, Homo sapiens
caaactaggcactgtgcacacactgtctcattttatcctcaccattcaacatgataggtattattactacttcaattttacaggctgggaaattgaggctyagatacacaaaaagaaagtagcagaataagaatttgcacccaggtttgtctaattccaaagctcaatctttcaaacactatacaaccttctattctgtac

SEQ ID NO: 17404 - DNA, 201 bp, Homo sapiens
ctaaagcagcaataacaacaataatgaaagtgccaagcactgagcaccaaactaggcactgtgcacacactgtctcattttatcctcaccattcaacatgrtaggtattattactacttcaattttacaggctgggaaattgaggcttagatacacaaaaagaaagtagcagaataagaatttgcacccaggtttgtctaa

SEQ ID NO: 17405 - DNA, 201 bp, Homo sapiens
gttaatcgtataaggcctatatggcctgatacacccatctcatcttgggaatgggctagccaaaggtaccagaaaactcaaaggtctttggctaaaatccyctgtatcctccagcagtaactttgccattaggactagaaatactcaaagtccaatgagtaggatttcctctcccctagatagtacttggatgggtgcttt

SEQ ID NO: 17406 - DNA, 201 bp, Homo sapiens
aatacattcaaaatgaaattaattttaatttatttaaaaaataccagtcccagaaacatttgtgatgagaaaaaggagggcatggtacaataaaacaacakagaattatatttctaaatgattaggaattacctgtttaaggtcctcagaaaacaagaaaagctgagcagtggtcacttccaaagtgtaaggttccacaac

SEQ ID NO: 17407 - DNA, 201 bp, Homo sapiens
tcttttgttgtagctgtggctgtttcgtttgtctttgaaatgtgatgatcaaaattttcaaaaatacccattaaatgttacccagctgtgttacatgtggkgtgcccctgacctccttcctttgctgttttgtatggagtcctgtgtcacctaccttagaggaaggcagacctagccccagaaaggttaaaggttctggct

SEQ ID NO: 17408 - DNA, 201 bp, Homo sapiens
ttttgtatggagtcctgtgtcacctaccttagaggaaggcagacctagccccagaaaggttaaaggttctggctgcagagatgaggagagagaatgagtayatgtcaatgtgagttagagactctattgacttctgcagagaccattttcaccaaatagaattttacctattttaaaagtttttgaatgtactgtttttta

SEQ ID NO: 17409 - DNA, 201 bp, Homo sapiens
atatgtcaatgtgagttagagactctattgacttctgcagagaccattttcaccaaatagaattttacctattttaaaagtttttgaatgtactgtttttyatgaaattgatgaattgctttgacatcaggtaggtacaacctatatgattatatggtgatagagtatgccataactaaaggcagttgactataggcttag

SEQ ID NO: 17410 - DNA, 201 bp, Homo sapiens
aaaagttcctgaaggaagttaagagtgctacttcaagtgaacatgtgcatgataaaaaagaaatcgttattgctgatatatagagtattttagcggtctcratagaagatctaactagccacaacattctcataagccaaagcttaagtcagagcaaggccctaattctcttcaattctatgaaggctgagagaggtgaag

SEQ ID NO: 17411 - DNA, 201 bp, Homo sapiens
aaagcccagctcctgcctaatataaattacatcctaatatagcttacatgtcagaagtgcccatgggatcaggttgagattgagatggggcttgaaatatytcccttgattgatttctgcccttccttcccttgcttctgctactcccttaagagttctcctggagcacatcttaaatacttttctcacacatgaatcttc

SEQ ID NO: 17412 - DNA, 201 bp, Homo sapiens
aacagaagactttctttaaatgtttttataactgactttttagtatactttcatgcaggaatttgaatagcaacagatacactattaaagagacttgacayacattattgtttcctattgtttcaatttaattttgtttcaaatacggtaataatctgtaatgaaataaaatggaccatattctctcaggtgaattggcta

SEQ ID NO: 17413 - DNA, 201 bp, Homo sapiens
ggatggtaaacaacaagctaattaaattctctagaagaaggcaaatgggatgggagaacagaagaaattatgtaaaagattttagaaagcatgtcgctggyttattcgtatcaaaaacatgagtagatgacacaaaggtggtgtgctttgagctataatgacagtttggaaggtttgtggttaacagaaagctaatactta

SEQ ID NO: 17414 - DNA, 201 bp, Homo sapiens; identical to SEQ ID NO: 2976

SEQ ID NO: 17415 - DNA, 201 bp, Homo sapiens
caaggcgaaaccccgtctctactaaaaatacaatatatatatgtgtatatatatatagctggccatggtggtgtgtgcctgtaatcccagctactcgggargctgaggcacgagaatagcttgaacccaggaggcagaggttgcagtgagccgagattgcatcactgtactccagcctgggcgacagaacaagaatccttc

SEQ ID NO: 17416 - DNA, 201 bp, Homo sapiens
gaaggtattggcagggacacactccctgaaaagccccaagaagcattcttcttaactctgtcaactggccttccttggcctgtggttccgtcacttcaatwtctgcctctgtgttcacatgctattcttgtgtgtctgtgtgtgtcctcacctctttttataaggacatcagccattggattgagggccaaacttaaatcc

SEQ ID NO: 17417 - DNA, 201 bp, Homo sapiens
aaccttatttttatagcaccaacaatgaatttcatggtggatgaaacagcagcaatcaactcaaacaaggaatcccagcaattggtgcaaaaaacgtatayactggagaagaaagaagcaatggaggaagatgaagcgccccagcacagagatgctgacatagtacagggaaaaggggaggcagcactgtggggagaagca

SEQ ID NO: 17418 - DNA, 201 bp, Homo sapiens
agaagactttctttaaatgtttttataactgactttttagtatactttcatgcaggaatttgaatagcaacagatacactattaaagagacttgacatacrttattgtttcctattgtttcaatttaattttgtttcaaatacggtaataatctgtaatgaaataaaatggaccatattctctcaggtgaattggctatat

SEQ ID NO: 17419 - DNA, 201 bp, Homo sapiens
tgtaggaaacctgcatatgtaccccctgaatctaaaataaaggctggaaaaaatgattgatgtctgtaatacataaagagttcttacaaatcaatgaaaargcaaacatcataacagaagaatgtacattgtatagcaggaaattcacaaaaggaaagcttgctactaatattgacagctctatccttgccaccacttttc

SEQ ID NO: 17420 - DNA, 201 bp, Homo sapiens
tcatacctcctttttaaaagaacatttagaaatatgtataaaaagcttctaaaaattcatagcaattcatattccaggaatgtgtcctaagggaatagtcwgaaatatgtgcaaaaatgattataagtagtgtttaaaatagctttataatcacaattgaaatagctcaatatttaacaatagacattgatgaaccgaaat

SEQ ID NO: 17421 - DNA, 201 bp, Homo sapiens
acatcattacctaggaagaaccttcagaaatcctctgcaaaagacggcctgtttccacccttcctattcttgtttcttccttctgccactttttttttttytttcaactaaggaatagaatggccagaagtagttgacaggccctaaggagagcttcacagctaacatcaggtataaatttattattattttttgaatata

SEQ ID NO: 17422 - DNA, 201 bp, Homo sapiens
catgatgcctattcctcctccacttcccccaactgggaaaatcacaagagaaaatagatctgaaacatggagaaggagaagatttcgtccaaccactgctscaaatggcttagaacctcttttgacaaaggtgattatggaacaaatttttcttttattaatttatctcagattacattgcactattagatttctaggttt

SEQ ID NO: 17423 - DNA, 201 bp, Homo sapiens
ggataagcgcaaagacaggtattttttatcttaaactctgcattagctgctacagccatcggtacagctgccaaatggaactgaaagaaataaagaaacaraaaaaagagtaaggagtacagagaaaacaaaaaaataggcagcatttaaatgtaggatgttttatttggaagtataaaaaaaacaattacagacctagac

SEQ ID NO: 17424 - DNA, 201 bp, Homo sapiens; identical to SEQ ID NO: 2963

SEQ ID NO: 17425 - DNA, 201 bp, Homo sapiens
ttattttaatcttactggtgaggagatcctttttgtcatattactttttgtcttaaaatctattttgtctaataatacttcttattttctttagtgtgtckgtgtgtgtgtgtgtgtgtactgtatatggagagttgacacttgaataacatggggggaaggggtgtcatttctctgcacagtcgaaaatttgtatataaa

SEQ ID NO: 17426 - DNA, 201 bp, Homo sapiens
aactgtcagtgaacaataaataattaactgtacaaatactataattataatcatatataatgctttctaatattttacattctaaaatatttaagactgtrttgtggatagactagcacattctacacacccccatctctgttttatgggtgaaaattctgaaaggcaacaaagttaaatgactcaccaagatacactcac

SEQ ID NO: 17427 - DNA, 201 bp, Homo sapiens
agaaatactcaaagtccaatgagtaggatttcctctcccctagatagtacttggatgggtgctttccatgcttgccaaggtgattatattattttttaagktccataattattaatgctactttgatcaatactttgtttcattagacatgtgaacaccatcaatcaggtattatttaagctctgctggctggggagcaat

SEQ ID NO: 17428 - DNA, 201 bp, Homo sapiens
tattttaatcttactggtgaggagatcctttttgtcatattactttttgtcttaaaatctattttgtctaataatacttcttattttctttagtgtgtctgtgtgtgtgtgtgtgtgtactgtatatggagagttgacacttgaataacatggggggaaggggtgtcatttctctgcacagtcgaaaatttgtatataaac

SEQ ID NO: 17429 - DNA, 201 bp, Homo sapiens
ctgtgcagctttctcactgacttctactctgttttatcccaatagctttcagtcagcactcaaaactgaagcagttcattgtgctttgacttatattaackgtttttaatttttttcttttttaagagacagtctctctctcacccagactagagtgcagtgccacaatcatagtcactatagccttgaactcctagggta

SEQ ID NO: 17430 - DNA, 201 bp, Homo sapiens
tatagcttacatgtcagaagtgcccatgggatcaggttgagattgagatggggcttgaaatatctcccttgattgatttctgcccttccttcccttgcttmtgctactcccttaagagttctcctggagcacatcttaaatacttttctcacacatgaatcttcatctcagcttctgcttctgcagagctcaaaataagat

SEQ ID NO: 17431 - DNA, 201 bp, Homo sapiens
ttatgttagttaaaaaatataccacacaaggttagaatttttaatttgccgcagatactacaaagtgtcatttttcagcagactggagtgttttgagtttrtctattgatatcagttgtgtttgcatgcaatgtcaatcatttaggcttgtctttaaatttgggttacattgagtcactgattctgtttcactggttctta

SEQ ID NO: 17432 - DNA, 201 bp, Homo sapiens
ttgggaagaattgcctaaccatgtagaatgcagactgctttgagctttagtaatcataatcaacacctcaaattatattcagaagtcaaataggtagtcartgacgaggagagcacagatgttactcactttgtttgtccaattcccttcagcagatgggcaataaaaagtctgtgcatgcagtagggaggcatcaaagcc

SEQ ID NO: 17433 - DNA, 201 bp, Homo sapiens
ctttattcaacaaaatgcatataaaacatctatttgctggaaaatgtgatagatacaaatgaaaaaagaatgaggcttagctaaatgattctctggtagaygatgtacactctgtgatgagagtgaaaaaccaaaggttatgggaaaaagggtgtcacttgagtcagtgttattttgcatacatattgatgctgggatgtt

SEQ ID NO: 17434 - DNA, 201 bp, Homo sapiens
gattttacatattatttctattcttctgggactagcaagtcttgactgctttctgatccctttcacctgcccactataaattcagttctctggtagttgtrtcacatgcagagaggggaacgtgagtagttctagagaaagaagactgaagagactgataactaccagaaacatttttcagatcatggattttatccaggt

SEQ ID NO: 17435 - DNA, 201 bp, Homo sapiens
aatggcctcttgatatcacatataaatatctcacactgtaaataagtgtgatataagattatagtgtcccctcccttgttcgcttggattaaagtaatctygatttctaaccttatttttatagcaccaacaatgaatttcatggtggatgaaacagcagcaatcaactcaaacaaggaatcccagcaattggtgcaaaaa

SEQ ID NO: 17436 - DNA, 201 bp, Homo sapiens; identical to SEQ ID NO: 2968

SEQ ID NO: 17437 - DNA, 201 bp, Homo sapiens; identical to SEQ ID NO: 2970

SEQ ID NO: 17438 - DNA, 201 bp, Homo sapiens
catgaattttatattctaggagagagatatgcctgccaagtgaaaaataagcatgtgatggggtatctgggctaagtaatagaaggaaaataaagcagggkaaagggataatagagtgatggtttgaggaaggggtagtatttttgggatggcctctctaataatcggacatctgaacagagatgaatgaagtgcaggggg

SEQ ID NO: 17439 - DNA, 201 bp, Homo sapiens
tggctaaaatcctctgtatcctccagcagtaactttgccattaggactagaaatactcaaagtccaatgagtaggatttcctctcccctagatagtacttrgatgggtgctttccatgcttgccaaggtgattatattattttttaagttccataattattaatgctactttgatcaatactttgtttcattagacatgtg

SEQ ID NO: 17440 - DNA, 201 bp, Homo sapiens
ataattgtggcatttagttatgtagaggacttcaacaccatatgttttaacaaatactttgggtcataagggtatgtataatggaaggacataattaaagyttaatctgttcagtaaaaaggcaccattaattactctaggcaatttattgggttattaattggttctggaaacatgtcaagatactaatttaaatggaat

SEQ ID NO: 17441 - DNA, 201 bp, Homo sapiens
agagaaacatgaaataaattttaagactttaatatattttatttaatcaagtatatctaaaatatcatttccacctgtaatcaatatgaaaaattttaattaagtatgatgtattttcttatactatgtctttgatattcaatgaatattttatacttacagcaaatgagctacctttcaaatgcccagcatccaaatggg

SEQ ID NO: 17442 - DNA, 201 bp, Homo sapiens
gaaccacagaatgcttttaaggttccactcaggagtggcacatgtcacttacacttgaatgccatttggcaagcccttgaccaagactgacctcaatggartaggaagtatcagtctctcacagaaaagggcagcgaatatttggaacaataatagaatctaccatatccactaacttaatttttcactctgcatgctggc

SEQ ID NO: 17443 - DNA, 201 bp, Homo sapiens
gagaaacatgaaataaattttaagactttaatatattttatttaatcaagtatatctaaaatatcatttccacctgtaatcaatatgaaaaattttaattaagtatgatgtattttcttatactatgtctttgatattcaatgaatattttatacttacagcaaatgagctacctttcaaatgcccagcatccaaatggga

SEQ ID NO: 17444 - DNA, 201 bp, Homo sapiens
agtactataattgtgatataaataaagcacaatagaaacatagaggaaagaaatattagttttgaccgaggagattagagaatgcctcctagagaaggtgscatttgaaatgggctttgaatgatcagtaggaagttagcagatagaaccagggaactgagattgaaaagcagaaaggggaaaaaggaataagcaaaattc

SEQ ID NO: 17445 - DNA, 201 bp, Homo sapiens
agaaacatgaaataaattttaagactttaatatattttatttaatcaagtatatctaaaatatcatttccacctgtaatcaatatgaaaaattttaattaagtatgatgtattttcttatactatgtctttgatattcaatgaatattttatacttacagcaaatgagctacctttcaaatgcccagcatccaaatgggag

SEQ ID NO: 17446 - DNA, 201 bp, Homo sapiens
cacagcaagaccccatcttcaataatgttaataactcttacaccacaccatgcagagctacacaaggaagcaccagagtaggttaggaagcagagggagtrggggaggaaatgtgagcaggaacccttattatcatttctgtgggaaggaacaggtgagagagatcctgaaaatctagagctctgatgcctctgtaaggat

SEQ ID NO: 17447 - DNA, 201 bp, Homo sapiens
ttgaaaactacatatttaggtgctattttaaagttcctgtgaattctggattctgacttttccctatcaaaggttattgttgtttctggtttttccttcctttttttttttttgtttgttttttgttgttttttttagtaacttaccaaaattaaatctgtgaaatttagccttcatcatcctggtgcagagccagccatg

SEQ ID NO: 17448 - DNA, 201 bp, Homo sapiens
catataattcatgttactcttgaaattatttttttcagtttaactgtgcacatattaagtatcctaaaaagtcaatacgtgtatgaataacttattattgytaatagcaatatgaaagtttatggtatgccaatttattgttttgtgtactgatatttctgtatctttaggctagatttccttaagtatttgcttatgttt

SEQ ID NO: 17449 - DNA, 201 bp, Homo sapiens
ctcaataatcttatcattatcataatcatcatttttattaatgtatatattattatcattggaattcttattttaatatcaacttaagaaatagaaagctrtagaagacaatttattcatattacttttgttataattgatttaaaaagttttaatgtcataatgcattcagattatctgcatggttcaccagatttgact

SEQ ID NO: 17450 - DNA, 201 bp, Homo sapiens
gtttaaaacagacaatttggctactgattgcaataagagtatggcaatagtttctgagagagttatcagcagtcactgttagagtgaaccaatacctttawgaacatgtacagtggatctatttccctcatgcgaacggaggtggataattagtcaatctctgttttgagtgtgtattataggtagaagcaaggaccaagg

SEQ ID NO: 17451 - DNA, 201 bp, Homo sapiens
ttatttcatcacccaggtattaaacctagcacattatttatttttcctgatcctctttctcctcccatgctccacccttcaataggccccagtgtttgttkttccccactatgtgtccatgtgttctcatcatttagctcccactcatgacagtatgaggtaatttgttaccttcacactttattaatgcagcttcaaaaa

SEQ ID NO: 17452 - DNA, 201 bp, Homo sapiens
gagtatggcaatagtttctgagagagttatcagcagtcactgttagagtgaaccaatacctttatgaacatgtacagtggatctatttccctcatgcgaamggaggtggataattagtcaatctctgttttgagtgtgtattataggtagaagcaaggaccaaggtttctgttttcttgtagaacattgcctggcacatag

SEQ ID NO: 17453 - DNA, 201 bp, Homo sapiens
ttttattaccctaactcctggtgggttgagcatctttccttatattcattgtccatttatatttccttttctgtgaatattttgcttgctttactcatttstctattggatattatggctattgaggggctctttattaggcatagtttatcacatgctgtcatgctttcattcaatttttttttacttcattaatatttg

SEQ ID NO: 17454 - DNA, 201 bp, Homo sapiens
tataattttaataataggtaagatgggagaaagagagaaagctacatataagaaaatgtatggaaaacagcagtaggtagactttcatggtaaaagaaagrgaaataaaaaagtcctaagttagaaaagaaaatgcaagaggagtagagaatattggagaggatcgaaacaccagtggcagactacagcataagtaagtaa

SEQ ID NO: 17455 - DNA, 201 bp, Homo sapiens
tagaatgaaataaatttttttaaaaaaagcttttgttgaagagacaaaggattattcatttttttctataacaaagtgaatatttataaagcgttttcaakaaaaaatggctttcaaaaaacaacaaaaaaacagggatggttgatagttaaatgtgatctattgaaaatttctatatactcatatattccattgatttga

SEQ ID NO: 17456 - DNA, 201 bp, Homo sapiens
taggtaactgaacaaaagctcaataaagttaagtggcttgtctaaaaatcagtcaatctcaggtcatgtgacacaaaatttagaatttttcttatcatatycactacttctaagaagaggtatcttaaatagatactaagatattatatgtgaacatctacttgtttttgtttacttgtagaagggaaaaaaattaaactt

SEQ ID NO: 17457 - DNA, 201 bp, Homo sapiens
aggaggcatagctgtttatcaacatgcttccaagataatttttccctcctaatgacaaagcaaatttacatacgtgctctcaaagttttttttaatataarcatttgctttatttctaagagaataaataaaattagttttgaaaatcctatttcataaccctgaagcttttttagcttttttataggcaaagtcttaccc

SEQ ID NO: 17458 - DNA, 201 bp, Homo sapiens
ttttctataacaaagtgaatatttataaagcgttttcaataaaaaatggctttcaaaaaacaacaaaaaaacagggatggttgatagttaaatgtgatctmttgaaaatttctatatactcatatattccattgatttgataggttttccttatcctaacaatgatttagaccagggatctaatccccgggccacggactg

SEQ ID NO: 17459 - DNA, 201 bp, Homo sapiens
ttgggaatgggctagccaaaggtaccagaaaactcaaaggtctttggctaaaatcctctgtatcctccagcagtaactttgccattaggactagaaatackcaaagtccaatgagtaggatttcctctcccctagatagtacttggatgggtgctttccatgcttgccaaggtgattatattattttttaagttccataat

SEQ ID NO: 17460 - DNA, 201 bp, Homo sapiens
cactatctttattgcaatggcctggaactgaacctgcaatatccctgaggtatacctgtatatcgaatatatatataggtatacattcacagatctaggtrtgcttgtatatacttacatgtgtatataggtatgcctgtatatgcttatacctaaagcagcaataacaacaataatgaaagtgccaagcactgagcacca

SEQ ID NO: 17461 - DNA, 201 bp, Homo sapiens
acttcttcctttttaatctggattttttctttgcctaattgccgtggctagacctgccagtacagtgttgactaaaagatagcaagagcagacttacttaycttgctcctaatcttagaggggaagcttttctctctcatcaagtgcgatttaagctgtgagtgcctttatcacattgaggaagatcccttctgtttccag

SEQ ID NO: 17462 - DNA, 201 bp, Homo sapiens
ttattgctagttacagaaatgcaaatgatttttgtttattgatcttgtatcttgcaaccttgctgaactcatttgtaattctgtcaatagattccttaggwttttctctatacagtataatgtcatctgcaaatataggtttacttcttcctttttaatctggattttttctttgcctaattgccgtggctagacctgcca

SEQ ID NO: 17463 - DNA, 201 bp, Homo sapiens
taataatccagacagctcctaagtgactaaggggcaggtaacatagacagcatgtgcaggacaaagggataattcacgccctaggcaggacagagcagaayggctcaagatttcttcacactacttagaacagcatgtcatttaaatcttatgaattatttctggaattttccagttaatattttcagaccacagttgacc

SEQ ID NO: 17464 - DNA, 201 bp, Homo sapiens
agaaattatcaaccatattttaggcagtagttagaaaagtcatgtacaatataaagccaaatgttaatacaattgttagcaccaagaagcagaaaaattayctatctactagcattgtaattatcttctgagaattggaagcattacaaaattttatgtatatgtattaagtatgctcttggggttttccatagtcaaggt

SEQ ID NO: 17465 - DNA, 201 bp, Homo sapiens
tctcttcccttctgtttttttgaaagagtttgtgacagattgttagtacttcttaaatgtcttagaaaattttaatagtgaatcgattgagagaggaatayggaaattgctccaaagtggagattctaaacaaggctatgggagaaagcaaaaaactcttccattgcaacatttgatggtcatttgtactttcaggcatgt

SEQ ID NO: 17466 - DNA, 201 bp, Homo sapiens
tgaatatactttgtccctggaaaacacattgctcagttctggagcggctttctctccagatctctgtgcgctggggaacttagatttgctttctactgtcyaaatataaactttggtcattctccacctcccctatccctttccccacagctactcacttagtttaagtcccgttgtctctatcagttaacctcttgtggt

SEQ ID NO: 17467 - DNA, 201 bp, Homo sapiens; identical to SEQ ID NO: 3013

SEQ ID NO: 17468 - DNA, 201 bp, Homo sapiens
atttttagtagagacagggtttcactgtgttagccaggatggtctcgatctcctgacctcgtgatccgcccacctcggcctcccaaagtgctgggattacrggcgtgacccaccgcgcctggccaagctgtttgctttcttaccattcacattttcactggaatagcacttccaatttccttcaagagcttttcttttgta

SEQ ID NO: 17469 - DNA, 201 bp, Homo sapiens
gcctgttctttgaaactttgaaactaggcattgacttctcctttatagctatgaagtcctagatggcatcttccttgaatagcaggctattttgtctccaytgaaaatctgttcttagtgtagccaccttcatcaatgatcttagccagatcttctggataaacttgctgcagcttctacattagcacttgctgcttcacc

SEQ ID NO: 17470 - DNA, 201 bp, Homo sapiens
acagagcaagactccgtctcattcataaataaataaataaataaaatgattcagtctttctttacagtttttttctgaagtaaatattacatgagacacamgtcttaaatgtacatttgctaagttttgataaatgtatacacctgtgtaaccccagccctatcaaagatacagaatattacctatcacccccagaaagtt

SEQ ID NO: 17471 - DNA, 201 bp, Homo sapiens; identical to SEQ ID NO: 2992

SEQ ID NO: 17472 - DNA, 201 bp, Homo sapiens
tcccgatttaaaaaataaacagactaatatagtgaaatacagatgaaagagagaacttgtgagacaagaagagaataaaattagaatgtggaaggagccayaagtgatgggagccagagcagacggtcatattaataaagtaaggtggttttactttgtgtctgccgtcagctctgtacgtcattgtgcagtcgatttttc

SEQ ID NO: 17473 - DNA, 201 bp, Homo sapiens; identical to SEQ ID NO: 2997

SEQ ID NO: 17474 - DNA, 201 bp, Homo sapiens
cttacccacaagccccgcccccccagccccgatggccctgcccagtcccagacagaacctactacgtgcggcggcagctggggcgggaaggcgggcgctgsgggcgctgcggccgctgcagcgccagggtccacctggtcggctgcacctgtggaggaggaggtggatttcaggcttcccgtagactggaagaatcggctc

SEQ ID NO: 17475 - DNA, 201 bp, Homo sapiens
gtctagacagtcaagttgtggctttaaaagaacttgaggtgagaagggtgggaatggccactgatgagtacagaatgttttcttttttggtgtgatggaamtgttctaaaagtagataggagtgatgcttgctcgactctgtgaatctactaaacgtcactgaactatacactttaaaagggtaaatgttatggtgtgtga

SEQ ID NO: 17476 - DNA, 201 bp, Homo sapiens
gtttcactttgttggccaggctggtctggaactcctgacctcccgtgatccgcccatctcagcctcccaaagtgctgggattacaggcgtgagccaccacrcctggctaatctgttcttcactttcttttctatactcactacaaaaaagggcaaggaagtcttcacagctgcacttactaacaccgtcacggctctgttt

SEQ ID NO: 17477 - DNA, 201 bp, Homo sapiens
gaaattcagcagtgaaatatgtgactatattggatgcttgctatttgtcatttactgtatttctagcgcttgtgccatgtaagggctgatgaactcaaacmgtagctcagctttttgcatgctcttttttacccacctagaggtccagtgtttcctgtgatacttacctctaaactgctaaatagccacattttacggaag

SEQ ID NO: 17478 - DNA, 201 bp, Homo sapiens
tggtttaaaataattataggaaagaaattcagcagtgaaatatgtgactatattggatgcttgctatttgtcatttactgtatttctagcgcttgtgccaygtaagggctgatgaactcaaaccgtagctcagctttttgcatgctcttttttacccacctagaggtccagtgtttcctgtgatacttacctctaaactgc

SEQ ID NO: 17479 - DNA, 201 bp, Homo sapiens
gtccacacatttcttaacaaagaatacatatgctactacataccaactctcctttgtcagggaatccaatctagattggtttaaaataattataggaaagraattcagcagtgaaatatgtgactatattggatgcttgctatttgtcatttactgtatttctagcgcttgtgccatgtaagggctgatgaactcaaaccg

SEQ ID NO: 17480 - DNA, 201 bp, Homo sapiens
aaaaaggataatgtttatatggcacccgagataatcagataaggccagaagacaagagtcagagggttctgcctaatctaagccccaccatcctgatgttwaagggcccctgaatcggaggaccctgccacaggcaccaactgaagtcttttgtccatgtaacaaattgcagctcaagtttcaaagtcaaatctgttggag

SEQ ID NO: 17481 - DNA, 201 bp, Homo sapiens
ttatatctgtgaagcacagtaaaatgaggtatggcttagtagggaaccccatttttaaaggctcagtatgaagggtcttaaattgaagatgtatttttgcrttctggttaagacactattccatttcagggttttttgtttttaagtggtttcccaacactcctcagggaaattgagcaagaattccatcggcagtcctca

SEQ ID NO: 17482 - DNA, 201 bp, Homo sapiens
aaagaaaaacacctttatatctgtgaagcacagtaaaatgaggtatggcttagtagggaaccccatttttaaaggctcagtatgaagggtcttaaattgargatgtatttttgcgttctggttaagacactattccatttcagggttttttgtttttaagtggtttcccaacactcctcagggaaattgagcaagaattcc

SEQ ID NO: 17483 - DNA, 201 bp, Homo sapiens
aaaacgtattttaataatgaaaaagcctgaaatattgtggaaattaccaaaaggtaacagagatagaaagtgaacacatgctgttggaaaaacttcaccartagacctgctcagtgcagggttggcacaaaccttcaatttgtaaaaaagaaaaacacctttatatctgtgaagcacagtaaaatgaggtatggcttagta

SEQ ID NO: 17484 - DNA, 201 bp, Homo sapiens
gttcccaaggttcatttaccattattaaaaaatttttgtcttagaaattttatgtatgtcaacgcacgagcaaattatcaggcatggggcagaattggcarctgggtggaggcttcggtggaggtgagcactccgaaaggaaaacagagtaggcctttggaacagctgctggaagagataaggcctgaacaagggcagtgg

SEQ ID NO: 17485 - DNA, 201 bp, Homo sapiens
acagggtttcactgtgttagccaggatggtctcgatctcctgacctcgtgatccgcccacctcggcctcccaaagtgctgggattacaggcgtgacccacygcgcctggccaagctgtttgctttcttaccattcacattttcactggaatagcacttccaatttccttcaagagcttttcttttgtatttacaacttggc

SEQ ID NO: 17486 - DNA, 201 bp, Homo sapiens
taaaaaatttttgtcttagaaattttatgtatgtcaacgcacgagcaaattatcaggcatggggcagaattggcagctgggtggaggcttcggtggaggtkagcactccgaaaggaaaacagagtaggcctttggaacagctgctggaagagataaggcctgaacaagggcagtggagaagagagggtaaaaattttttaa

SEQ ID NO: 17487 - DNA, 201 bp, Homo sapiens
tttggaacagctgctggaagagataaggcctgaacaagggcagtggagaagagagggtaaaaattttttaaggttacatgaccctggattttggagatctsgaatttaaaggtgatgcaccagggatgaacgctcagattttcagtttgaaagctggcgtgacatgtaaaggagtggagaataatgtaccattgtaatgat

SEQ ID NO: 17488 - DNA, 201 bp, Homo sapiens
gaacattattctaagtctttaattcccacaacaaccctagaagcaggaactattgttatctctattttatagataaagtaaaccacaaggggttaacacgwtttgtcttgtgggtgacaaaatgcattcaacttgagcactttgactcagaatctttttttttttttttttttaagagggagtcttgctctgtcgcccagg

SEQ ID NO: 17489 - DNA, 201 bp, Homo sapiens
agcgagactccgtctcaaaaaaaaaaaaaaaaaaagagaaatgaaacaaaccaataatactagtaggcaccatttatagaacacttgatgtgttaggcacratgctacattcttttttggttttgggggatgggggcggagtcctgctctgtcactgaagctggagtgcagtggcgccatcttggctcactgcaacctctg

SEQ ID NO: 17490 - DNA, 201 bp, Homo sapiens
aaactcctgacttcaggtgatccacctgcctcggcctcccaaagtgctgggattacagacgtaagccactgcacccgacttataatcaactttaatgcagracttcaccaccacagtcaatctaataatccagacagctcctaagtgactaaggggcaggtaacatagacagcatgtgcaggacaaagggataattcacgc

SEQ ID NO: 17491 - DNA, 201 bp, Homo sapiens
tagtttacagtttttttcttaccatttgcatatgtagtatactagcatgatatttatccaacttgacagtggcttaccattgtgaagaaaaaagggaaacyttttatttgctttatgcactattgatgcatttaaactgagaatcagggaagctgtgtttttaatggacacataatttaattatatattttttcttacaga

SEQ ID NO: 17492 - DNA, 201 bp, Homo sapiens
ctggaagagataaggcctgaacaagggcagtggagaagagagggtaaaaattttttaaggttacatgaccctggattttggagatctcgaatttaaaggtsatgcaccagggatgaacgctcagattttcagtttgaaagctggcgtgacatgtaaaggagtggagaataatgtaccattgtaatgatgaggcgcctctag

SEQ ID NO: 17493 - DNA, 201 bp, Homo sapiens
tgattcaagcaggcgttcctgaccacctggagcatactggggtgcagcctgcatagtactgaagaagtaaccaaagattggggttcattggaggctggaakggtcagaagattcctcagtggagaagctgggtttggaaggggagctggagagaacacaggcttaagtgagagttagggaacaggaatagcagatcctaat

SEQ ID NO: 17494 - DNA, 201 bp, Homo sapiens
tcaataacctgtagtttcacataaagtcaaaacaactattttttgggacttgctaaaattaagtgatgatcccctttctggacccaaccctaaatgcaatmaaatgtgaattttaggatgggctgaaatgggtcataatcttctactctgttattcctagttaaccacaatacccaataatattttgtacttaacattcat

SEQ ID NO: 17495 - DNA, 201 bp, Homo sapiens
ggaatgttttcagctgcgagtgctagaaaatctaacttacagtaactaaaacaaattgggattttgctgactctgattgattgattgattgattgattgaktttgccctcaaaaaatcaaaccaaacttggcattgcaagatggctgctactgctccagagagcaggcccatgttcacagtaggaagaagaaatatagtgt

SEQ ID NO: 17496 - DNA, 201 bp, Homo sapiens
ccactaaatgtcaggatgtccatcatatctatgcacatagataagtcctcaatgtcatctgtgagttcttggaaactgtgactttaagtgaaacaatgtakagcaaaaccaattttaccataggctactggatgtacacaagagttaagttcctagggcatattgctggtcacaaaaacatcaccaaacttctaaatgaag

SEQ ID NO: 17497 - DNA, 201 bp, Homo sapiens
tcccgggttcacaccattcttctgcctcagcctcctgagtagctgggactacagacgcctgccaccacacctggctaattttttgtatttttagtagagayggggtttcaccgtgttagccaggatggtctcgatctcctgacctcgtgatctgcccatcttggcctccccagaatctttactatgtcatacacaattgca

SEQ ID NO: 17498 - DNA, 201 bp, Homo sapiens
tagaattaatttagttctcagcagagaactcaagtaagtaccttaacataaattcaccacaagaaaatcatgtctcatagtggagatcagtatatgataaratgaaattgtataaaaggagctattgatgaagctgcttaatatcacaaaggtgattatagaaaattaataagcagttatttatactacatgacaataact

SEQ ID NO: 17499 - DNA, 201 bp, Homo sapiens
tgactatattggatgcttgctatttgtcatttactgtatttctagcgcttgtgccatgtaagggctgatgaactcaaaccgtagctcagctttttgcatgytcttttttacccacctagaggtccagtgtttcctgtgatacttacctctaaactgctaaatagccacattttacggaagcatattcttcatacctttgct

SEQ ID NO: 17500 - DNA, 201 bp, Homo sapiens
cccctttctggacccaaccctaaatgcaataaaatgtgaattttaggatgggctgaaatgggtcataatcttctactctgttattcctagttaaccacaayacccaataatattttgtacttaacattcattacccagtgtctgaaggtaaaacatttcaaagtattgaaatggttctagagatcctggagagaagcgggt

SEQ ID NO: 17501 - DNA, 201 bp, Homo sapiens
atttgtcatttactgtatttctagcgcttgtgccatgtaagggctgatgaactcaaaccgtagctcagctttttgcatgctcttttttacccacctagagrtccagtgtttcctgtgatacttacctctaaactgctaaatagccacattttacggaagcatattcttcatacctttgctctaacttaaatctctaacttt

SEQ ID NO: 17502 - DNA, 201 bp, Homo sapiens
cctcccaagtagctgggattataggcacacaccatcgtgcccggctaatttttgtatattttgtagagtcaggattttgccatgttgcccaggccggtctygaactcctgggttcaggcaattcacctcccaatgtgctgggattacaggtgtgaaccaccacacccagcctatttatctttttaattggcaaataattgc

SEQ ID NO: 17503 - DNA, 201 bp, Homo sapiens
tttttggtgtgatggaactgttctaaaagtagataggagtgatgcttgctcgactctgtgaatctactaaacgtcactgaactatacactttaaaagggtraatgttatggtgtgtgatttatatcaataaagtggcttttaaaagtctttggaaccagccgggcacagtggctcacatctgtaatcccagcactttggga

SEQ ID NO: 17504 - DNA, 201 bp, Homo sapiens
ctcccaatgtgctgggattacaggtgtgaaccaccacacccagcctatttatctttttaattggcaaataattgcatatatatatatattatgtacaacaygttgttttgaaatgtgtatacattgtagaatggctaaatggagctaattaacatgtattacccacttattttgtgtggtaagaacacttaaagtctactc

SEQ ID NO: 17505 - DNA, 201 bp, Homo sapiens
tggtagatttcaaattcacagactatatcgccattccaagaaactctttaatgatatttttgaatactactcaagtttgtttatggctagcttaagctcamacagaaagaaatctcagtgggggagatgttcacttgagccagcatttctcctcgaatatgatgagtgtaatttttttttacgaccttcctgtgatgcatg

SEQ ID NO: 17506 - DNA, 201 bp, Homo sapiens
agtctttaattcccacaacaaccctagaagcaggaactattgttatctctattttatagataaagtaaaccacaaggggttaacacgttttgtcttgtggrtgacaaaatgcattcaacttgagcactttgactcagaatctttttttttttttttttttaagagggagtcttgctctgtcgcccaggctggagtgcagtg

SEQ ID NO: 17507 - DNA, 201 bp, Homo sapiens; identical to SEQ ID NO: 2990

SEQ ID NO: 17508 - DNA, 201 bp, Homo sapiens
gcccgccttacccacaagccccgcccccccagccccgatggccctgcccagtcccagacagaacctactacgtgcggcggcagctggggcgggaaggcggscgctgggggcgctgcggccgctgcagcgccagggtccacctggtcggctgcacctgtggaggaggaggtggatttcaggcttcccgtagactggaagaat

SEQ ID NO: 17509 - DNA, 201 bp, Homo sapiens
acccacaagccccgcccccccagccccgatggccctgcccagtcccagacagaacctactacgtgcggcggcagctggggcgggaaggcgggcgctggggscgctgcggccgctgcagcgccagggtccacctggtcggctgcacctgtggaggaggaggtggatttcaggcttcccgtagactggaagaatcggctcaaa

SEQ ID NO: 17510 - DNA, 201 bp, Homo sapiens
agccccgcccccccagccccgatggccctgcccagtcccagacagaacctactacgtgcggcggcagctggggcgggaaggcgggcgctgggggcgctgcrgccgctgcagcgccagggtccacctggtcggctgcacctgtggaggaggaggtggatttcaggcttcccgtagactggaagaatcggctcaaaaccgctt

SEQ ID NO: 17511 - DNA, 201 bp, Homo sapiens
gagccctaacatcagcctaaccagatttcaaatttcatcttttggcggtatgcatttttaacagtcacccctcaactaacacatcatcctccctcaactcmcattctactaaccccatcaatgcaactccctgcccaccttactcaacatatacaccgctgctagccccataccccgaaccaaccaaaccccaaagacacc

SEQ ID NO: 17512 - DNA, 201 bp, Homo sapiens
  misc_feature (1)...(201): n = A,T,C or G, or insertion/deletion polymorphism (see Tables 1-2)
ttaacagtcacccctcaactaacacatcatcctccctcaactcccattctactaaccccatcaatgcaactccctgcccaccttactcaacatatacaccrctgctagccccataccccgaaccaaccaaaccccaaagacaccccatatggtttatgtagcttacttcctcaannnnnnnnnnnnnnnnnnnnnnnnnnn

SEQ ID NO: 17513 - DNA, 201 bp, Homo sapiens; identical to SEQ ID NO: 2999

SEQ ID NO: 17514 - DNA, 201 bp, Homo sapiens; identical to SEQ ID NO: 3000

SEQ ID NO: 17515 - DNA, 201 bp, Homo sapiens; identical to SEQ ID NO: 3003

SEQ ID NO: 17516 - DNA, 201 bp, Homo sapiens; identical to SEQ ID NO: 3004

SEQ ID NO: 17517 - DNA, 201 bp, Homo sapiens
gtatttgcctctggaaagaacaactggcaggactgttgttttcattgtaagacttttggagccatttaattgtacttaaccattttcatctatttctttartaagaacaattccatcttaataaagagttacacttgttaataagtgctggcctcctgttgttctttgtacaccccacacaaaatttcaaagaaactttga

SEQ ID NO: 17518 - DNA, 201 bp, Homo sapiens; identical to SEQ ID NO: 3005

SEQ ID NO: 17519 - DNA, 201 bp, Homo sapiens; identical to SEQ ID NO: 3008

SEQ ID NO: 17520 - DNA, 201 bp, Homo sapiens; identical to SEQ ID NO: 3011

SEQ ID NO: 17521 - DNA, 201 bp, Homo sapiens; identical to SEQ ID NO: 3010

SEQ ID NO: 17522 - DNA, 201 bp, Homo sapiens; identical to SEQ ID NO: 3014

SEQ ID NO: 17523 - DNA, 201 bp, Homo sapiens
cctgcctacaatgagtttaaaaaatagagaaacgaggcgggcggatcacgaggtcaggagatcgagaacatcctggctaacacagtgaaaccccgtctctwctaaaaatacaaaaaattagctggatgtggtggcgggtacctgtagtcccagctactcgggaggctgaggcaggagaatggcatgaacccaggaggcgga

SEQ ID NO: 17524 - DNA, 201 bp, Homo sapiens
gtgttgtccctgcctacaatgagtttaaaaaatagagaaacgaggcgggcggatcacgaggtcaggagatcgagaacatcctggctaacacagtgaaaccmcgtctctactaaaaatacaaaaaattagctggatgtggtggcgggtacctgtagtcccagctactcgggaggctgaggcaggagaatggcatgaacccag

SEQ ID NO: 17525 - DNA, 201 bp, Homo sapiens
aagtttactgtgttgtccctgcctacaatgagtttaaaaaatagagaaacgaggcgggcggatcacgaggtcaggagatcgagaacatcctggctaacacrgtgaaaccccgtctctactaaaaatacaaaaaattagctggatgtggtggcgggtacctgtagtcccagctactcgggaggctgaggcaggagaatggca

SEQ ID NO: 17526 - DNA, 201 bp, Homo sapiens
tgatacttacctctaaactgctaaatagccacattttacggaagcatattcttcatacctttgctctaacttaaatctctaactttgcactatatttaatwtgggttttttggggggaaggggggagtggagttggttttttttgagacagagtctcgctgtctcgcccaggctggagtgcagtggcacaatctcagctca

SEQ ID NO: 17527 - DNA, 201 bp, Homo sapiens
agatacctgggcttatttaacttctctctggccaccatgtctttttccagcctgagtcaaagtatattctttgctctaacctaattcttttaagaatgacmgagtaaaataagtaaaatttatatgaggagggagagggaggaggcaatcaagagaatgaatagtccctattcttgattaatccttattataactatgagt

SEQ ID NO: 17528 - DNA, 201 bp, Homo sapiens; identical to SEQ ID NO: 2988

SEQ ID NO: 17529 - DNA, 201 bp, Homo sapiens
acactacttagaacagcatgtcatttaaatcttatgaattatttctggaattttccagttaatattttcagaccacagttgaccatagataacaaactggraagtgaaactgcagataaggggggagtctgcattccactttttaaatttttggtacagtaagaattagtagagcatctatttggttgtagcaaagataat

SEQ ID NO: 17530 - DNA, 201 bp, Homo sapiens; identical to SEQ ID NO: 2989

SEQ ID NO: 17531 - DNA, 201 bp, Homo sapiens
agaattagtagagcatctatttggttgtagcaaagataataaatgatttaatataaaatgatatattgaaaataaaaagtgaaatttgttctgtacccttmtttggaattttaaaaataaacacttggatttgttgtgtgtgtgtgtgtgtgtgtgtgtgtatttttcttttctataaactatttgagatcaagaattact

SEQ ID NO: 17532 - DNA, 201 bp, Homo sapiens; identical to SEQ ID NO: 2991

SEQ ID NO: 17533 - DNA, 201 bp, Homo sapiens
atctttttttttttaaagctcatcagctattgttaatgtttgtgtattgtatgtgtggcccaagacaattcttcttccaatgtggccaagagaagccaaartattggaccacccctgagtaaacactgaaattaattaacttcttcccttttggattttaattacataagtaataataagctcattttttaatacttcacc

SEQ ID NO: 17534 - DNA, 201 bp, Homo sapiens; identical to SEQ ID NO: 2994

SEQ ID NO: 17535 - DNA, 201 bp, Homo sapiens
tcattttttaatacttcacccattcctgtattgtttgaaacataaatcctttccccattcccaaaggtaacaacatattaacagtctgaatgtcattccargcttttctgcagtcattcaaacatatcactctttttctaatattaggaaaatcttcacacatacagaaagaactttacagtaaactcaccacctagatct

SEQ ID NO: 17536 - DNA, 201 bp, Homo sapiens
attttttgtttttgagatggagtcttgctccgttgcccaggctggagtgcagtggcacgatcttggctcattgcaacctccacctcccaggttcagcgatkctcctgcctcagcctcccaagtagctgggattacaggcacgtgccgccatgcccagctaatttttgtatttttagtagagacagggtttcatcatgttgg

SEQ ID NO: 17537 - DNA, 201 bp, Homo sapiens
ctttttctgagtctattgagatgatcatgtggtttttgtcttttatactaatattttaatgtactattaatatggtatatcacattgattttcatgttaarctaatgtttctgggataaattctacttggtaatggtatataatcctttttatatgttactgggcttaggttgctagtattttgttgaagatttttgcatt

SEQ ID NO: 17538 - DNA, 201 bp, Homo sapiens
aactgcttgttcctgggaggcagaggtcgtagtaagccaagatcacgccattgcactccagcctgggcgacagagcaagaccgtctcaaaaacaaacaaamaaaaatattaagtattttaacacctgagcatgtgatgtctttccccttgtttaggtcctatttcgttcagcgatgttttatacctttcagtgttaatttc

SEQ ID NO: 17539 - DNA, 201 bp, Homo sapiens
aaaatctcacagatcactactaaagaacttactcatgtaaccaaatacaacctgttccccaaaaacctatggaaataataaattaaaaaaaaaaaaaaaaagcttggcacagtgactcatgcctgtaatcccagcactttgggaggtcgaggcaggggcagatcacctgaggtcaggagttcaagaccagcctggccaaca

SEQ ID NO: 17540 - DNA, 201 bp, Homo sapiens; identical to SEQ ID NO: 3007

SEQ ID NO: 17541 - DNA, 201 bp, Homo sapiens
tacaggcatgcgccaccacgcccagctaattttgtattttaagtagagacggagtttctccatgttggtcgggctggtctcaaactcctgacttcaggtgrtccacctgcctcggcctcccaaagtgctgggattacagacgtaagccactgcacccgacttataatcaactttaatgcagaacttcaccaccacagtcaa

SEQ ID NO: 17542 - DNA, 201 bp, Homo sapiens
cctcccgggttcaagtgattctcctgcctcagcctcccaagtagctgggattacaggcatgcgccaccacgcccagctaattttgtattttaagtagagayggagtttctccatgttggtcgggctggtctcaaactcctgacttcaggtgatccacctgcctcggcctcccaaagtgctgggattacagacgtaagccac

SEQ ID NO: 17543 - DNA, 201 bp, Homo sapiens
atttaccatcactccttttacagaaggtttgccttgtataatcaactttttttttctttttttttgagacggagtttcgctctttttgcccaggctggagygcaatggtgcagtcttggctcaccgcaacctccgcctcccgggttcaagtgattctcctgcctcagcctcccaagtagctgggattacaggcatgcgcca

SEQ ID NO: 17544 - DNA, 201 bp, Homo sapiens
aaggtaggaaaccctatggccctcagagcctaaaatatttaccatcactccttttacagaaggtttgccttgtataatcaactttttttttctttttttttgagacggagtttcgctctttttgcccaggctggagcgcaatggtgcagtcttggctcaccgcaacctccgcctcccgggttcaagtgattctcctgcctc

SEQ ID NO: 17545 - DNA, 201 bp, Homo sapiens
gctacttgggaggctgaggtgggaaaatcacttgaacatggggggcagaggttgcagtaagctgagatcgtgccactgcactccagcctgggtaacagagygagactctgtctcaaaaaaaaaaaaaaaaaaaaaaaactctcagtttcttgggctcctgtttctagaacctcttatgttccccatttgtaatagaagaaa

SEQ ID NO: 17546 - DNA, 201 bp, Homo sapiens
ttctgccatgtgggtggtcttgtggtaagatatatacagtgaaattattttagaaagaagaggtaggccgacgcctgtaatcccagcactttgggaggccraggcgggtggattgcttgaggtcaggatctaaaaaccagctgggccaagatggtgaaactccatctctcctaaaaatacaaaaattagttgtgtgtgggc

SEQ ID NO: 17547 - DNA, 201 bp, Homo sapiens
cctatcatcgggcggagggtccacgcctccgcccgccttacccacaagccccgcccccccagccccgatggccctgcccagtcccagacagaacctactaygtgcggcggcagctggggcgggaaggcgggcgctgggggcgctgcggccgctgcagcgccagggtccacctggtcggctgcacctgtggaggaggaggtg

SEQ ID NO: 17548 - DNA, 201 bp, Homo sapiens
ctcctgccctgtccaagttaatctttatcccacccctccagaaataactactattctgatgtttttccaccagagatatcacaagatatcacatggttttrtgattcattgtgaaccacagatgtacaaatataggttaaattattggtcagaggccatactgatgttaagtgctttttgttgaaaggattcatatttatg

SEQ ID NO: 17549 - DNA, 201 bp, Homo sapiens
gaattagtagagcatctatttggttgtagcaaagataataaatgatttaatataaaatgatatattgaaaataaaaagtgaaatttgttctgtacccttakttggaattttaaaaataaacacttggatttgttgtgtgtgtgtgtgtgtgtgtgtgtgtatttttcttttctataaactatttgagatcaagaattactg

SEQ ID NO: 17550 - DNA, 201 bp, Homo sapiens
ttatgttctaaacagcttcagattgtatttttgtcttttgcttacacaagaaatgtgataccaaatgtaagtcttgcaaaaaattcttaagaaatttcctrttagctgggtgatagagtggaaagatacaagggaaactgctgactggtttttgagagaatgaggaatccaaaggaaacaaaaaaggagaaattacacttt

SEQ ID NO: 17551 - DNA, 201 bp, Homo sapiens
tagttagaaaagtcatgtacaatataaagccaaatgttaatacaattgttagcaccaagaagcagaaaaattacctatctactagcattgtaattatcttstgagaattggaagcattacaaaattttatgtatatgtattaagtatgctcttggggttttccatagtcaaggtctcattaaattgtactatcttattcat

SEQ ID NO: 17552 - DNA, 201 bp, Homo sapiens
ggttttatgattcattgtgaaccacagatgtacaaatataggttaaattattggtcagaggccatactgatgttaagtgctttttgttgaaaggattcatrtttatgatgattttagttctatagtcactgcatcttagtcagattatttgactagtatggatggattttacaaacattttgtggaattctttttttaacc

SEQ ID NO: 17553 - DNA, 201 bp, Homo sapiens
aatataaagccaaatgttaatacaattgttagcaccaagaagcagaaaaattacctatctactagcattgtaattatcttctgagaattggaagcattacraaattttatgtatatgtattaagtatgctcttggggttttccatagtcaaggtctcattaaattgtactatcttattcatacaagtttatgtaaattttt

SEQ ID NO: 17554 - DNA, 201 bp, Homo sapiens
acatcacaacagcttgtagatatcattcaggcttatcttcctatgggccaaatcggacctcccagcctgtttttgtaaagaaagtttcagtggaacacagmcccacccattcattcagttctgtctgtggcctgcaaaggtaggaaaccctatggccctcagagcctaaaatatttaccatcactccttttacagaaggtt

SEQ ID NO: 17555 - DNA, 201 bp, Homo sapiens
aacaaatgttctgttctactttcagcttccttgccatttaaaggaagtggaagaaacaggtataactcattgtctgaacctttaaaaaattaagccatgcrtataggaagcagcacattatctgtactgtaaattatttgttgttagttgaaattatttgttgtttgatactatacaaactaaatagaaatgcaaaaataa

SEQ ID NO: 17556 - DNA, 201 bp, Homo sapiens
cagtggaacacagacccacccattcattcagttctgtctgtggcctgcaaaggtaggaaaccctatggccctcagagcctaaaatatttaccatcactccytttacagaaggtttgccttgtataatcaactttttttttctttttttttgagacggagtttcgctctttttgcccaggctggagcgcaatggtgcagtct

SEQ ID NO: 17557 - DNA, 201 bp, Homo sapiens
ttgacattttatcatgagattccagcaattccatcccatcttcaggccccactttttttttttttttttttgagacggagtcttgcctgtggcccaggctsgagtgcagtggcccgatctcagctcactgcaagctccgcctcccgggttcacaccgttctcctgcctcagcctccctagtagctgggactacaggtgccc

SEQ ID NO: 17558 - DNA, 201 bp, Homo sapiens
ggttgtagtctgtcatgcctgtgcctttgcacatgtttttatctcctttgacactcagttaaggagtcatgccctgaggagtattctccctcatcaccccrgccctgcgttcctgtatagcgtcctctgcatgtcttcgttgtatgtcctttcatacattatagtcactgctgagatatttctgactgctatcacaatctc

SEQ ID NO: 17559 - DNA, 201 bp, Homo sapiens
ctgggctacagagcgagactccgtctcaaaaaaaaaaaaaaaaaaagagaaatgaaacaaaccaataatactagtaggcaccatttatagaacacttgatrtgttaggcacaatgctacattcttttttggttttgggggatgggggcggagtcctgctctgtcactgaagctggagtgcagtggcgccatcttggctcac

SEQ ID NO: 17560 - DNA, 201 bp, Homo sapiens
aaaggacaagctggaattctccagcaggggctgaagtggtacaggtgaaatttcttcaggaaagcctcaactctactcttaaagcctttaaactgattgawtcagcccactcagattaaagtctgaccgggcacagtggctaacccctgcaatcccagcactttggaaggccaaggcaggtggatcacttgagctcaggag

SEQ ID NO: 17561 - DNA, 201 bp, Homo sapiens
tggcttacacaattatgggggctgggtacgtgagtccaaaaatctgtaaaacgggccatcagaaaggacaagctggaattctccagcaggggctgaagtgstacaggtgaaatttcttcaggaaagcctcaactctactcttaaagcctttaaactgattgattcagcccactcagattaaagtctgaccgggcacagtgg

SEQ ID NO: 17562 - DNA, 201 bp, Homo sapiens
acatttatgaggaggaagaaaaatctagtttctgccatgtgggtggtcttgtggtaagatatatacagtgaaattattttagaaagaagaggtaggccgargcctgtaatcccagcactttgggaggccaaggcgggtggattgcttgaggtcaggatctaaaaaccagctgggccaagatggtgaaactccatctctcct

SEQ ID NO: 17563 - DNA, 201 bp, Homo sapiens
gcaattcacctcccaatgtgctgggattacaggtgtgaaccaccacacccagcctatttatctttttaattggcaaataattgcatatatatatatattawgtacaacatgttgttttgaaatgtgtatacattgtagaatggctaaatggagctaattaacatgtattacccacttattttgtgtggtaagaacacttaa

SEQ ID NO: 17564 - DNA, 201 bp, Homo sapiens
gattgagaccatcatggctaacacggtgaaaccacgtctcttctaaaaatacaaaaaattagccgggcgtggtggcaggcacctgtagtcccagctactcrggaagctaaggcaggagaatggcatgaacctgggaggcggagcttgcagtgagctgagatcgcgccactgtactccagcctgggctacagagcaagactc

SEQ ID NO: 17565 - DNA, 201 bp, Homo sapiens
aggcctcagtgtggcccaggatggctttgaatgctgcccaacacaaattagtaaatttccttaaaacatgcacagatctttttttttttaaagctcatcarctattgttaatgtttgtgtattgtatgtgtggcccaagacaattcttcttccaatgtggccaagagaagccaaagtattggaccacccctgagtaaacac

SEQ ID NO: 17566 - DNA, 201 bp, Homo sapiens
ccttgttctagattgggctttggcataaggtactgtggctggtttgatctatccagaccactcagcttcctctacatcagcaataaggctgtttgcttttytgtttttgtttttgtttgagacggagtctcgctctttcgcccaggctggagagtgcagtggcgtgatctcagctcactgcaagctccacctcctgggttc

SEQ ID NO: 17567 - DNA, 201 bp, Homo sapiens
cttgctagtttcaaacttttcttctatagctttctcacctctctcagcctttacagaattaaagagggttaaagccttgttctagattgggctttggcatraggtactgtggctggtttgatctatccagaccactcagcttcctctacatcagcaataaggctgtttgcttttttgtttttgtttttgtttgagacggag

SEQ ID NO: 17568 - DNA, 201 bp, Homo sapiens
aggctttaaatatttagtgaaccatgctataaacagacgtgctgtcatccaaacttcgttgttccatttctaatacacaggcagagtatatttagcgtaaytcttaaaggccctgggattttcagaatggtaaatgagcattggcttccactgaaagtcatcagcttgcattagctcctaacaagagaatcagcctgttct

SEQ ID NO: 17569 - DNA, 201 bp, Homo sapiens
tgaaaggaatcttccttcctgagaagtaggtctcaacaggaggctttaaatatttagtgaaccatgctataaacagacgtgctgtcatccaaacttcgttrttccatttctaatacacaggcagagtatatttagcgtaattcttaaaggccctgggattttcagaatggtaaatgagcattggcttccactgaaagtcat

SEQ ID NO: 17570 - DNA, 201 bp, Homo sapiens
caaaattactccttgatccatgggctgcagaatgagcaggaatattttgaaaggaatcttccttcctgagaagtaggtctcaacaggaggctttaaatatytagtgaaccatgctataaacagacgtgctgtcatccaaacttcgttgttccatttctaatacacaggcagagtatatttagcgtaattcttaaaggccct

SEQ ID NO: 17571 - DNA, 201 bp, Homo sapiens; identical to SEQ ID NO: 2986

SEQ ID NO: 17572 - DNA, 201 bp, Homo sapiens
gctgggattacaggcattagccaccacacccagcccaggttccacttctaattctagttctcttgccatttccaccacatctgcagttatttccacccccraagtcttaaacccctcaaagccatcatgagggttggaatcaactaactccaaactcctgttaatgttgatattttgatctcctatgaatcatgaatgttg

SEQ ID NO: 17573 - DNA, 201 bp, Homo sapiens
atggggggcagaggttgcagtaagctgagatcgtgccactgcactccagcctgggtaacagagtgagactctgtctcaaaaaaaaaaaaaaaaaaaaaaamctctcagtttcttgggctcctgtttctagaacctcttatgttccccatttgtaatagaagaaaagggacattttttcttgatatttttatccaagtatga

SEQ ID NO: 17574 - DNA, 201 bp, Homo sapiens
gcttaagtgagagttagggaacaggaatagcagatcctaataaaggaattacaatctgccacacattgtggaattagggcagtatagtctccatcaatcaracagaagcagagaacctgtcactgtccagggcacataatttcagttatgttctaaacagcttcagattgtatttttgtcttttgcttacacaagaaatgt

SEQ ID NO: 17575 - DNA, 201 bp, Homo sapiens
tgtaaaccaagcttgtccagcccatggcccgcaggcctcagtgtggcccaggatggctttgaatgctgcccaacacaaattagtaaatttccttaaaacaygcacagatctttttttttttaaagctcatcagctattgttaatgtttgtgtattgtatgtgtggcccaagacaattcttcttccaatgtggccaagagaa

SEQ ID NO: 17576 - DNA, 201 bp, Homo sapiens
tatctaattactatgaaagcctagttctacctgtttcatcatttataaagggaattgcaacccccaccacgaccaacaaagtagtttcagagattgggagrgactaagctagtcaatgtaaaccaagcttgtccagcccatggcccgcaggcctcagtgtggcccaggatggctttgaatgctgcccaacacaaattagta

SEQ ID NO: 17577 - DNA, 201 bp, Homo sapiens
tctccatgttggccaggctggtctcaaactcctgacctcaggtgatctgcccacctcagcctcccaaagtgctgggattacaggcgtgagccaccgtgttyggcctaccctgttttaaacctcaccatagtttacttttcttctaccctcaactttctcagagctttcttgtattaaataactttagtatgattaaaataa

SEQ ID NO: 17578 - DNA, 201 bp, Homo sapiens
cttctggttgctaggatgctctgattatctctttccttggtagatttcaaattcacagactatatcgccattccaagaaactctttaatgatatttttgartactactcaagtttgtttatggctagcttaagctcaaacagaaagaaatctcagtgggggagatgttcacttgagccagcatttctcctcgaatatgatg

SEQ ID NO: 17579 - DNA, 201 bp, Homo sapiens; identical to SEQ ID NO: 3001

SEQ ID NO: 17580 - DNA, 201 bp, Homo sapiens
tgctgagatatttctgactgctatcacaatctctttgagttcagggactgcatattttatctctatccccagaatctagcataacccctagcaaagtaggrattcaaaaatcacagaatgaatagtacataggtgatttataaaaatagaaccatcccacatagtaccactttgtaacccacctctttttccctcaatata

SEQ ID NO: 17581 - DNA, 201 bp, Homo sapiens; identical to SEQ ID NO: 3009

SEQ ID NO: 17582 - DNA, 201 bp, Homo sapiens
accacgcctgctagttttctgtattttttagtagagacagggtctcactgtgttagccaggatggtctccatctcctgacctcgtgatccgtccaccttgkcctcccaaagtgctgggattacaggcattagccaccacacccagcccaggttccacttctaattctagttctcttgccatttccaccacatctgcagtta

SEQ ID NO: 17583 - DNA, 201 bp, Homo sapiens
tttacccacaacagaatttctttcaaaatgggaatcagtcctctcaaaccttgctgttgctttattaacttagtttgcatagtattctaaatctttcgtgrtcaacaatgttcacagcatcttcactgggagtagatttcatctcaagaagccagtttctttgctcatccataagaagtaattccttatccattgacattt

SEQ ID NO: 17584 - DNA, 201 bp, Homo sapiens; identical to SEQ ID NO: 3012

SEQ ID NO: 17585 - DNA, 201 bp, Homo sapiens
atgtgatgctattttataggattttacccacaacagaatttctttcaaaatgggaatcagtcctctcaaaccttgctgttgctttattaacttagtttgcrtagtattctaaatctttcgtgatcaacaatgttcacagcatcttcactgggagtagatttcatctcaagaagccagtttctttgctcatccataagaagt

SEQ ID NO: 17586 - DNA, 201 bp, Homo sapiens; identical to SEQ ID NO: 2983

SEQ ID NO: 17587 - DNA, 201 bp, Homo sapiens
cctcagagacactgcaggttcagttccagaccactgcaataaataaagcatatcacaatataggtagtcacataaattttttctcagtgcatataaaagtyatatttacactatactgatagtctaatagatgtgcaatagtatatctttaaaaaatgtatgtaccttagttaaaatatgactggaaaatgctaacaatca

SEQ ID NO: 17588 - DNA, 201 bp, Homo sapiens
gaactatacactttaaaagggtaaatgttatggtgtgtgatttatatcaataaagtggcttttaaaagtctttggaaccagccgggcacagtggctcacayctgtaatcccagcactttgggaggccgaggtgggcagatcacgaggtcaggtgttcgagaccagcctggccaacatagcaaaaccccgtctctactgaaa

SEQ ID NO: 17589 - DNA, 201 bp, Homo sapiens; identical to SEQ ID NO: 2984

SEQ ID NO: 17590 - DNA, 201 bp, Homo sapiens
tgaactatacactttaaaagggtaaatgttatggtgtgtgatttatatcaataaagtggcttttaaaagtctttggaaccagccgggcacagtggctcacrtctgtaatcccagcactttgggaggccgaggtgggcagatcacgaggtcaggtgttcgagaccagcctggccaacatagcaaaaccccgtctctactgaa

SEQ ID NO: 17591 - DNA, 201 bp, Homo sapiens; identical to SEQ ID NO: 2985

SEQ ID NO: 17592 - DNA, 201 bp, Homo sapiens
aacgtcactgaactatacactttaaaagggtaaatgttatggtgtgtgatttatatcaataaagtggcttttaaaagtctttggaaccagccgggcacagwggctcacatctgtaatcccagcactttgggaggccgaggtgggcagatcacgaggtcaggtgttcgagaccagcctggccaacatagcaaaaccccgtct

SEQ ID NO: 17593 - DNA, 201 bp, Homo sapiens
aatttttttttacgaccttcctgtgatgcatgtaattgggtttggttgcttcttctgtatttatatataacatatgttggtgtcttgtgctttttttttttaaggctgagaaaatttaaagtctttgttatcaagcatgccagggaaatagtgataccagttagtaaaaaatgttagagctcttttttgttgttgttcttc

SEQ ID NO: 17594 - DNA, 201 bp, Homo sapiens
atggggggaaccaccccccataattcatttatctccacctggtatcacccttgacatgtggggattattacaattcaaggtgagattttggcggagacacrgccaaaccatatcaggatctaaggggaaggtctgggatctggcatgttaatcattcttagtctaataatataatcaccaaaaagaatgcagtatcctagg

SEQ ID NO: 17595 - DNA, 201 bp, Homo sapiens
ggggtaatcatattaagactgcccaggaagtcaactccaatggcttgggaggttgaggggtggccagaattggacctgtgttaatccattctcatgttcttataaagaactgcccaagactgggcaatttgtacaggaaagaggtttaattgactcacagttcctcatggctggggaggccacaggaaatttaaaatcatg

SEQ ID NO: 17596 - DNA, 201 bp, Homo sapiens
gcactccagcctgggtaacagagtgagactctgtctcaaaaaaaaaaaaaaaaaaaaaaaactctcagtttcttgggctcctgtttctagaacctcttatkttccccatttgtaatagaagaaaagggacattttttcttgatatttttatccaagtatgaatttcttctaagaaaacaagttatttattttgttcagtgc

SEQ ID NO: 17597 - DNA, 201 bp, Homo sapiens; identical to SEQ ID NO: 3002

SEQ ID NO: 17598 - DNA, 201 bp, Homo sapiens
caaaaaaaaaaaaaaaacctcgttggaaccaaaaattaaataaacaagttttactgtaatgctatagtagcctggacaccatctttagaaaatccaaaatkgcctccattatgtaagatttaaatagtctcccatccacgaaagttaacttaatttcatgttataattttttacgatctcactatcagaatctccacagtg

SEQ ID NO: 17599 - DNA, 201 bp, Homo sapiens
ggagatgttctcttcccttctgtttttttgaaagagtttgtgacagattgttagtacttcttaaatgtcttagaaaattttaatagtgaatcgattgagakaggaatacggaaattgctccaaagtggagattctaaacaaggctatgggagaaagcaaaaaactcttccattgcaacatttgatggtcatttgtactttc

SEQ ID NO: 17600 - DNA, 201 bp, Homo sapiens
aggggtaatcatattaagactgcccaggaagtcaactccaatggcttgggaggttgaggggtggccagaattggacctgtgttaatccattctcatgttcytataaagaactgcccaagactgggcaatttgtacaggaaagaggtttaattgactcacagttcctcatggctggggaggccacaggaaatttaaaatcat

SEQ ID NO: 17601 - DNA, 201 bp, Homo sapiens
ttgcatttatattcagaagggatgatttatagttttttttgttttaatgccttcccctggttttgttatcaggataaaagtgacctcatagagtgagttargagatgttctcttcccttctgtttttttgaaagagtttgtgacagattgttagtacttcttaaatgtcttagaaaattttaatagtgaatcgattgagag

SEQ ID NO: 17602 - DNA, 201 bp, Homo sapiens
gaggggtaatcatattaagactgcccaggaagtcaactccaatggcttgggaggttgaggggtggccagaattggacctgtgttaatccattctcatgttsttataaagaactgcccaagactgggcaatttgtacaggaaagaggtttaattgactcacagttcctcatggctggggaggccacaggaaatttaaaatca

SEQ ID NO: 17603 - DNA, 201 bp, Homo sapiens
ctcctaatcttagaggggaagcttttctctctcatcaagtgcgatttaagctgtgagtgcctttatcacattgaggaagatcccttctgtttccagtttayttagtattttttatcatgagagtattatacattttgtgacatgctttttctgagtctattgagatgatcatgtggtttttgtcttttatactaatatttt

SEQ ID NO: 17604 - DNA, 201 bp, Homo sapiens
agcccaatttgatatgtctaagtcctctatcattttccatgaacagggtatcaagccagcaaaccggatgcactcttcaagttggaacaaggagaacaacygtggacaattgaagatggaatccacagtggagcctgttcaggtgagagaacccacaagacagaaggctatggaagtcacattctagacagtcagagaagg

SEQ ID NO: 17605 - DNA, 201 bp, Homo sapiens
aaatgataaaagatcataaaggttttgtgtgtgtgtgtgtggcgggggtgggttgactatgagtttattttttacttttacttttctgctttttttctttyttccttttttttttttttttaattgagatggggtcttgtcatgttgcccaggctgctcttgaactcctgggctcaagcaatcctcctgcctcccaaagtg

SEQ ID NO: 17606 - DNA, 201 bp, Homo sapiens
aatatttacttcctgtcactgtatctgtttgtggatctatgtctatatatgtattaataaaagtgtgagtatatatgaatctatctgtagatatatatatycattatgatatacacatatatatattttacatgatagaatcatatttcaaagaacatagcagccaacttgaagggactcttcattggccgaagatgctac

SEQ ID NO: 17607 - DNA, 201 bp, Homo sapiens
gaaaagagaaaaagttttcttttcacatattttcttcctaatccacttctgtaaatggttggtaatatttacttcctgtcactgtatctgtttgtggatcyatgtctatatatgtattaataaaagtgtgagtatatatgaatctatctgtagatatatatattcattatgatatacacatatatatattttacatgatag

SEQ ID NO: 17608 - DNA, 201 bp, Homo sapiens
gaaaacttcccagtacttctttaaagcactgctcccagtacctctttagggcactgaccttatatctgctgccggcagactcttcccagggtcccctttcrccttgtcaatttcagttcctctgctccagcagaccttcttcattcacgtccttgaagtcccatgtttggatgctgctagttgggcgtgcttggagtccct

SEQ ID NO: 17609 - DNA, 201 bp, Homo sapiens
ctgtggattttttggatcaggcctgatggaaataggaaaagcacaatgtcctaagggctctccagctatggcagcagagcattaaattctttgtattaggrtttctatttctgccaccgaaggaggcagtacagatgtttctgcaactgaaggaggcagtataggccaatttttatcctccctctcctgttttttattttt

SEQ ID NO: 17610 - DNA, 201 bp, Homo sapiens
ctccgtgtccagcagcatggttctgtttagcctggtctgcacacatttcttgccaatttaaattccatgtcagatatgcactagcagacaagcaagttcgygccaagtgtctcacatcaaagggtaaaaaacgcatagcaccaaacacagattctagcaatcctaaggtgaatgggctctgtatgccatcatttaccactc

SEQ ID NO: 17611 - DNA, 201 bp, Homo sapiens
aaaacaacattattccaagaactacatataagatgttaatgtggtgccttagataggtccaagggttgaggctctccaggccttcctggaattcggtccartcttctaaagaaggctgaaattcttgagtttgcctatttaaatcaataattttgttttgtaattcaccaatatcaaaggtgatgttggatgtgaaagctc

SEQ ID NO: 17612 - DNA, 201 bp, Homo sapiens
gcagaatgctgagttggtcacgtcccacaggcctttggctccctgcatatccccctttctgtttatgtattaattgaaagaatgtaaggctgggctgggargctctcattctccaattggtggtccatccgattttacagactataaaccgaagacagagacaaaacaacattattccaagaactacatataagatgttaa

SEQ ID NO: 17613 - DNA, 201 bp, Homo sapiens
gagaaggggtcagggagcaccttacctctagtggacaagggccctgagctttacacagccctccgtatttattaggcaaaagagataggagggtgggggggtggaagaaggggtcggctgctcagttcagagtaggcttgcaagactgcattctctagatgtcgcagtagataacctcggtgccagggagtgattgcctcc

SEQ ID NO: 17614 - DNA, 201 bp, Homo sapiens
atgacttttaccaagcatactgcctgcaaacacattttaacaaagcacgtcctgcacagccctaaatccattaaaccttgagccaacacagcacacgtttytgagcacagggttggggctagggttacagattaacagtatctcaagacagaggaacttttctttgtacagattaaaatggagtttcttatgtcttcctct

SEQ ID NO: 17615 - DNA, 201 bp, Homo sapiens
ggacaattgaagatggaatccacagtggagcctgttcaggtgagagaacccacaagacagaaggctatggaagtcacattctagacagtcagagaaggcarcacagctgtgaagggggtttgaggatatgtaaacagttcctctactcatctgtctcccagtgtgagaccagtttttctttgtaggaatttagagttaaaa

SEQ ID NO: 17616 - DNA, 201 bp, Homo sapiens
caaaccggatgcactcttcaagttggaacaaggagaacaactgtggacaattgaagatggaatccacagtggagcctgttcaggtgagagaacccacaagrcagaaggctatggaagtcacattctagacagtcagagaaggcagcacagctgtgaagggggtttgaggatatgtaaacagttcctctactcatctgtctc

SEQ ID NO: 17617 - DNA, 201 bp, Homo sapiens
ctgggaccacaggcactcaccactgtgcctagctaattttttaattttttgtacagatggggtctcatgttgcccaggctggtcttgaactcctgggctcragtgaccctcctgccttggcctccgaaagtgctgggattacaggtgtgatctactgtgcctgaccaatactgtgccattttatatcagacacctcagtat

SEQ ID NO: 17618 - DNA, 201 bp, Homo sapiens
tttggttcagacatatcaactataataaccgcatgtggggaggctgaggcgggtgtgtgatgagatccggagttgaaggccagcctgaccaagatgctgaratccgatctctactaaaaatacaaaaatcagccaggcgcggtggcgggccgtaacccacatggacccatgggactgcacaaatgggggtgaacgtgggaa

SEQ ID NO: 17619 - DNA, 201 bp, Homo sapiens; identical to SEQ ID NO: 3047

SEQ ID NO: 17620 - DNA, 201 bp, Homo sapiens; identical to SEQ ID NO: 3048

SEQ ID NO: 17621 - DNA, 201 bp, Homo sapiens; identical to SEQ ID NO: 3049

SEQ ID NO: 17622 - DNA, 201 bp, Homo sapiens; identical to SEQ ID NO: 3051

SEQ ID NO: 17623 - DNA, 201 bp, Homo sapiens; identical to SEQ ID NO: 3044

SEQ ID NO: 17624 - DNA, 201 bp, Homo sapiens
ttgctgattgtctcttttctaaaactaatctgcctaagagttcaccatctcctgaggctggtgctatggtgggtctcatttcctacctgccttcacagtcyttccacggaaacgtcacagaggaaaggcatacctccaccacattaagaatcctagacattattggccacaggtataaaatccgctggggctccaaacaaa

SEQ ID NO: 17625 - DNA, 201 bp, Homo sapiens
aattcttctgcctcagcttctggaataactgtatttttatagagatggggtttcaccatgttggctaggccggtctcggactcctgatgtcaggtgatccrcccgcctcggcatcccaaagtgctgggattacaggcgtgagccactgtgcctggacttactagtgttaattgtaactagagattacatgtagtgtgcaac

SEQ ID NO: 17626 - DNA, 201 bp, Homo sapiens
aacagaagaatcgactttaagacctttttgatgagcctgttttaatccttctcctgctgtatcccaattttccacatcaagagtgcctgcctgtggaaacsatgggttatgtgtaataaccttttgtggcttctgcaggaggttagtgtctgcgaattaacctgagctgcagactgtctcaacagaactttaagcaactgc

SEQ ID NO: 17627 - DNA, 201 bp, Homo sapiens
cctgctgtatcccaattttccacatcaagagtgcctgcctgtggaaacgatgggttatgtgtaataaccttttgtggcttctgcaggaggttagtgtctgygaattaacctgagctgcagactgtctcaacagaactttaagcaactgcacataatgtttttcttcaatagacaaattctttcccttgttaccctgagtca

SEQ ID NO: 17628 - DNA, 201 bp, Homo sapiens
cttgaagtcccatgtttggatgctgctagttgggcgtgcttggagtccctgttctggttgccatttgtaacctgcacggacctaggtggactaaacaaagkggggtgaacacgggaataaagatgagacaaaagagtgtatttggaagaagggatcgggggcgctttgcctctaggggacaagggccctgagctttacaca

SEQ ID NO: 17629 - DNA, 201 bp, Homo sapiens; identical to SEQ ID NO: 3045

SEQ ID NO: 17630 - DNA, 201 bp, Homo sapiens
agcagaatgctgagttggtcacgtcccacaggcctttggctccctgcatatccccctttctgtttatgtattaattgaaagaatgtaaggctgggctgggmggctctcattctccaattggtggtccatccgattttacagactataaaccgaagacagagacaaaacaacattattccaagaactacatataagatgtta

SEQ ID NO: 17631 - DNA, 201 bp, Homo sapiens
gactgcattctctagatgtcgcagtagataacctcggtgccagggagtgattgcctccagcaaaccttatgttggcaggagcagtcctgagtttgctcacrtcctgtattcatgataaacagtttgctgtttgatcatatagcctccagcagaatgctgagttggtcacgtcccacaggcctttggctccctgcatatccc

SEQ ID NO: 17632 - DNA, 201 bp, Homo sapiens
ataagtcctcataactgatatggcaagtcttctaacttttttttcaaactttaaaaaaaagtttatagctatttaaacttttcagtatcagtttgggattrtgactgtgatttcattgaatctgtagatttgggagacttgacatttttaaaatgctttgttttccagcccatctttatagtacatctttgcatttattta

SEQ ID NO: 17633 - DNA, 201 bp, Homo sapiens; identical to SEQ ID NO: 3050

SEQ ID NO: 17634 - DNA, 201 bp, Homo sapiens
tgttattacaggaatccataacactggaggatgtggctgtggacttcacttgggaggagtggcaactcctgggcgctgctcagaaggacctgtaccgggaygtgatgttggagaactacagcaacctggtggcagtgggtgaggacagctgccctgtgtcactcagagggtgcctagtcagtggccttcctttctcagatg

SEQ ID NO: 17635 - DNA, 201 bp, Homo sapiens
tttccaaagaggaaactttgaagtcctcactgttttcggactcccacccctttgtgccccttggctaatgctgacctcccctcctaacacctcccctgtgwtggatgtggcttcctcagggtaaactggactttcgctgtgccttggcttccttcgcttctctttttccttattcttaggttctccaaaggtcccgttctc

SEQ ID NO: 17636 - DNA, 201 bp, Homo sapiens
acaaaacaaaacaaaaactctttatctcctcagagatctgattattttatctacatattgtttgtttgcctgcataattttcttcttcctcgggtttcaartatttcccttcttcatgttgttccacctctcttgttacgaaattccaccttccaggcctctttccaaagaggaaactttgaagtcctcactgttttcgga

SEQ ID NO: 17637 - DNA, 201 bp, Homo sapiens
agcttgtattattaagaataatgcatgtgtgaaaatttgtgtaaatgtcttttggttcatatgtgctctcatatgggggaggcagagatgtatatctagaygtgcacctcggaggaaaattgctgcttcatagagtgtgtataaactccgtctaaatagatgtcaaactgttttctaaagtggttgtaccacttacagttc

SEQ ID NO: 17638 - DNA, 201 bp, Homo sapiens
gtggcttatgcctactttgggaggcttaggcaggaggattccttgagcccaggagtttgagactagcctgggcaatctagtgagaccttgtctatatttartaaaattgaagaaaagagaaaaagttttcttttcacatattttcttcctaatccacttctgtaaatggttggtaatatttacttcctgtcactgtatctg

SEQ ID NO: 17639 - DNA, 201 bp, Homo sapiens
aactaatctgcctaagagttcaccatctcctgaggctggtgctatggtgggtctcatttcctacctgccttcacagtccttccacggaaacgtcacagagsaaaggcatacctccaccacattaagaatcctagacattattggccacaggtataaaatccgctggggctccaaacaaaggtatatagttaactatattgg

SEQ ID NO: 17640 - DNA, 201 bp, Homo sapiens
aaaaagtataaatttcaaaaagcaggatctggagagaagtaagcttagtttttaaactcaatatcatgcaaaatagtaggataaggaatataatgttcatwgcattaacactaaattatgaattttgtgacaccatgcatggctggaggatcctgtggattatattagctgtcagcttgcatctaatatctctgacagcca

SEQ ID NO: 17641 - DNA, 201 bp, Homo sapiens
attgctagtgataggtttgacatggaaatgagcttaggcgtatggtgcaattctagccaactatgtatgtgaaaatctgcctgggagtttctgagggagcrttttcttttttaaatatgtaatttcttgaatctctttttccatgttcgtgatgatatcgcctgaaaataacattaattttctgtcttactttgtaatgct

SEQ ID NO: 17642 - DNA, 201 bp, Homo sapiens
aggcccaggtaactgacttttggtttgttttattctttcctttgttccataatagatttgtagaagcctataaacatcaatttcactaatataaaaagtakaaatttcaaaaagcaggatctggagagaagtaagcttagtttttaaactcaatatcatgcaaaatagtaggataaggaatataatgttcatagcattaac

SEQ ID NO: 17643 - DNA, 201 bp, Homo sapiens; identical to SEQ ID NO: 3046

SEQ ID NO: 17644 - DNA, 201 bp, Homo sapiens
tatgcagagttacagaagatatcacaacagaagttattagtttgaccaaggaaacaatagcaaaaattatgcctaaggctctatggacacagtgagtaagstgagttagaagaagtgttacaaaaatgcaaagcaggtgtggcagcccaaggctcagacagattaacaagaatccatagcccagggatgcaacccaacatt

SEQ ID NO: 17645 - DNA, 201 bp, Homo sapiens
caaggagaacaactgtggacaattgaagatggaatccacagtggagcctgttcaggtgagagaacccacaagacagaaggctatggaagtcacattctagwcagtcagagaaggcagcacagctgtgaagggggtttgaggatatgtaaacagttcctctactcatctgtctcccagtgtgagaccagtttttctttgtag

SEQ ID NO: 17646 - DNA, 201 bp, Homo sapiens
ctctgaagtggtagattctcagatccttctcttgctcccacacaagacggtgtaatctaccctcttgtaagagaaaaaccttgatgttacagatatgaaaygaaactttcatagtttcagataagaaactaaattttgggtattttaagaaactcaagtttcttgaaatgtaacattcttccttcttgacattgccagccc

SEQ ID NO: 17647 - DNA, 201 bp, Homo sapiens
gctttcaggcatgaccaggtgtttcaggctcatcttgtctatttcctgccccagacttggctttataataagtgttgatgtctgatagagcagatctctcsattatcttatcctggatctctgccaaggagacagagcctgagtctaggacttgagtgttggtagtttatttttgctaagtgattgcgggggaggagtgag

SEQ ID NO: 17648 - DNA, 201 bp, Homo sapiens
caaagtctcaccttattgactgatcccctcatccctattacaacaaattcaggagatttttcaacaacgattcagcaccccaagaaatatttcaccagttratatgtggctttgtggccagtggtccctctcttggaccagacctcagcagcgtgaatggctctcccgcaaagcagggatttggagctggctgtgatctgt

SEQ ID NO: 17649 - DNA, 201 bp, Homo sapiens
gaaagtcttccttagagacatcatttccccagggcagtgcgcagaatgacctgctagggttaggcatgctgtctttcgggctgctccagaatgcagccaaygagtgactagagccagatttattttaggaaaaataaaagtcattcatttcaccaagtgtcactgtttcttcacttggccaaattgatagccaaagtacat

SEQ ID NO: 17650 - DNA, 201 bp, Homo sapiens
caataacaggaggatgtactctaagaatactaattaatacctttagctctaccagaatgagattctgtaaaaaatggtgggttgtcagttgccaaatcatraaatattgcagggagggaaaaggcaacatactctttcacaatatggcttgttatgttaaaactgttagtggtagggaattttgtacttgttaatcatttg

SEQ ID NO: 17651 - DNA, 201 bp, Homo sapiens
tgtcagccctcagattttatgtttatgttaatcttctgggggatagtgttcatagccatcatcagatttccagtaggacctggaccacaaaggttaaagakcactggtttgggatgagtacatttcagaacgcaatggaccgaaatacgctgaaccacagttaccatcattaaaagtgaaacgacaactcattcctgaggg

SEQ ID NO: 17652 - DNA, 201 bp, Homo sapiens
ccagcaccattattgcatagggtgtcctttctccaatttatgtctttatatgctttgtcaaatatcagttggctgtaattatttggctttatttttgggtwctctgttctgttctattggtctatgtgcccatttttataccagtaccatgctgttttggtaactataaccttgtagtataatttgaagtattgtaatgtg

SEQ ID NO: 17653 - DNA, 201 bp, Homo sapiens
atttgcaaattgagcagcctctttttaaataattttatatttcaatcatttttgaggtacaagtggtttttcgttacatggatgagttctttagtggtgarttctgagatttcagtgtacctgtcacctgagcagtgtacactatgcccaatatgtagtcttttatcccttaccctacttctgacttccccaaatgagttc

SEQ ID NO: 17654 - DNA, 201 bp, Homo sapiens
agaaggtattgggtgcttactttgtatgggataaagataagtactatcatctccttttatagttgagaagactgaagttcagacctgaccaaggtcacacrtctagtaagtagttgatggatttcagtctgtgtttaactctgctttttcacatgcacgatgttcatcatcatgtgtttccctgcagattccaaggttggt

SEQ ID NO: 17655 - DNA, 201 bp, Homo sapiens
tggtcattttcacaatgttgattcttcccattcgtgagcataggatgtgtatccatttgtttgtgtcatctattatttatttcagcagtgctttttagttktccgcgtagaggtctttcccctacttggttaagtatattcatatgtattttattttattttatttttttgcagctgttgtaaaagagattgagctcttga

SEQ ID NO: 17656 - DNA, 201 bp, Homo sapiens
aactaaatataattgaaagaatgaagacattaccaagggaatccttcaatgtttccccacagcacttacagtctaaatcattcaattctgcacgcaattagttggcccacatagtttgtaattaaattattccacaagcatttaaggttcacaaaggaggaagcatcttcatcttgttatctgttgtatctcccagtcaac

SEQ ID NO: 17657 - DNA, 201 bp, Homo sapiens
ctcccatgacacgtggggattatgggagttataattcaagatgatatttgggtggggacacagccaaaccatatcatgtacttactgcaataagtatgtaraatgattccattagctcagaaagtatctcttgtacctcattgtagtcaatgccccttccccacttccagcccatagcaactaatgaaatgatctgttttc

SEQ ID NO: 17658 - DNA, 201 bp, Homo sapiens
gcttttgttgccattgcttttggtgttttagacatgaagtccttgcccatgcctatgtcctgaatggtattgcctaggttttcttctagggtttttatggytttaggtctaacatgtaagtctttaatccatcttgaattaatttttgtataaggtgtaaggaagggatccagtttcagctttctacatatggctagccag

SEQ ID NO: 17659 - DNA, 201 bp, Homo sapiens
ggttttcttctagggtttttatggttttaggtctaacatgtaagtctttaatccatcttgaattaatttttgtataaggtgtaaggaagggatccagtttyagctttctacatatggctagccagttttcctagcaccatttattaaatagggaatcctttccccatttcttgtttttgtcaggtttgtcaaagatgagat

SEQ ID NO: 17660 - DNA, 201 bp, Homo sapiens
ataaaaatcttagactcagcatgtcaagtctcatctaaaattctgtttttttgaggactaaattttttcaagttttgatttatttgaagttccatttccastttgatctggaaaaatatcttttacaatactgaattttctaaccaatgagtgtggtatatctctttattacttaggtcatcttgaatcttaataatgtat

SEQ ID NO: 17661 - DNA, 201 bp, Homo sapiens
ttagtggttgtactaatttgcattcccaccaatagtgtagaagtattcccttttcaccacatcccaaccaacatctattgttttttgactttttaattatrgccattcttgcaagagtaaggtggtatctcattgtggttttaatttgcatttccctgacaactactgatgagcattttttcatatttgttggctgtttgt

SEQ ID NO: 17662 - DNA, 201 bp, Homo sapiens
ttctacatgtggcttgccagttttcccagcaccattattgcatagggtgtcctttctccaatttatgtctttatatgctttgtcaaatatcagttggctgyaattatttggctttatttttgggtactctgttctgttctattggtctatgtgcccatttttataccagtaccatgctgttttggtaactataaccttgta

SEQ ID NO: 17663 - DNA, 201 bp, Homo sapiens
ggcagcctcttgagccagagtaggctcagaaagactccagtggagccatgtggtagaagatgatttgtggattgaaaaaagaaagtgatgtacagaaaatrgaaatgaggtacaaaaatagccagattagttacagctcattgcttgccttatttgaacacggtttgaaaagttggccacctttggccaaaactcagtgat

SEQ ID NO: 17664 - DNA, 201 bp, Homo sapiens
acatacatgttcctctttccctctatctcctgcaattgggctggtaggtcggaggcttagatttctgtcaataacactacataagtggtgctgtgtactgygtcacatcaggaggcacataatgcctgtgttttactcttttagtgttaagattaatttagaggactccggtgttgtcagcctgattgagccattgtcagg

SEQ ID NO: 17665 - DNA, 201 bp, Homo sapiens
tttattagtttgggcatgtttcatatatttattagccatttagatattctctagtgtaaacagcctgttcttttgcttttttcccctattggattgtctgtttttttttttaatattgttttgtaggagttctttaaatattctggtacagtagttttgttggttatgtgtcacaagtaccttttcccattttgagacttg

SEQ ID NO: 17666 - DNA, 201 bp, Homo sapiens
gttataacagccttttcttaaatttttcaattttttttttaagttctggggtacatgtccaggatacacaggtttgttacctaggtaaacgcaaacacgcrcattttttcctgtagtattttaaagtatatctcagacaatatttatttttacctgtaaataattcactaaatatcagataataacttttacaaaaaatca

SEQ ID NO: 17667 - DNA, 201 bp, Homo sapiens
tacgtgttatcagccagattgattgattataatgttccccatcaagatttcaccccaaagttttagcataagagcttacatcctttcagtaggagtggcartgtgatgattttcaaatagtgctatcatatttcttgtacattcattcatcagctagaatttttctttaaagaactttttctcatttactattttgctacc

SEQ ID NO: 17668 - DNA, 201 bp, Homo sapiens
tggcagcaggttgtttaactttcatacagttgtatggttttgagtgactttcttggctttgatttctatttatattgtgctgttgtctgagaatgtggtcwgtatgatttcgtttttttgtgtgtttgctgaggattgttttatgtcagattgcatggtcaattttagaatatgtaccatgtggtgatgaaaagaatgtat

SEQ ID NO: 17669 - DNA, 201 bp, Homo sapiens
gctggttataacagccttttcttaaatttttcaattttttttttaagttctggggtacatgtccaggatacacaggtttgttacctaggtaaacgcaaacrcgcgcattttttcctgtagtattttaaagtatatctcagacaatatttatttttacctgtaaataattcactaaatatcagataataacttttacaaaaa

SEQ ID NO: 17670 - DNA, 201 bp, Homo sapiens
taaaatagatacattagagttaaataatctagacacaaaacgtacataatatgtgattccattcatctagatattaaaagccaggcaaaagtataatgttwagggatgcatgcttaagtcataaaagagaattaaggggccgggctctgtggctcacgcctgtaatcccagcactttgggagactgaggcgggcagatcac

SEQ ID NO: 17671 - DNA, 201 bp, Homo sapiens
gcttttctgccctcaacttgatgtaaaattcatccatattgttggtctctgtttagatcatctttattgatttgtgatattatattataggaatatggcawttttttctatatgctatcaataaaaacttgggttgtttccaatattccactattatgaataacactgctatgaacagtcttactcatatctctgtagcat

SEQ ID NO: 17672 - DNA, 201 bp, Homo sapiens
tggctttgatttctatttatattgtgctgttgtctgagaatgtggtcagtatgatttcgtttttttgtgtgtttgctgaggattgttttatgtcagattgmatggtcaattttagaatatgtaccatgtggtgatgaaaagaatgtatattctgttgtctttgggcagagagttctgtagctgtgtactaggtccatttga

SEQ ID NO: 17673 - DNA, 201 bp, Homo sapiens
aagagttagctgagaatatatttgtctaacttttctttttaatattctctgaaagaagacattacatcacacatactgaactcttacttaacctggactcygttaagtagaaacattggaaggagccaaagactgacattttaaattaagaaaaacaaaccaaatgagcgaaatagttcctctgagaagtgttttggccta

SEQ ID NO: 17674 - DNA, 201 bp, Homo sapiens
ttattacattttccttcaaatctactttcctttatatagctcttcttcctatgtcttggtctggtacttccttactgtcttgtgaggtttttgtttgtttrtttgtttgtttgtttttaatggttttagggtttttaatttgatattttatcaataatttttagttctcttttttagcacaatgattggataacctagcct

SEQ ID NO: 17675 - DNA, 201 bp, Homo sapiens
cttgggttctaatatagttttgccattttgtatacattcctagaaacgtagttcagtttttcctttgtctgtactttatataaattgaatcacactgtatrtattcatgtttcatgttgcttttctgccctcaacttgatgtaaaattcatccatattgttggtctctgtttagatcatctttattgatttgtgatattat

SEQ ID NO: 17676 - DNA, 201 bp, Homo sapiens
cttttagaattcaatggtgcaaatctataaagacagagctttaatggcaaaccctattctgtctggttctccttcctaagagttagctgagaatatatttktctaacttttctttttaatattctctgaaagaagacattacatcacacatactgaactcttacttaacctggactctgttaagtagaaacattggaagga

SEQ ID NO: 17677 - DNA, 201 bp, Homo sapiens
aatatgctcaggatttctgttgcttagatttctttcataaagaagtcactaagaaatggtagactgcagcttatttatttattgttaaacaagcaaaagarggccattacatctcttgtttacattaaaatatgaataagccttcattgatttgatggttgcatccaaagtaaggaattttagttatcaataaatggtaat

SEQ ID NO: 17678 - DNA, 201 bp, Homo sapiens
atggggtttaaccacatttgccacaatggtctcgatctcctgaccttgtgatctacctgcctcagcctcccaaagtgctgggattacaggcgcgagccacygcacccggcccaaaaattatttttttaaaactgggggaaaacatttttatcaagcaatgtttatatttatttaagtgtgttaaaggatctgggctactgt

SEQ ID NO: 17679 - DNA, 201 bp, Homo sapiens
ctttagttttttcttttcttttttttttttttaaaccaaactttctgctaacaataacaccagtaacaattacgtgccaggcactgtgcaaagtgaagtcytttacaaacattatctcatttaatcttcttaataaatgcatgagatggatgtgatagatggattccaagatggctccaagttattatcactttctggtat

SEQ ID NO: 17680 - DNA, 201 bp, Homo sapiens
gaattagggaggagtaaggaagaggaatctggtctctcactgtctggatgcggtgatctggtgagtttcagttcctttatactctctgggaggcccgagcrtcagttttctaagaaaggaactcagataagataaatataagtttcaggcttaagaccaagagggccaatttctgtttatttaaaaagaccataaacatca

SEQ ID NO: 17681 - DNA, 201 bp, Homo sapiens
atctcttccagaaacatctagatagacatgcccagaaataatgtttagctggatatctgggcatctcgtgtcccagtcaagttgacacataaaattgcctwtcacatctactacttattaaattgaaaaataagataattgaatttccttgtgacaaaagtagtctgttttgaaactataatacttgtagattcttggtat

SEQ ID NO: 17682 - DNA, 201 bp, Homo sapiens
aggtagaataaacgtgggacccggagtgcaccaaggtcagaggtcctcgcagagattgtggggtcaaagtgtgagggacatgggggctaaccggggcgtcscctcttttcgtcctcgtcctcgccctgcgtcccaggcgttctccagactttccagacccctcccctcctcagccttccctagccacttctcactcccatg

SEQ ID NO: 17683 - DNA, 201 bp, Homo sapiens
aaacaaggggtggattattcatgcctcccctttttagaccatatagggtaacttcctgacattgacatggcatttgtaaactttcatggcactggtggaartgtagcagtgaggacaaccagaggtcactctcatcaccatcttggttttggtgggttttagctggctttatttactgcagcctgttttatcagcaaggtc

SEQ ID NO: 17684 - DNA, 201 bp, Homo sapiens
tgtgtatttgtttttccttgcatctcccataatttctactttatatggatggtttttgtgctattttggtgcatagataataataactattacatcatcaktttgaattatggtgtttcacactctaaaatattcttctttgtgttgttaatgattttttaaaaatctgtcttaaaatcaagaccacaatctttgcttttt

SEQ ID NO: 17685 - DNA, 201 bp, Homo sapiens
cgtggcaacggacggcaacagctcgggcggcgcatggagagtgcgggcggcttcaagctgggtatggagcccctcagcggcggcggggtctgtgagttggwcgcggggtcttggcggggaatggaggtagaataaacgtgggacccggagtgcaccaaggtcagaggtcctcgcagagattgtggggtcaaagtgtgaggg

SEQ ID NO: 17686 - DNA, 201 bp, Homo sapiens
ggaagacataaaaatttagttacatatttatatcttatgtgaaaagtgcattgctgtgaggacatataagaaggggatgtcagagaggtcaagggtctagraagccttcagagaaaggatttctagattaagtgctgtttcagctgagatctgtgggatgagtctaagcatggacaagggaacagggtggaagaagaaagt

SEQ ID NO: 17687 - DNA, 201 bp, Homo sapiens
tctcctgttatttgtgtatttgtttttccttgcatctcccataatttctactttatatggatggtttttgtgctattttggtgcatagataataataactrttacatcatcagtttgaattatggtgtttcacactctaaaatattcttctttgtgttgttaatgattttttaaaaatctgtcttaaaatcaagaccacaa

SEQ ID NO: 17688 - DNA, 201 bp, Homo sapiens
atcgcgcggcttgctaggctgtgcggctccgtggttaccgtggcaacggacggcaacagctcgggcggcgcatggagagtgcgggcggcttcaagctgggyatggagcccctcagcggcggcggggtctgtgagttggacgcggggtcttggcggggaatggaggtagaataaacgtgggacccggagtgcaccaaggtca

SEQ ID NO: 17689 - DNA, 201 bp, Homo sapiens
tgctctctggtagggaaggaagacataaaaatttagttacatatttatatcttatgtgaaaagtgcattgctgtgaggacatataagaaggggatgtcagwgaggtcaagggtctaggaagccttcagagaaaggatttctagattaagtgctgtttcagctgagatctgtgggatgagtctaagcatggacaagggaaca

SEQ ID NO: 17690 - DNA, 201 bp, Homo sapiens
tacttattttttgtccacctaacaggtcttactaagagtagtttattaaaatctcctgttatttgtgtatttgtttttccttgcatctcccataatttctrctttatatggatggtttttgtgctattttggtgcatagataataataactattacatcatcagtttgaattatggtgtttcacactctaaaatattcttc

SEQ ID NO: 17691 - DNA, 201 bp, Homo sapiens
tattatgatcagactgttgcttctaatatttctagattatagaaccactggtattttctttggtattatacttttaatatataaccaaatttttgtcaccrttctatttgctattgaggaggcatattttctattactaggatgtagtgtttgatacatattcctaaacctatttaatgtgttatgtcattcaaatctttt

SEQ ID NO: 17692 - DNA, 201 bp, Homo sapiens
tcccaaagtgctgagattacgggtgtgagccactacgcccagccaaaaatattatgttttaaggttggttggaataattgttttctctctgtggttatgayaccagctggatgtacagcaaggttcatttgtttcagtttcttttttatttttaagaattgattttcccgtttcttttttcatttttgatatgtaaaacac

SEQ ID NO: 17693 - DNA, 201 bp, Homo sapiens
ttcattgtgtttacatggatggttggttcaactgttagttgccattactagaagtggaagtcctcttcacttttagaagaatatcttattgttttccttgttagagatatagagtggaaacagatatttttcatgctgttaatgggaattgatctggccaaaccctgtgaaagcagcacactaagaatttcctctcaatat

SEQ ID NO: 17694 - DNA, 201 bp, Homo sapiens
tctcccctcctaggggcaaaatggctgccagcagcttcaggctcaaatcccgatttcagcacctcaatacaaagaaagcattgcctctcttgcagcagttyaccccaaaatcagaattaagcctcattggctttggtgggcttggcttgggtcatgtgctgtgttctgaaccatatagctagggaggtgcaatactgggat

SEQ ID NO: 17695 - DNA, 201 bp, Homo sapiens
cccttgccctcactgtagcagaagccaaagttgaagacatgtgaacagttttatgcattcacatttacttccagaaagcaaagttaattgcatagaattcytttcgctttagttttttcttttcttttttttttttttaaaccaaactttctgctaacaataacaccagtaacaattacgtgccaggcactgtgcaaagtg

SEQ ID NO: 17696 - DNA, 201 bp, Homo sapiens
agtcaacccttcagatgactgtagacctggctgtatctttgactacaatctcatgagagactccaagccagaatcacgtagccaaacttcttttgaattcktgaatcatggaaactatgataaataagtagtgtttattattgttgtttttaacattaagttttggggcaatttgttagatgccaataggtaattgttaga

SEQ ID NO: 17697 - DNA, 201 bp, Homo sapiens
ttttattatttccaaaataattagtttggtgctttagcaacttccaaaggtgaccaattatttttttaaagtatcatttaaatttagatttaaaagaacgratctattgccgacttttttttttttatgctcaaattgtctcatctttggttaatgggaatgctttcaagttgctctggatccctgacaaccctggtagct

SEQ ID NO: 17698 - DNA, 201 bp, Homo sapiens
ggattatggaggctgagaagtcccacaatatgtttttggaaaggggtcccaatccagaccccaagagagggttcttggatttcacacaagaaagaattcasgtcaagtccacagaataaagtgaaagcaagcttattaggaaagtaaagggataaagaatggctaccccataggcagagcacccctgagggctgctggtta

SEQ ID NO: 17699 - DNA, 201 bp, Homo sapiens
aaataattagtttggtgctttagcaacttccaaaggtgaccaattatttttttaaagtatcatttaaatttagatttaaaagaacggatctattgccgacttttttttttttatgctcaaattgtctcatctttggttaatgggaatgctttcaagttgctctggatccctgacaaccctggtagctcttgataacgttct

SEQ ID NO: 17700 - DNA, 201 bp, Homo sapiens
ctgtatataataaaatagatacattagagttaaataatctagacacaaaacgtacataatatgtgattccattcatctagatattaaaagccaggcaaaastataatgtttagggatgcatgcttaagtcataaaagagaattaaggggccgggctctgtggctcacgcctgtaatcccagcactttgggagactgaggcg

SEQ ID NO: 17701 - DNA, 201 bp, Homo sapiens
gaataataggaaacaacctcaagttggaaacaacccaaatgttaattggtggtagaatggataaataaattgcagtaaattcaaatggtggattattatayacaaaatggactacagctgtatataataaaatagatacattagagttaaataatctagacacaaaacgtacataatatgtgattccattcatctagatat

SEQ ID NO: 17702 - DNA, 201 bp, Homo sapiens
tttttgatatgtaaaacacttacatggttcaaaatcaacactgtatagtgaggtacattcagagaaatctctctttcattcctatctcctctaccctgttsctttactccttctgtaggtaaccactgttactggtttatgtatcgtttcatattttagctagtgtatcatttggatagattcctagaatagggattgctg

SEQ ID NO: 17703 - DNA, 201 bp, Homo sapiens
tttacccagctcctactcaagatggagttgctctggttcacacgcctctgacacttgtattgtgcttcatacaatttgccattttgtcttcaaattttttwaaaaaaattccttttctgaattggaaagttctttaggcatagattaatatctgtccctgtataccatcttcacgttatgaatgagagatttctgcttctg

SEQ ID NO: 17704 - DNA, 201 bp, Homo sapiens
aaacagcaaacacatgtcattttcaattaccgtgcaaagacctcaaaagtgcgtgggtacttctcttatataatttacttattttaaatattttataaggraacttagtggcattccagaattatcctgaaagctgcaaacacaaattattcattactggtacttatgaaaacactttttcagtacatccacttaagaatc

SEQ ID NO: 17705 - DNA, 201 bp, Homo sapiens
ccactgtaattcagccattcagtgttgatatactaaatgtccatctcaggtaacaggaattgtatctcagcctgatacctaaaatgaagcaatcaagatgrcaagacttcagctgtacaagtcttggattaggtggcatgaatggatgatccaggttaatttcagaaacctaagccatgctctcagtagacttttactagt

SEQ ID NO: 17706 - DNA, 201 bp, Homo sapiens
ttctagtattaaaacaaccttgaatttctgagatgaacccaacttggtcatgatgtgttatcgtttttatatagtgccagtttcagtttcagtttgcaaattttttttctctttctttcatctatctgtctatctgtctatggtttatgaatgagactggcctatagttttcttttcccttagtgtctttctcagatatat

SEQ ID NO: 17707 - DNA, 201 bp, Homo sapiens
gtgagaagggtctggaaaatgtgccctttcttgcttggtagataaataaaaaattcacttttggccactgtaattcagccattcagtgttgatatactaawtgtccatctcaggtaacaggaattgtatctcagcctgatacctaaaatgaagcaatcaagatggcaagacttcagctgtacaagtcttggattaggtggc

SEQ ID NO: 17708 - DNA, 201 bp, Homo sapiens
ttataaggaattcactttgtcaagatactatggtcacagcatacagctcagatgacacttgtgtcaaaaaacattgactggctcagatgactcagaagttygtggctggatctaagaattcaaatgatggcctaagaagtcagtctgttggcactgctgtcatttgtgtggctttgttctcagacagcctctcccctccta

SEQ ID NO: 17709 - DNA, 201 bp, Homo sapiens
taagaatcttataaaatagattagcttaagtggtgtgtatacacatgcacataccatgcatgtgtctgtaatagttgaagcaaattctccaaatgaacatwcgtcatgtgtgatggctgtagtaacaaaaggtgttctcactttgtgctcctgaaatcctaccagtctttcagactctggtgttgacagaatcaaaggcat

SEQ ID NO: 17710 - DNA, 201 bp, Homo sapiens
gaataatttgtgtatggaattacctgtcctgggttacctaatccagagatccagcaatttttcttaattcctgaatttccaggcattgtaaagcatacttmactgtgcttggcacagattaattagtctatatattatatataggtacaaaaagtataagcttattctctcctattctaatagaaatgaggcatttttaac

SEQ ID NO: 17711 - DNA, 201 bp, Homo sapiens
ctcacacattctggatgactggaattctttggacccatatgagcctctgcaaagacattggtatgtgctggtcatattcaaatgtgagattcataagaatrgaataatttgtgtatggaattacctgtcctgggttacctaatccagagatccagcaatttttcttaattcctgaatttccaggcattgtaaagcatactt

SEQ ID NO: 17712 - DNA, 201 bp, Homo sapiens
gacctcttgcccagctgaaagctttgcagctggctgaggacttccaaacatgggttttatggagtagttatcccttctctgttttctccccatatcttatycttaccacattgggattaatagaatatgttttagagtggatctttggaacagtcgctaacaaccactgggtgtgttgaatctaatacagcttgctaaatt

SEQ ID NO: 17713 - DNA, 201 bp, Homo sapiens
taaaactcttttgtaggacaagagttgagcccaaaggcaagggatgtctagtcctcactgatacagtggagagagccttgtggtggggttgggaagcacarggcaaatgccttaaccacccatggagtctggacttggctaagcacttcccaaacttaggcgacctatttgaaaataccgatgtccaggaccgactataga

SEQ ID NO: 17714 - DNA, 201 bp, Homo sapiens
ctgtcagtagggtattgaaatctccaactattattgtttgtgaaactaagcctattcatagatctctaaaaacttgctttatgaatctgggtgcacctgtkttggctgcatatagatttagggtagttaggtcttcttgttaaattaaacctttcatcattatgtaatgccctactttttcctttttgatctttgttggtt

SEQ ID NO: 17715 - DNA, 201 bp, Homo sapiens
tgtccacccacagagttcaggtggaaatgggactgctgagttggaaactctagtgggtgtggcccatctggctatgggcctttggggtgggtaggattgcyagccctactgtctgggtgtttccaaagcaataggaggctgcacctctcagcaaattcagggagacatagggctgcagggctagaagctctagcaggtgtt

SEQ ID NO: 17716 - DNA, 201 bp, Homo sapiens
ggtcaagggtctaggaagccttcagagaaaggatttctagattaagtgctgtttcagctgagatctgtgggatgagtctaagcatggacaagggaacaggrtggaagaagaaagttccaggcattttacccttaaacagtttgatcaaaggaaacagggagagcccagacagaggagggagagagtgtaccaattgggtta

SEQ ID NO: 17717 - DNA, 201 bp, Homo sapiens
ggaaattgccacatccctaatggctggtggagattgatgaaagcactggtccctttctctattgatttcagttggagccatggaagtgtcaatgagtaaayccaagtttgctcttctgtgtatagctggctttattaaaagaattctaagcatttttctgtgaagggaaatctgattcccaggtgttacttttttgtcaga

SEQ ID NO: 17718 - DNA, 201 bp, Homo sapiens
attcatgcaatgatacattacaaataatagatggactgcaattatttataaggaattcactttgtcaagatactatggtcacagcatacagctcagatgayacttgtgtcaaaaaacattgactggctcagatgactcagaagttcgtggctggatctaagaattcaaatgatggcctaagaagtcagtctgttggcactg

SEQ ID NO: 17719 - DNA, 201 bp, Homo sapiens
gattgactggcttcgattctagtcttctgggtcttagaggagcctcctcctattactgtctctgtgtctgctttcttttgttggatattctggtctacagrgctccctcaggctggggctgcagttggccaacaagacatgtccttgccaggtcagccctaatctgctgttcatgtgcttcctggggaaacacagggttgt

SEQ ID NO: 17720 - DNA, 201 bp, Homo sapiens
atctggccatcattcaagggaaggattatgacaggcattgttagggtcacatgtacacccccaagaccaatcagagcagaagagtataggatactatgatkggctatgtctgcctacctctctggagagggcagtgggttcttaccagaaggagaataggggagggacaagggagagggaattacactggatagccaaaag

SEQ ID NO: 17721 - DNA, 201 bp, Homo sapiens
acaacttacccctataacattttgtttaaacgatttcatacctaaagaaaacttgaaataatagtacaatgaaaacccatataccctttaattagagtcawtccttgttaacattctgccacatttgctcgtggttctctttctctttcttgaatcatttgaaagtaagtttatgacttaggtaagggagatatcatgaca

SEQ ID NO: 17722 - DNA, 201 bp, Homo sapiens
ggtcggtggagctggaaatcagaagagatctgagtgggataaaccctctagaatggcaggaagagaaatagctgccgggaagagagctaataaaggaaacrgatgaggtggtctaaggggcccagcagaggctgcagacactgaatttgcaaggttgtgagtctaggctgctgtgtggttttctctggcagtcctaacagc

SEQ ID NO: 17723 - DNA, 201 bp, Homo sapiens
actacattgttttgctaatgttaatataactttacattcttggttaaaattcaacatatttcaatatgttattgctggattagtattctttttactattcrgtttttccctcttctagtttgggcattgtcactctcattctattaatttagtacttccttaagaatccaacatgtatgtatacttaactaagttaataaa

SEQ ID NO: 17724 - DNA, 201 bp, Homo sapiens
cttctttccttgcttcttcagaatagtgaattggtactctagtgacctctaaaggtgactaattagttttatcctgtctttggccaatgggagaaccctgyaagttggcctctatgttatttgattgatgaattgattgtacagtctgtgatagtttccttgctttcaggcatgaccaggtgtttcaggctcatcttgtct

SEQ ID NO: 17725 - DNA, 201 bp, Homo sapiens
ctttaatagaagactttaaaatttccaggagaatggaccttcctgtttctttgttttgtttttaagtttctagctttgttgtattatgatcagactgttgyttctaatatttctagattatagaaccactggtattttctttggtattatacttttaatatataaccaaatttttgtcaccgttctatttgctattgagga

SEQ ID NO: 17726 - DNA, 201 bp, Homo sapiens
agaatttgcttgtaaagctatctgggtttggaattttctctgtaaaagggtttgtttacagatataatttctgtaacagttttagaactattcagatgttstgtttcttcttgtgccagttttgatacatttttattgtatttttctaggaatttgtatttttatctatattttcacatttattgacataatatttattat

SEQ ID NO: 17727 - DNA, 201 bp, Homo sapiens
gttgtgtattgggtagaaaggattttaacttgttcaaagatttaactgggagcaaaaaaatttttgctggcttttctgcaaagaagggaggggcttgggartagaagatggcagaaaaaaagtataggaaatgagttttttgagacatttaagataaagaaaaagcaaagagagatgatagagatgggggtgagggtatga

SEQ ID NO: 17728 - DNA, 201 bp, Homo sapiens
agagatggggtttcaccatatttcacaggctggtcttaaactcctgagctcaagtgatctgcccacctcggcctcccaatgtgctggggaactattttctrttatctgttctggactcacacattctggatgactggaattctttggacccatatgagcctctgcaaagacattggtatgtgctggtcatattcaaatgtg

SEQ ID NO: 17729 - DNA, 201 bp, Homo sapiens
tgacattttaataaaaggtagacatgcagcatttaacaagtatctgctagtaaggatgtataagagccagtgatcaatgttgaaagcactcaatcgagaasggtcaaactagcttgctgttcacttgcttctggaaattgccacatccctaatggctggtggagattgatgaaagcactggtccctttctctattgatttc

SEQ ID NO: 17730 - DNA, 201 bp, Homo sapiens
gggcctttggggtgggtaggattgccagccctactgtctgggtgtttccaaagcaataggaggctgcacctctcagcaaattcagggagacatagggctgyagggctagaagctctagcaggtgttgtctgcctggttatcagtggttgaggtcagtagggtcacatgctctgctctccaggacaacaggaggctgtgctc

SEQ ID NO: 17731 - DNA, 201 bp, Homo sapiens
ttaagaacccttgctggagaactagtgtggttgggaggaaagaagacactctgactttttgagttgctggagttcttgcgttggttctctctcagctgtgygggccaatgttccttcagtctttgtccttttggatggattgttttgatttttattttctttgatgcctttgaatgtttgattatggtataaggcaagttt

SEQ ID NO: 17732 - DNA, 201 bp, Homo sapiens
ttagcttccttggattgggtttcaacattctcctgaatcttgatgatcttagtttctatccatattctgaattctatttctgtcatttcagccatctcagyctggttaagaacccttgctggagaactagtgtggttgggaggaaagaagacactctgactttttgagttgctggagttcttgcgttggttctctctcagc

SEQ ID NO: 17733 - DNA, 201 bp, Homo sapiens
actcacacattctggatgactggaattctttggacccatatgagcctctgcaaagacattggtatgtgctggtcatattcaaatgtgagattcataagaayggaataatttgtgtatggaattacctgtcctgggttacctaatccagagatccagcaatttttcttaattcctgaatttccaggcattgtaaagcatact

SEQ ID NO: 17734 - DNA, 201 bp, Homo sapiens
tctttgtacatctggcagaatttggctgtgaatctgtctggtcctgggctttctttggttcgtaggctattttttactgattcaatttcagagcttgttaytagtctgtttagggattcaatttctccctgattcagtcttgggaggatgtatgtatccagaaatttatccatttcttctagattttctaatttgtatgca

SEQ ID NO: 17735 - DNA, 201 bp, Homo sapiens
tggcctgacattttctttttttgttgtatctctgccatgttttggtatcaggatgatgctggcctcatagaatgagttggagatgactccctccccttcarttgtttggaatagtttcagtaggaatggtacccattcttctttgtacatctggcagaatttggctgtgaatctgtctggtcctgggctttctttggttcg

SEQ ID NO: 17736 - DNA, 201 bp, Homo sapiens
ttctgtccatgtgttcttgttatttagctcttataagtgagaacagacggtatctggttttctgttcctgtgttagtttgctgagcataatggtctaacgytccatccatgttcctgcaaaggacatgatctcattcttttttatggctgcatggtattccatggtctatatataccacattttctttattgagtctacca

SEQ ID NO: 17737 - DNA, 201 bp, Homo sapiens
aaggtagagaaggttcctcatacttcccatcttttgcaggctctgatcattgacttctatctctctgtgtgtgtgtgtaatatttcttatgtcatgttatrtgatttttattaaattgttttattttatatttatctcttttacagattataccttggtgctaactgacaacatattatttgctttatcatataatataca

SEQ ID NO: 17738 - DNA, 201 bp, Homo sapiens
tcatttgtttcagtttcttttttatttttaagaattgattttcccgtttcttttttcatttttgatatgtaaaacacttacatggttcaaaatcaacactrtatagtgaggtacattcagagaaatctctctttcattcctatctcctctaccctgttcctttactccttctgtaggtaaccactgttactggtttatgta

SEQ ID NO: 17739 - DNA, 201 bp, Homo sapiens
taagggaacttagtggcattccagaattatcctgaaagctgcaaacacaaattattcattactggtacttatgaaaacactttttcagtacatccacttawgaatctttggttcttattgttttacattctagcttacaccctcagagttcctgaaggaaatgtccctgaccaccgagcagagactggcaaaaacacgttt

SEQ ID NO: 17740 - DNA, 201 bp, Homo sapiens
catttttaaagtacattgtgtttaacccaaggcaacataaagcagctaagttatataccctcaaatgttttgtaaaaatcttggcatatacttgagcattrtgtagctgccaatgatcataatctccctgcacatatagtaggaacattctagaaccacaataacattggttctgggtaactaatcccttgttgggttagt

SEQ ID NO: 17741 - DNA, 201 bp, Homo sapiens
attttatttttagaaagtttttcttgaattatcaagtatttttttcatatcatttttcaatgatgaatatgttggaccttctttgtctgcccttctacagyttgcatttcctctctcattcatttttaactttctgttcatttccattgcattgtcattacattcattaggctatcctctgtgtcccttactttgagttat

SEQ ID NO: 17742 - DNA, 201 bp, Homo sapiens
gtcaactatcagtctccccacctttgatgggtcctgggtgttgacctttcctggaagccctaccaggcagccacaagcagagctcagggtgtccttgtctrgaggattatctcctaccaaatttgtttcagtgctccacttacctttcttggtccctgttttcagttagatgttggctagataattccttatggtcttgtt

SEQ ID NO: 17743 - DNA, 201 bp, Homo sapiens
tcctctcttcctattttgatgccttttatttctttctcttgcctgattgctctggccaggacttccagtactggaagtggtgagagtggacatcctttgasttgttccaggtttcaagggaatgcttccagcttttgcccattcagtatgatgttggctctgagtttgtcatgcacagctctcattattttgaggtatgtt

SEQ ID NO: 17744 - DNA, 201 bp, Homo sapiens
ccacttctcagaaaatcacccataggggaatctggccctcgctttttaggttcctgttcgtcttgccagattttacaaccatcacctattctgttggtgcytcctcttaccttaagaatcctctgcctgagccaagctggattgtctccctgtgcctagaattagcaaatgtccccagagaaaaacatgaccagtaacttc

SEQ ID NO: 17745 - DNA, 201 bp, Homo sapiens
ttcctctcttcctattttgatgccttttatttctttctcttgcctgattgctctggccaggacttccagtactggaagtggtgagagtggacatcctttgwgttgttccaggtttcaagggaatgcttccagcttttgcccattcagtatgatgttggctctgagtttgtcatgcacagctctcattattttgaggtatgt

SEQ ID NO: 17746 - DNA, 201 bp, Homo sapiens
atggatttctttttgaatatttcccatgtttagttttaatatccacaggtctacgtagtattttcttatcttccccagtcatttttgtcaatgtgtgactrtaacaataatttactctttcaactgaagttttcaggaattgacctggatcaggcattattccagccctttccatcagaaattatatttcagaactacact

SEQ ID NO: 17747 - DNA, 201 bp, Homo sapiens
attgttgttgatttttgtttttcagcacattgacgtttttgaagactccagttgttttacagaattgctgtatcattttttcttagattcccgtgccttgmagatatcatcaagcttgtatgttagtacttcaaacatattaatcatggtttttttgtaatctgtatctaataattcccctatgtgaagcctttcatggta

SEQ ID NO: 17748 - DNA, 201 bp, Homo sapiens
tttgtctgccagacactcagttctcatggataaccaacatctcttgataagatgcagccagagtgctggccacatggaaagagggtcccatcctaggaacrcccagctaccaagaggcagacagttctctccaggcgaggcaggcttgtcctctggtgactccaggaccctcatgccaggtggctgatgtgaccctgctcc

SEQ ID NO: 17749 - DNA, 201 bp, Homo sapiens
ttgtctgccagacactcagttctcatggataaccaacatctcttgataagatgcagccagagtgctggccacatggaaagagggtcccatcctaggaacgyccagctaccaagaggcagacagttctctccaggcgaggcaggcttgtcctctggtgactccaggaccctcatgccaggtggctgatgtgaccctgctcct

SEQ ID NO: 17750 - DNA, 201 bp, Homo sapiens
tgaaacacattttccaggttgcttcctttctcccagtctctttcatggacaccagtgagtcatagatttggtctcttttcataatcccatatttcttggargttttgttcattcatttttattctgttttctttattcttatctgactgttatatttcagaaagtcggtcttcaagctctgagagtctttcctcagcctag

SEQ ID NO: 17751 - DNA, 201 bp, Homo sapiens
ttgaactaaatataattgaaagaatgaagacattaccaagggaatccttcaatgtttccccacagcacttacagtctaaatcattcaattctgcacgcaattagttggcccacatagtttgtaattaaattattccacaagcatttaaggttcacaaaggaggaagcatcttcatcttgttatctgttgtatctcccagtc

SEQ ID NO: 17752 - DNA, 201 bp, Homo sapiens
tgaactaaatataattgaaagaatgaagacattaccaagggaatccttcaatgtttccccacagcacttacagtctaaatcattcaattctgcacgcaattagttggcccacatagtttgtaattaaattattccacaagcatttaaggttcacaaaggaggaagcatcttcatcttgttatctgttgtatctcccagtca

SEQ ID NO: 17753 - DNA, 201 bp, Homo sapiens
gaactaaatataattgaaagaatgaagacattaccaagggaatccttcaatgtttccccacagcacttacagtctaaatcattcaattctgcacgcaattagttggcccacatagtttgtaattaaattattccacaagcatttaaggttcacaaaggaggaagcatcttcatcttgttatctgttgtatctcccagtcaa

SEQ ID NO: 17754 - DNA, 201 bp, Homo sapiens
acatttagaacatgaaaacgctcatcaggtttgaaagaaactcatagcctgttagtattgaaaccatgttttaattggtacacattcgggatctgtgtaayagatttttgaccctggatgtgtcagccctcagattttatgtttatgttaatcttctgggggatagtgttcatagccatcatcagatttccagtaggacct

SEQ ID NO: 17755 - DNA, 201 bp, Homo sapiens
aggctatatataatttttgttgaatgttgaactacattgttttgctaatgttaatataactttacattcttggttaaaattcaacatatttcaatatgttwttgctggattagtattctttttactattcagtttttccctcttctagtttgggcattgtcactctcattctattaatttagtacttccttaagaatccaa

SEQ ID NO: 17756 - DNA, 201 bp, Homo sapiens
cgacttttttttttttatgctcaaattgtctcatctttggttaatgggaatgctttcaagttgctctggatccctgacaaccctggtagctcttgataacrttcttgttttatggtatgagacaatgtgccaagttcactgtatacattttgtacccttgtcctcaaattacccatttctccaaggagttgtgatttctgt

SEQ ID NO: 17757 - DNA, 201 bp, Homo sapiens
ttgtaattttagtagagacggggtttcaccatgttggtcaggctgggctcaaactcctgacctcaggtgatccacccacttcggcctcccaaagttttggrattacaggtgtgagccaccacgttgggctgcgagggtaattcttgacgatcactgcaatgcaaactgccatcttggaaggccaataatagtccttctgtc

SEQ ID NO: 17758 - DNA, 201 bp, Homo sapiens; identical to SEQ ID NO: 3073

SEQ ID NO: 17759 - DNA, 201 bp, Homo sapiens
agctgggcatggtgacgcacgcctgtaatcccagctacttggaaggctgaggcaggagaattgcttgaacccggaggtcgaggttgcagtgagccaagatsgctccactgcactccaccctgggaacagagcaagatcccatctcaaaaaaaaaaaaaagaaagaaaagaaagagagagagagagtgcgagccgagtgtgg

SEQ ID NO: 17760 - DNA, 201 bp, Homo sapiens
ctaggattacaggtgtgagccaactatgctgggaaatcagccaaccaacctggctcaggctcagggtcctctcctggtcagccaaccaacctgatttctargtttttaatcctggtttcatcacctagaatatttttcttgttgaagctactctaaacataagataatgcatgcattgtaagtatatagcttaattagttt

SEQ ID NO: 17761 - DNA, 201 bp, Homo sapiens
aaccctggttctgtccccatggggctcacaacccagtgggaggacagacccatccccagacaacccagagtgggcagggcttggggagtcaagagcactayaggagcccacagggggcatctgccccagatttggaggagtcagggagggcttcctggaggagggaacctgggccagagggtggaggagaggcatcctggg

SEQ ID NO: 17762 - DNA, 201 bp, Homo sapiens; identical to SEQ ID NO: 3067

SEQ ID NO: 17763 - DNA, 201 bp, Homo sapiens
cagagtgggcagggcttggggagtcaagagcactataggagcccacagggggcatctgccccagatttggaggagtcagggagggcttcctggaggagggracctgggccagagggtggaggagaggcatcctgggcagaggagagagcagataggagggcttgtgctttctctctgtcctccgcagattttccacacgca

SEQ ID NO: 17764 - DNA, 201 bp, Homo sapiens; identical to SEQ ID NO: 3076

SEQ ID NO: 17765 - DNA, 201 bp, Homo sapiens; identical to SEQ ID NO: 3070

SEQ ID NO: 17766 - DNA, 201 bp, Homo sapiens
aggatgtgaagttcaagcttcggcatgacctggcgcagctgcaggccgctgccagctcagcccaggacctgagccgcgagcagctggctctgctgaagctrgtgctgggccggggcctgtacccacagctggccgtccccgacgccttcaacagcagccgaaaggactcagaccaggtggggcctgttctgccccatccta

SEQ ID NO: 17767 - DNA, 201 bp, Homo sapiens
tgatgcagtgagccgagaccatgccattgtactctagcctgggcgacagagcgagactccatctcaaaaaaaaaaaaaaaaaaaagcaaaaacaaacaggygagattcattttgataaaatagctgattcaacctaatatacctaaaacatcacaattttaacataatcaatagaaacatttttgcaagattttatgttat

SEQ ID NO: 17768 - DNA, 201 bp, Homo sapiens
ttggagatgggcaagctgaggcccagagggggcagtcacccagccgacacctcctgtaccatttctggggtcccggtgttggggaccacagatgccccgawtgctctgagcatgggtcccgagttctctctggctgctagagcagtgttcaggcttcattggtccccagatgctttgagaatctaatggaaagtgtgagcc

SEQ ID NO: 17769 - DNA, 201 bp, Homo sapiens
tgcagtgagccgagaccatgccattgtactctagcctgggcgacagagcgagactccatctcaaaaaaaaaaaaaaaaaaaagcaaaaacaaacaggtgasattcattttgataaaatagctgattcaacctaatatacctaaaacatcacaattttaacataatcaatagaaacatttttgcaagattttatgttatttt

SEQ ID NO: 17770 - DNA, 201 bp, Homo sapiens; identical to SEQ ID NO: 3066

SEQ ID NO: 17771 - DNA, 201 bp, Homo sapiens
cctgactcaagactttctatttccagcagcctgaggcccaccatggcaggaccacccatgtatgtgtgttaacaccattaaagcccccatccttgcagcayagcagggcttcagtgtgggcaggaggctggatccgctggacttggagggctgcccaggctaagaagatggttcatttttgttttatttatttatttagag

SEQ ID NO: 17772 - DNA, 201 bp, Homo sapiens; identical to SEQ ID NO: 3081

SEQ ID NO: 17773 - DNA, 201 bp, Homo sapiens
cagccaaccaacctggctcaggctcagggtcctctcctggtcagccaaccaacctgatttctaggtttttaatcctggtttcatcacctagaatatttttyttgttgaagctactctaaacataagataatgcatgcattgtaagtatatagcttaattagttttcaccagttacatacatctgtgtagctagcacccagg

SEQ ID NO: 17774 - DNA, 201 bp, Homo sapiens
agacggttcctgccacttttcctctctgtggcctcccctctgtccttcctcccctttccctacctctcccagcccctgccccatctttctccatgtcttcrccttctgtcccctcttcctcttccacttccaccttgacctaaacaaaggctgcaggagaagattcatcctgtgataagcacaggagtcagtgcctgcctg

SEQ ID NO: 17775 - DNA, 201 bp, Homo sapiens
cacaggacttgtgtaactccacaaacacagggctcgggggctgtacttgtgcaaagtcgtagccacctagtggcagagccaggctgcgaacccaggtagtytggccccggagcccatgctctaaaccagaggtcggcaaactttctataaagggtcggagtagatgatgtcagtcctatcgaccatgggctctctgtctgt

SEQ ID NO: 17776 - DNA, 201 bp, Homo sapiens
tatcgaccatgggctctctgtctgtcacagctactcagccccactgttgcagcatgaaagcagccataaactgagtgggtgaggctgtgttccaaaacagtttttttttttttttgaaacagggtcttgctctgttgtccaggctggagtgcagtggcacgatcagggctcactgcagccttgacttcttgggctcaagtg

SEQ ID NO: 17777 - DNA, 201 bp, Homo sapiens; identical to SEQ ID NO: 3064

SEQ ID NO: 17778 - DNA, 201 bp, Homo sapiens
gagctgtgatcacgccactgcactccattgtaggccacagagtgggatcctgtctcaaaaaaaaaaaaaaaagttcaagatgttcaggtcgggggagcagktgtggtggctcatgcctgtaatcccagcacattgggaggccaaggcaggcggatcacctgaggtcaagagttcaagaccagcctggccgacatggtgaga

SEQ ID NO: 17779 - DNA, 201 bp, Homo sapiens
aagtgaggggggcgggacgggtgtaccgggttgtggcggcgatggctgtcggagttgggccgcttgggggtagtttggggtgcgagtccaggggcgagggmagtctcgagatgaggagaaatgtaggaggcagccgaagggccggcaaacgcggacagagatggcacctgagcgtccctgggagaacctgggcgacaggcc

SEQ ID NO: 17780 - DNA, 201 bp, Homo sapiens
cagagcagcggaagggccgggcgggccgcacgggccccggagtctgcttccgcctctatgccgaatcggactatgatgccttcgccccctaccccgtcccrgaaattcggagggtggccctggactcgttggtgctgcaggtgaggcatgggcagaaaggggactatatcctaactgctggcacagggaggaacctgggag

SEQ ID NO: 17781 - DNA, 201 bp, Homo sapiens
tccgcctctatgccgaatcggactatgatgccttcgccccctaccccgtcccagaaattcggagggtggccctggactcgttggtgctgcaggtgaggcaygggcagaaaggggactatatcctaactgctggcacagggaggaacctgggaggccttttttattttattttattttattttattttgagatagcgtcttg

SEQ ID NO: 17782 - DNA, 201 bp, Homo sapiens
tagcgtcttgctctgtcactcaggctagagtgcagtgctgtgatcatggctcactgcagcctccatattacaggctcaaatgatcctcctacctccacctsccaagtagctgggaccacaggcacacaccaccacgcttggctaacttttaaatttttatttatttatttatttttgagacggagtctccctctgtcgccc

SEQ ID NO: 17783 - DNA, 201 bp, Homo sapiens
tgctgtgatcatggctcactgcagcctccatattacaggctcaaatgatcctcctacctccacctgccaagtagctgggaccacaggcacacaccaccacrcttggctaacttttaaatttttatttatttatttatttttgagacggagtctccctctgtcgcccatgctggagtgcagtggtgcgatctcggctcactg

SEQ ID NO: 17784 - DNA, 201 bp, Homo sapiens
ttgagaatagaataaaagggttcctggtgtaatccattctgtttggttggagatgggcaagctgaggcccagagggggcagtcacccagccgacacctcckgtaccatttctggggtcccggtgttggggaccacagatgccccgattgctctgagcatgggtcccgagttctctctggctgctagagcagtgttcaggct

SEQ ID NO: 17785 - DNA, 201 bp, Homo sapiens
cagaataaaggagtaagtgagggtgttggcgagtgacaagagccaggcgcgtggccagctgcacgtggctgccacacacagactccctttcctcattgctyccatccaggaaaggtgaaggagatgagctacgatccgcaggccaagctgcaacggctgcaggagttctggattagtcaggccagcgcagagcagcggaag

SEQ ID NO: 17786 - DNA, 201 bp, Homo sapiens
ttcggcgccagttcaaggtgaggctcgggaggaggggtaaggccggccccactcaggcagacgtgtgtaagcacactccagaacactgcttccccttcccrgacagtggtcagaccagaatcccaccctgcacccacctcccccaccacccggtgaccaggtgttggggcagctgggcagagcaaagggagcagaaatcca

SEQ ID NO: 17787 - DNA, 201 bp, Homo sapiens
cataggagggggcactggggctgagacctggaagcaggagagcaggtgtccctgagggatgcccattttggggctctgggtgctcggtcagcccctccctscccgcactggccaggccctgacaccctggcgtctgctcctccacccaggtgaaatctgaacggagcagaaactctcgcaagtggtgccgccgccggggca

SEQ ID NO: 17788 - DNA, 201 bp, Homo sapiens
ccagtatatgtcccttgagtcctcaccctaaccctggccctgtagtgtagtgctgggggcccatcagtgccaaaactaccctggccctgccctcccggggytcacagcccagtgcagggagacagaccactgatgtgacagtgacaacccagagagggctggaatggggagtccagggggctgggacaacccagcggggca

SEQ ID NO: 17789 - DNA, 201 bp, Homo sapiens
tggccagctcacacctggaatcccagcaccttgggaggctgaggtgggaggattgtttgagcccaggagttcaaaggcagcctgggcaacatagggagacwctatctatctctacaaaaaattttaaaaagttagctgggcgtggtgttgtgtgcctgtaatcccagctactcgggaggctgaggcaggaggattgcttga

SEQ ID NO: 17790 - DNA, 201 bp, Homo sapiens
ctcacacctggaatcccagcaccttgggaggctgaggtgggaggattgtttgagcccaggagttcaaaggcagcctgggcaacatagggagactctatctrtctctacaaaaaattttaaaaagttagctgggcgtggtgttgtgtgcctgtaatcccagctactcgggaggctgaggcaggaggattgcttgagcctggg

SEQ ID NO: 17791 - DNA, 201 bp, Homo sapiens
ggagactctatctatctctacaaaaaattttaaaaagttagctgggcgtggtgttgtgtgcctgtaatcccagctactcgggaggctgaggcaggaggatygcttgagcctgggagattgaggctgcagtgagctgtgattgttgacactgcactccagcctgggtgacagagtgagacactgtctcaaaaaataataagc

SEQ ID NO: 17792 - DNA, 201 bp, Homo sapiens
acatttgaaaatcaatctgattcaccatattagaaacagaaaaaaaaaaaaaggttgggcatggtggttcatgcctgtaattccagcactttgggaggccsataagggtggatcagttgagtccaggagttccagactgggatggggaacatagcaagaccctgtctctattaaaaaacacaaaaattagccaggtgtggt

SEQ ID NO: 17793 - DNA, 201 bp, Homo sapiens
gctggagtgcagtggtgcaatctcagcttactgcagcctccacctcctgggctcaagtgatcctcccaaatcagtctcccaagtacctgggattacaggcrtgtgccaccatgcccagctaatttttgggtgtgaataggtttttttgtttgttttttgtagagagtttcaccatgatgcccaggttggtctggaaccatg

SEQ ID NO: 17794 - DNA, 201 bp, Homo sapiens; identical to SEQ ID NO: 3084

SEQ ID NO: 17795 - DNA, 201 bp, Homo sapiens
tgaggctgggcccaggaggctcctgagggcatggggaagcctggctttgatcggaggtgatggtaaatgcctcactcacattatctccctgagggctgggkgcaggtgcccccacttgccctgtggggaaaacgaggctcagagaactgctgctcagggtcacagtgggaactgagaggcacggatgaccctgtgctgggc

SEQ ID NO: 17796 - DNA, 201 bp, Homo sapiens
tgaagcaggagagtcgtttgaacccaggaggtggaggttgtggtgagccgagattgagccattgcactccagcctgggcaacaagagcgaaactccactcaaaaaaaaaaaaaaaaaaagatttgggtttctcctgcgcccacacagttctgcagcttgtttcatagatactgttctccatctgagtgcagacagacctgc

SEQ ID NO: 17797 - DNA, 201 bp, Homo sapiens
gcgcatcgcccatgagaacacctgcccccaggccccacaggatgggcccccaggtaagcacaggactgtggggacccggccacctctgcccagccgtctgyccatcccatgatggtctcctgtgcgtgtgagcacttgctagagcttcgaggactgacgacctccacccgctggccctggctggtgccacacacaggcctt

SEQ ID NO: 17798 - DNA, 201 bp, Homo sapiens
ccagcacccgaaggggtgcctggtacagcgggtagatggcgggtaggtggatgcctcacatagacagggctggtgggtgggcaggagcccagccgggcagrgcctgtctccaatagcgccctgcccctcccacctactccctgtcttctgccccctctctttcagtccctcctgctttttagccggtctttggacaccaat

SEQ ID NO: 17799 - DNA, 201 bp, Homo sapiens
cctcccaagtacctgggattacaggcgagtgtcaccacacccagctaattttgtatttttagtagagacgggggtttctctatgttggtcaggctggtctygaactcccgacctcaggtgatctgcccgcctcagcctcctaaaaatgttgagattacaggcatgagccaccacgctcagcctcaacagtcttttaaaatg

SEQ ID NO: 17800 - DNA, 201 bp, Homo sapiens; identical to SEQ ID NO: 3069

SEQ ID NO: 17801 - DNA, 201 bp, Homo sapiens
acatacctgtgccagcagcacccagataaaaaaataaaacaccagcagccctccacccgctgcagcccagctcctccgtctcccaggagtgtccaatattytttttttttgagatggagttttgctcttgtcgcccaggctggagtgcaacggtgcaatctcggctccctgcaacctctgcttctgggattcaagcaattc

SEQ ID NO: 17802 - DNA, 201 bp, Homo sapiens; identical to SEQ ID NO: 3113

SEQ ID NO: 17803 - DNA, 201 bp, Homo sapiens
gaatcgcttgaacctgggaggtagaggttgcagtgatgcagtgagccgagaccatgccattgtactctagcctgggcgacagagcgagactccatctcaamaaaaaaaaaaaaaaaaagcaaaaacaaacaggtgagattcattttgataaaatagctgattcaacctaatatacctaaaacatcacaattttaacataat

SEQ ID NO: 17804 - DNA, 201 bp, Homo sapiens
atcgcttgaacctgggaggtagaggttgcagtgatgcagtgagccgagaccatgccattgtactctagcctgggcgacagagcgagactccatctcaaaamaaaaaaaaaaaaaaagcaaaaacaaacaggtgagattcattttgataaaatagctgattcaacctaatatacctaaaacatcacaattttaacataatca

SEQ ID NO: 17805 - DNA, 201 bp, Homo sapiens
tacctaacaaatctttgcctaccctcaagatcatgaagttttttcttatgttttcttctagtttaatagttttagatttttaatataaaccgttaggtctrtggtccatttccagttaggcattgtgtatgatgtgagttaacgctcatggctcatttttctgcatatggatgtctaatggttccagaaccattttttgaa

SEQ ID NO: 17806 - DNA, 201 bp, Homo sapiens
tactagggagactgaagtgggaggattgcttcagcctgggaggttgaggctgcagtgagccgtgatctcatcactgcactctagcctaggtgacggagcgrgaccctgccgctaaataaataaataaataaataacatagtagtgatacctgtgtctgcggtcattactccagaacagcacttcacatatagtttctcctt

SEQ ID NO: 17807 - DNA, 201 bp, Homo sapiens
cggtgaccaggtgttggggcagctgggcagagcaaagggagcagaaatccaggagggcttcctggaggggtggaccgagtcagtggacatgcagcatcctygggaagagctcgccctccggactggggatgctgagctggctgcatgggcatggtgttggaggcagcctacggttgtggttggccggcacatctggagcca

SEQ ID NO: 17808 - DNA, 201 bp, Homo sapiens
ctaacctcctgggaatgcagcccataggtctcagccttatttcacccagctcctgttcaagatggagtcactctggttcacatgcctctgacatttccccrctcccttttataagagaacctttaatcctaagggttgtagagggaggaagatacaacttctgtgacttcttcaggctggacaggggtgacgatatacctg

SEQ ID NO: 17809 - DNA, 201 bp, Homo sapiens
cagctgggcagagcaaagggagcagaaatccaggagggcttcctggaggggtggaccgagtcagtggacatgcagcatcctcgggaagagctcgccctccrgactggggatgctgagctggctgcatgggcatggtgttggaggcagcctacggttgtggttggccggcacatctggagccagacacctcagccacagatc

SEQ ID NO: 17810 - DNA, 201 bp, Homo sapiens
gtcacaagcagatgtggtgctcctcgtccccacgctgtgtcatcaggaatagggcgttaatcttgagggatttggggccagcagaccctctgaccctgtckttcttgtgtgcaccgtcagtgtctcaggcactcacctgacgctgcagatgccaccaccagaggctgggtgtggcctgtggtgtctggcttgcaaggctgt

SEQ ID NO: 17811 - DNA, 201 bp, Homo sapiens
tccggactggggatgctgagctggctgcatgggcatggtgttggaggcagcctacggttgtggttggccggcacatctggagccagacacctcagccacaratcccagctctgccatttctgacagcgtggccccgggtgtgttactgcttgtctctgggcctcagcttcccctcgataaaaagagaggataaaaatagca

SEQ ID NO: 17812 - DNA, 201 bp, Homo sapiens; identical to SEQ ID NO: 3080

SEQ ID NO: 17813 - DNA, 201 bp, Homo sapiens
ctggccatctccaatctacaaatggggaaactgaggcccttgcccatggccacgtgaccagaaagcacagcgcgtgggtttgaatctccatctgggtcacragacccttagtgggcaagatggagggggtgggagcaggagggcaggcgggagggcaggctggggccccgaggggtgagggctgcgcctgtcctggcaccc

SEQ ID NO: 17814 - DNA, 201 bp, Homo sapiens
atttctgacagcgtggccccgggtgtgttactgcttgtctctgggcctcagcttcccctcgataaaaagagaggataaaaatagcacttgccagccgggcrtggtggctcacgcctataatcctagcactttgggagggcgaggtgggtggatcacgaggtcaggagatcgtgaccatcctggacaacatggtaaaactcc

SEQ ID NO: 17815 - DNA, 201 bp, Homo sapiens
ccaggcctccctgggtagccttgggtgactcacccctgctgggcctcaccttccgcatggtggtgatagtcaacctaagccagtgtggctgtgcccagagmgtgagcaccggtcagggggcctgtcctatggactctgtgagctcccaggtgggtcctgcagagggaggcccccctggcacccgtgtgcatggaagggtgt

SEQ ID NO: 17816 - DNA, 201 bp, Homo sapiens
tggggccacatgcctccatccccggctggctgtgtctgcctctcagtctccatgtctctccttgtgtctttctctctgtctctctcactggcagggatgcrgagtaaagacagacctgtgtatttttattaatctgggagggcttcctggaggaggcaaaactgggttctccaaaggccaggagagaacctgagccccaca

SEQ ID NO: 17817 - DNA, 201 bp, Homo sapiens
atttttattaatctgggagggcttcctggaggaggcaaaactgggttctccaaaggccaggagagaacctgagccccacaggtgcctggcatttgggtgcrggtagacctgtgcactggaacacgcccctcacagcctcctccttttcctcccttaggggctgaggaagctgccctcgaaaccctccagaagacatctgtc

SEQ ID NO: 17818 - DNA, 201 bp, Homo sapiens; identical to SEQ ID NO: 3071

SEQ ID NO: 17819 - DNA, 201 bp, Homo sapiens
ccgagggacagaggattggcgaccagccgggccgcaggaagcggaacagacctgctacctgaggcgctctctccctgcactggactgcttgttgagagaayctggccagctcacacctggaatcccagcaccttgggaggctgaggtgggaggattgtttgagcccaggagttcaaaggcagcctgggcaacatagggaga

SEQ ID NO: 17820 - DNA, 201 bp, Homo sapiens
tgggaggtggaggttgcagtgagccaagattgcgccattgcattccagcctgggcaacagagtgagactcatctcaaataaataaataaattaataataakaataataagaagaagaagatggagaaacttcacattcacataagcaggcagaacagtatatggagccctcctgtaccatccccggtccccaaaccatcca

SEQ ID NO: 17821 - DNA, 201 bp, Homo sapiens
gacactagaaacagaaaaaatggaatttagatggagaaacgagacactgaatcacgggggagaccgagagatacggaaggatggagacagttgaaataggragaaccccacaaaagctggagataatggagaacgatgctgagaaatggaaaagcgagggagtggagcccgaacccctggatttgagtggctcatgtaaca

SEQ ID NO: 17822 - DNA, 201 bp, Homo sapiens
gaggtggaggttgcagtgagccaagattgcgccattgcattccagcctgggcaacagagtgagactcatctcaaataaataaataaattaataataataakaataagaagaagaagatggagaaacttcacattcacataagcaggcagaacagtatatggagccctcctgtaccatccccggtccccaaaccatccacgc

SEQ ID NO: 17823 - DNA, 201 bp, Homo sapiens
cgatgattcttctagaactttatccacagagtggcttgtctgtggtctacatgacaaaggagctagcattaaccagtgtagcactttaacagcaaaacaaygggaaatgtcctaaaggctcatcactttttttttgagacggagtctcactctgtggcccaggctggagtgcattggtgcgatcttggctgactgcaacct

SEQ ID NO: 17824 - DNA, 201 bp, Homo sapiens
gttcagcctggtggagcctgtgctcaccatcgcagccgcacttagcgtccagtcgcccttcacccgcagcgcccagagcagcccagagtgcgcggcagcayggcggccgctggagagcgaccagggtgaccccttcacgctcttcaacgtcttcaacgcctgggtgcaggtgaggctggtggtgggggccctctgtctgtc

SEQ ID NO: 17825 - DNA, 201 bp, Homo sapiens
gagaaacgagacactgaatcacgggggagaccgagagatacggaaggatggagacagttgaaataggaagaaccccacaaaagctggagataatggagaaygatgctgagaaatggaaaagcgagggagtggagcccgaacccctggatttgagtggctcatgtaacactcggctactcacttagcctctctattgctcag

SEQ ID NO: 17826 - DNA, 201 bp, Homo sapiens
gtggaggttgcagtgagccaagattgcgccattgcattccagcctgggcaacagagtgagactcatctcaaataaataaataaattaataataataataakaagaagaagaagatggagaaacttcacattcacataagcaggcagaacagtatatggagccctcctgtaccatccccggtccccaaaccatccacgcatg

SEQ ID NO: 17827 - DNA, 201 bp, Homo sapiens
aattatatccaacgttccacttgacatccccagttgatgtccaatgcataactcaaacaatatgctgaaaacagatcttcggattttctctctagcctctytcccacgtcttcctgatggtagtagatggtgactccatatttccaaatgctcaggccaaaaactttagagtccttcttttttttagacatagaacttttt

SEQ ID NO: 17828 - DNA, 201 bp, Homo sapiens
ccgggcacaatgagtgactcatgcctgttatcccagcactttgggagggtgaggcaggaggattgcttgaggccaggaagtcgagaccagcctaggcaacwcggtgaggccctgactctagaaaaaatttaaaaattagcccagtgtgatggcacacacctgtggtcccacgcaggaggctgaggcaggaggatcgctaga

SEQ ID NO: 17829 - DNA, 201 bp, Homo sapiens
agcaaagaccaagccagggaagcatcagagcgctgggggagtgggttgtaaatagcaaagtggggaacttggtgacaggagtagtcagcgcttagacagtrtctcctgtgtgtccaaggaggcagggactggccatctccaatctacaaatggggaaactgaggcccttgcccatggccacgtgaccagaaagcacagcgc

SEQ ID NO: 17830 - DNA, 201 bp, Homo sapiens
ataggaagaaccccacaaaagctggagataatggagaacgatgctgagaaatggaaaagcgagggagtggagcccgaacccctggatttgagtggctcatstaacactcggctactcacttagcctctctattgctcagtaaaatagggggtgatcatagtgcctgacagtcgtgagaaaagtgtgtgtgtgtatgtacat

SEQ ID NO: 17831 - DNA, 201 bp, Homo sapiens
ttttttgttttttgttttttttagtagagacgacgtgttgctatgttgtctgcctggtcacgcatacctgagctcaagcaatcctcccgccttggcctccsaaagagctaggattacaggtgtgagccaactatgctgggaaatcagccaaccaacctggctcaggctcagggtcctctcctggtcagccaaccaacctga

SEQ ID NO: 17832 - DNA, 201 bp, Homo sapiens
ccggtccccaaaccatccacgcatggccagtcctgccctttcctctgccctggccccagccctgaggattttccccaacatcttatgagccacagcactgstaattacagcgctgacttccgtcctcacagaggagcgtgtgctcagggtctgggctctccctgcacgtcgtgtgtgtctgagtgcctgctgtccctctgc

SEQ ID NO: 17833 - DNA, 201 bp, Homo sapiens
ttcctctctgtggcctcccctctgtccttcctcccctttccctacctctcccagcccctgccccatctttctccatgtcttcgccttctgtcccctcttcstcttccacttccaccttgacctaaacaaaggctgcaggagaagattcatcctgtgataagcacaggagtcagtgcctgcctgtgccagggcagagctaga

SEQ ID NO: 17834 - DNA, 201 bp, Homo sapiens
ctctccctgtggtgcagtgaccattcttgtgcctgtatctagttatttctctaggatagattttaggaaagactctgtcatgttccagagctaccacaaasagctccaggcttatatcaaacttgcctgattatgatggataaaatgagagcttttctgtcctagcaaccgagtgtaaattccacaaaagggccctgattg

SEQ ID NO: 17835 - DNA, 201 bp, Homo sapiens
ctccaccctgttgtcacccagggatgccacacactggggttcagtgggggagatagcactggggccacatgcctccatccccggctggctgtgtctgcctstcagtctccatgtctctccttgtgtctttctctctgtctctctcactggcagggatgcggagtaaagacagacctgtgtatttttattaatctgggaggg

SEQ ID NO: 17836 - DNA, 201 bp, Homo sapiens
aaaaattagctgggtgtggtggcatgtgcctgtagtcccagctgctcgggaggctgaggcgggaggatcgcttgagtccaggaggtcgaggctgtggtgasccatgattacggcactgcactccagcctgggaaacagagtgagaccctgcctcaaaaagaaaaaaacaaaacaaaaccaaaaaaagcaatgttcccaaaa

SEQ ID NO: 17837 - DNA, 201 bp, Homo sapiens
gtgaggggggcgggacgggtgtaccgggttgtggcggcgatggctgtcggagttgggccgcttgggggtagtttggggtgcgagtccaggggcgagggaastctcgagatgaggagaaatgtaggaggcagccgaagggccggcaaacgcggacagagatggcacctgagcgtccctgggagaacctgggcgacaggccag

SEQ ID NO: 17838 - DNA, 201 bp, Homo sapiens
gtggcacaatcacagctcactgcagcctcgacctcctgggctcaagtgatcctcctgcctcagcctcccgagtagctgggaccacaggcctgcaccaccayatctggctaattgtttaaactttttgtagagacaggtctcactatgttgcccaggctagtctcgaactcctggccttaagagattctcccacctgggcct

SEQ ID NO: 17839 - DNA, 201 bp, Homo sapiens
tcttcgctggcagccccgaggtgctgcacgcacaggagctggaggccagcaactgcgacggaagccgaggtacagtgagcccaggcggaaggaacccccayccgggatgtgaggggcagggataccgtgaactcccaggcccctctggctggggctcccacaccggcccaggctggtattgacgggggcccacaggagggg

SEQ ID NO: 17840 - DNA, 201 bp, Homo sapiens; identical to SEQ ID NO: 3083

SEQ ID NO: 17841 - DNA, 201 bp, Homo sapiens
ctgcctcagccttccgagtatgtgggattacaggcacccgccaccatgcccagctaattttgcatttttagtagagacgggttttcaccatgttggccaarttggtcttgaactactgacctcaggtgatcctcccgcctcagcctcccaaagtgctgggattacaggcgtgagccactgcacccggccgtgaccaacatt

SEQ ID NO: 17842 - DNA, 201 bp, Homo sapiens
ccagatgaaacatacctgtgccagcagcacccagataaaaaaataaaacaccagcagccctccacccgctgcagcccagctcctccgtctcccaggagtgwccaatattctttttttttgagatggagttttgctcttgtcgcccaggctggagtgcaacggtgcaatctcggctccctgcaacctctgcttctgggattc

SEQ ID NO: 17843 - DNA, 201 bp, Homo sapiens
agcacttggctcccgtaactgcaaagcccgagggagggcttcaggcacagctggatccaggtgctttggcggcatctccctgagtctgtctctctccattkcctgtctctccttccttagattccttacagcctccggcggctcacagggctagaagtccagaacatgtatgtgggaccccagaccatcccagccaccccc

SEQ ID NO: 17844 - DNA, 201 bp, Homo sapiens
caccataagacccactcacaataaaaaaataaaaggccgagccgggcatggttgctcactcccgtaataaaaaaataaaagaacaggctgagccgggcatrgttgctcactcccgtaatcccagcactttgggaggctgaggcgggtggatcgcctgaggtcaggagttcgagaccagcctggccaacatagtgaaaccct

SEQ ID NO: 17845 - DNA, 201 bp, Homo sapiens; identical to SEQ ID NO: 3074

SEQ ID NO: 17846 - DNA, 201 bp, Homo sapiens
tccgcccgcctctgcctcccaaagtgctgggattacaggcgtgagccaccgcacccggcctgcttagattttcaatttgggcagggccaggggctggtacycaggctcagggtcctctcctgatcctttctttctcccaccccaggtcggctaccagatccgctttgagagcacacgttcggcggccaccaagattgtatt

SEQ ID NO: 17847 - DNA, 201 bp, Homo sapiens
atggaattctcacagcatctaggaggagaactataagggatggcattgcctgcccaaggtcagttggcactaagtggcagaggtgagattcaaacccaagstgttggactccagagtctgatgggtaggcatggtatttgcttagattttctttttgctttttcttttttttgagatggagtttcactcttgttgcccagg

SEQ ID NO: 17848 - DNA, 201 bp, Homo sapiens
tattttctattctgtttgatttcatcttttaaaaaaaaaaatactagtgctgccgggcacaatgagtgactcatgcctgttatcccagcactttgggaggstgaggcaggaggattgcttgaggccaggaagtcgagaccagcctaggcaacacggtgaggccctgactctagaaaaaatttaaaaattagcccagtgtga

SEQ ID NO: 17849 - DNA, 201 bp, Homo sapiens
gggagagaggaacctgcaggctcctagagcctcagggttttgttgacactgcgattgccaccaacaccacaaaagccagctcagctcagtcacttctgtgygtgtccacacctccctcgagcccgtctggtgggccaggcactgttagtgttcagtgttctggggccgggggtgcagctgtggtcaatgtcaaccaaactc

SEQ ID NO: 17850 - DNA, 201 bp, Homo sapiens
tgactgaaacaaccctggttctgtccccatggggctcacaacccagtgggaggacagacccatccccagacaacccagagtgggcagggcttggggagtcmagagcactataggagcccacagggggcatctgccccagatttggaggagtcagggagggcttcctggaggagggaacctgggccagagggtggaggagag

SEQ ID NO: 17851 - DNA, 201 bp, Homo sapiens
accagggggccctggacagctcagaggccctcacacccattgggtccctgctagcccagctgcctgtggacgttgtgattggtgagtacccacccccctcstgatcactcagggccccaggagcgggtatgggcacagctcactctctgagtggcctgggggcaagtctgtttcttccctgggtccagttcatttattcac

SEQ ID NO: 17852 - DNA, 201 bp, Homo sapiens
ttccatcctggccacaaccagagaggatgctgggaatgctcttcctggctccagtctcatggaaggattctgattggtccagctcaggtcacgtgcctctsctccatggtctggggcaagatgtgctaggcagacagatacagagacagcagccctccttgcctgcctctgcacagtggatcttgacattgggaattttat

SEQ ID NO: 17853 - DNA, 201 bp, Homo sapiens
tcacatagacagggctggtgggtgggcaggagcccagccgggcagggcctgtctccaatagcgccctgcccctcccacctactccctgtcttctgcccccyctctttcagtccctcctgctttttagccggtctttggacaccaatggtgactgctcccgcctggtggccgatggctggctggagctgcagctagcagaca

SEQ ID NO: 17854 - DNA, 201 bp, Homo sapiens
gtaggtcctacagatgcgaaaaggagaagagaatacgataaacaacgtgccacacagaaattcactcatttgaaatggaaaaaattattgaaagacactarctacccaaagctcattcaggaagaaatagataaccggaacaactctattaaggaaatgtaattcatagttaacaaagagaacaggctcagatgggctccc

SEQ ID NO: 17855 - DNA, 201 bp, Homo sapiens
gacagctacagtcggttgcagcagcgccgggagcgccgggccctgcaccagctgaaacgccagcacgaggagggcgcggggcgcaggcgcaaggtgctgcrgctgcaggaggagcaggacggcggctccagtgacgaggacagggctggcccagcccccccaggggccagtgatggcgtggacatccaggtgggcgccatg

SEQ ID NO: 17856 - DNA, 201 bp, Homo sapiens
gggtttaccaaggtgggccttggcctctcctgggggggtcccaggggacatggccctgtcctcatttcaggagccgggtttccatggacggtgcttggtcycaggtatctgcagagcctgggggtctgcggatcatggtaggagcccctcaggtcccctaagactctgcctccccgtgctccccccaggatgtgaagttca

SEQ ID NO: 17857 - DNA, 201 bp, Homo sapiens; identical to SEQ ID NO: 3130

SEQ ID NO: 17858 - DNA, 201 bp, Homo sapiens; identical to SEQ ID NO: 3131

SEQ ID NO: 17859 - DNA, 201 bp, Homo sapiens
ggccctttcaatgggctgtttattagagaggagccttccgcacctgatccccggcgcgtgggagagcgctctgcgccgcgcccccagccctcgccctgcasctagcgcttttgtacaaggtggaaatttagcggtgggccagagatggaaggcaagaaaagaaaggcgagggaggggtggaagaccctgtccacttttgtt

SEQ ID NO: 17860 - DNA, 201 bp, Homo sapiens
gccctttcaatgggctgtttattagagaggagccttccgcacctgatccccggcgcgtgggagagcgctctgcgccgcgcccccagccctcgccctgcagstagcgcttttgtacaaggtggaaatttagcggtgggccagagatggaaggcaagaaaagaaaggcgagggaggggtggaagaccctgtccacttttgttg

SEQ ID NO: 17861 - DNA, 201 bp, Homo sapiens; identical to SEQ ID NO: 3132

SEQ ID NO: 17862 - DNA, 201 bp, Homo sapiens
ttctcagatgttcaaagtaccaaaggagctttctcttctcagttatgtctttactagacttttccagtatatgctggataagttatgactactcattatgyaatattttagatctggcatgatttagctaattgtgtggctcactgaatctgagtgaataatgccatttaacttctgttggcttattttttcatgaattta

SEQ ID NO: 17863 - DNA, 201 bp, Homo sapiens
tgcctgtcgagcctgggcagctccagcctcaggccaggacccgggagcccaactgcctcccccggggcggaggcgccgcgtcggcggtctggtcagaaccsgcatcaaccccccttcatcccccgaagctctcaagagcctccgagctacccagcctgtgcaggacctgcagctctcagccctccgttcctgcggcccctg

SEQ ID NO: 17864 - DNA, 201 bp, Homo sapiens; identical to SEQ ID NO: 3133

SEQ ID NO: 17865 - DNA, 201 bp, Homo sapiens; identical to SEQ ID NO: 3134

SEQ ID NO: 17866 - DNA, 201 bp, Homo sapiens
atgttccttctgcaggggaggatttaatttatgaaaatgatattgtttatgcatgaatgaactgcatgcactctgcataacacatagcacttccatctgaycagagaaataccacagaaccagtgccaatgtcagaaacatattctacaaatttactcacttaaatgtttaatgaatatttggaaggcattttcaaaccat

SEQ ID NO: 17867 - DNA, 201 bp, Homo sapiens; identical to SEQ ID NO: 3136

SEQ ID NO: 17868 - DNA, 201 bp, Homo sapiens
ctcagctagcggccccgcccgcgcttagcatcactaactgggctatataacctgagcgcccgcgcggccacgacacgaggaattcgcccacgcaggaggcrcggcgtccggaggccccagggttatgagactatcactgctcaggacctactaacaacaaaggtaattacagttctttcatttttttgccccagaatagaa

SEQ ID NO: 17869 - DNA, 201 bp, Homo sapiens
tttgggtttcttttgtggatagcataggagcttcttggattttttaaaagaatgcacggtaactatgattatctgctagtgctgattttaaagtcccaaargcaataatgacttcactttctcacttcttacagtaagaaaaaaaaatctatgttatcaatatatattttgtgtgcatgtattttacgcacattgggagtg

SEQ ID NO: 17870 - DNA, 201 bp, Homo sapiens
tgcgtttgcgagagtgtgtatgtgtattgagaccagcatccccctccataattgcccataagtactcacacataatgagtcgtgtcactcaagtacccccygcaggctttctaatttaaattttaaaaatttgggtttcttttgtggatagcataggagcttcttggattttttaaaagaatgcacggtaactatgattat

SEQ ID NO: 17871 - DNA, 201 bp, Homo sapiens
gagaaataccacagaaccagtgccaatgtcagaaacatattctacaaatttactcacttaaatgtttaatgaatatttggaaggcattttcaaaccataaraaacattttaaattatcttcttttatgaattcctacccatatttaaaagagactcttacagtttttgtaattggctaatgcttatacccagtttgtaaga

SEQ ID NO: 17872 - DNA, 201 bp, Homo sapiens
taaagggaggtttgaggcgaactttgaaaagccccaataaagagcgggcggccctttcaatgggctgtttattagagaggagccttccgcacctgatcccyggcgcgtgggagagcgctctgcgccgcgcccccagccctcgccctgcagctagcgcttttgtacaaggtggaaatttagcggtgggccagagatggaagg

SEQ ID NO: 17873 - DNA, 201 bp, Homo sapiens
ccacaaattattttcagtccagcaagtgttataaacattaattctataaaaagaaaacaattgaaactaatttcttattatattgcatggcaccaaactcyccccacttcctttttgaggatcatgagttgtctgtcattgtttctttttattgatatcaattggttaaatataatctggaattggaataaaagaaaaact

SEQ ID NO: 17874 - DNA, 201 bp, Homo sapiens
tcagaaacatattctacaaatttactcacttaaatgtttaatgaatatttggaaggcattttcaaaccataagaaacattttaaattatcttcttttatgrattcctacccatatttaaaagagactcttacagtttttgtaattggctaatgcttatacccagtttgtaagaaaagaacatattttactaaatgaaaacc

SEQ ID NO: 17875 - DNA, 201 bp, Homo sapiens
tgggtttcttttgtggatagcataggagcttcttggattttttaaaagaatgcacggtaactatgattatctgctagtgctgattttaaagtcccaaaagsaataatgacttcactttctcacttcttacagtaagaaaaaaaaatctatgttatcaatatatattttgtgtgcatgtattttacgcacattgggagtgtc

SEQ ID NO: 17876 - DNA, 201 bp, Homo sapiens
tacctgttaccgctccagaggcggccaagtccccagcagccactactggagccagaaattcagttgttttactaaaggctttttattttccttactagaarcggcaacttcgcggttgccaatcgctgaccattataattactcaatcttttaaagggaggtttgaggcgaactttgaaaagccccaataaagagcgggcg

SEQ ID NO: 17877 - DNA, 201 bp, Homo sapiens
ggaagtagaatgtgtgattttacagcttttttttttttttatggagttgtgagtaactttgaacacatttggataaacatgaagtcgctgaaatgtacagycatttccacacacattatcctgtcgggcaaccaccataaacacatttaagttaatcactaggatacaaacacatatgcgtgagtggtgtacacatataca

SEQ ID NO: 17878 - DNA, 201 bp, Homo sapiens; identical to SEQ ID NO: 3135

SEQ ID NO: 17879 - DNA, 201 bp, Homo sapiens
ctcaagtaccccctgcaggctttctaatttaaattttaaaaatttgggtttcttttgtggatagcataggagcttcttggattttttaaaagaatgcacgrtaactatgattatctgctagtgctgattttaaagtcccaaaagcaataatgacttcactttctcacttcttacagtaagaaaaaaaaatctatgttatca

SEQ ID NO: 17880 - DNA, 201 bp, Homo sapiens
aaaatacataccattataaattgtcaacttacagtttttattttttaaagacaagagtcctgatcattctcagttgaaaggtatctaatgacactaatgawaaggaacatcgtttttgtctttattacttttttccagtataaggattttggccaaatgggacttagactggaggctgaatttgagaaggatttcaaggaa

SEQ ID NO: 17881 - DNA, 201 bp, Homo sapiens
agagtaccattggatgagttcttacaaccacacttttctgcaccatcgaaatctttatcaagatacagaacatgatcatcaccctggaaaggttccttatrtcctttctggtatatctccacccactacctatcagggcaatcactactctttgtttttccatgataacttaatttgggtttttaaaaaactttatataaa

SEQ ID NO: 17882 - DNA, 201 bp, Homo sapiens
ttatctttcaggaaggatctctacctaatcctccaagaatatattacaggaacaaaaaggtgattattacataattttctacagattcttgtcacacaacwgatttaacatgtacaacatcttattttatggagtctccaattgggtaactataattaagctttcaccttctccacttcccacatataaatttttttaata

SEQ ID NO: 17883 - DNA, 201 bp, Homo sapiens
aataagtggagaagcaaacgatgctaacagattgcaagctcaatattgttgtcagctcccccaaatttatctatagtttcaaatcaaacccaagaaaaatmcaaaaggcttttctcatagaaattgacaaattgatttgaaaagatatgtggaaaatcaaagaatctagaaagtccaagacaatcttttctaattgacttc

SEQ ID NO: 17884 - DNA, 201 bp, Homo sapiens
tcaacaacaaaaatgaacaaactaactgttcaacacagcaacatagatgataagcaaaagaagccagacacaaaagcatgtatatgttttgctcatttatrtgaaatccaagagcaggcagtattaacatctgacagaataaatgacagcaatggttgccccctgagaggctgcctggctgcatgtgttcagtatgcaggt

SEQ ID NO: 17885 - DNA, 201 bp, Homo sapiens
tctgaccagaaaagagatggaaatcctatcttttctctagtaacgagtttataaataacattacgtaatctttttattttatttcatttttttgagacagrgtctcactctgtcaaccaggctggagtgcagtggcacaatcccggctcactgcaacctctgtctcctgggttcaagcgattttaatcttttaaatttttt

SEQ ID NO: 17886 - DNA, 201 bp, Homo sapiens
tttaaaaggaaacggcagcgatttctgaaattcagatgcctaaaatgattaactgtatatagcaatagtatggacagatttatattaacacaaagcagaaycagatgttccaggagatatcactgatattctcatgaaattctcaataatgtggtattattatcattattaaaccacattgtattatttatgaattaattt

SEQ ID NO: 17887 - DNA, 201 bp, Homo sapiens
caccaccacgtctggctaattttttgtatttttagtagagacagggtttcaccatgtttgccaggaaggtctcaatctcttgacctcatgatccactcgcytcggcctcccaaagtgctgggattacaggcataagccaccgcgcccgacccccattctgattcttgatcctgtctttctatgtcacctgttttgcctctc

SEQ ID NO: 17888 - DNA, 201 bp, Homo sapiens
gaccacctattttatatatgttggttcttcatagcttatccgttatacataaaatcttaccatctccacaaacatctcagaatcttgatgaccattttcayttggtgtcctttttccttaggctgttcacggaagaccaggatgtagatgagggacttgtctatgacactgtattcaagcacttcaaaagacataagctgg

SEQ ID NO: 17889 - DNA, 201 bp, Homo sapiens
ttctatgacattttctcaggaccttcatttcttctagtgatttaaaaatttctgccatgatatttttaatttccaaaagcccttttaaaaagttgtttctygtttatagcatcttgttgttgttgtttcaagaaatccaatattttctctctcctaatgaggatgatgatttttagaattgcatctgttccttccaggttt

SEQ ID NO: 17890 - DNA, 201 bp, Homo sapiens
tttactagtcaaacttagtcaatttcagagcagtgaaatctaaaaaacagcaaacccattagaagccagagttgtaagttgattgtattcatatcatagawcttatctgtccaagttctaaagttgttttcctctgtgttttatctgattttcctgggaattcctttgccttaaatcattggctaattaaaatggctggac

SEQ ID NO: 17891 - DNA, 201 bp, Homo sapiens
ttgtctatgacactgtattcaagcacttcaaaagacataagctggagatatcaaatgcaataaaaaagacatttccattccttgagggcctccgcgatcgkgaactcatcacaaataaaatgtttgaagtaagtaaagtttatttcacaacctggcagatatgctttcatattttacaagtatttctgtaagtgctcctgt

SEQ ID NO: 17892 - DNA, 201 bp, Homo sapiens
acattcttatctgtgcctaatctagaacgtctaaattgtctttatttttgcagcctgttgcaacagttcctttccactaaggggtgggtccttgagctaamctatttggccccatttgttttgcttttagctacctgcaagtaattatgtcttgttccctcactaactgcctaccacctgtttcatgagaatctatgagga

SEQ ID NO: 17893 - DNA, 201 bp, Homo sapiens
ccaaattgtctttttagggggctgaacggaggtgtttcacaagtagcaaatgagatgaaccatcttcctgcacacagccaaagtctgcaaaggtgatgaaraattacaatttgttttaatttgtattttcctgataatgtggaaagctgaacagcttttcatgtttcttggccactgaaatttcctcttccataatttttt

SEQ ID NO: 17894 - DNA, 201 bp, Homo sapiens
ttgccaggaaggtctcaatctcttgacctcatgatccactcgcttcggcctcccaaagtgctgggattacaggcataagccaccgcgcccgacccccattytgattcttgatcctgtctttctatgtcacctgttttgcctctctgaaactttctggctcatctctttaatcccttgattctaaattctcatgatggtttg

SEQ ID NO: 17895 - DNA, 201 bp, Homo sapiens
tctgttcatgataaaattcccagcatattaggaatagataggaactcagcaaattagaaatagataggtaggaaagtcatatgactaccttggtagatgcrtttgataaaattagtagttcatgataaaattctcagcaagttagaaataggtaggaatgcaaagcacagtggctaacagctgtgatcccaattctttggg

SEQ ID NO: 17896 - DNA, 201 bp, Homo sapiens
ccagaccctggggccccagggggtcactaaagtgctacttccactgaaatgataaatttcaaggctgaagataggccattgctgtataaagggtataaccygtaagtgatttagctgatcttcctctggctacacagaaagccacatgttgcacactaaggttgaaccagcgttgtggttagagatctgtgtcctaaggct

SEQ ID NO: 17897 - DNA, 201 bp, Homo sapiens
aatggcaataaggaatttgaaaagcagtatcctttaaagtagcaccagagagaataaaataactagaaataaatttaatgaaagatgtgcttgatttttamaattaatctaaataagtggagaagcaaacgatgctaacagattgcaagctcaatattgttgtcagctcccccaaatttatctatagtttcaaatcaaacc

SEQ ID NO: 17898 - DNA, 201 bp, Homo sapiens
aaagatatgtggaaaatcaaagaatctagaaagtccaagacaatcttttctaattgacttcaagactttctttaagccatggtattcaacacaaaatcatrtcagcataaggatagacaaacagatcaatggtatggcatagaaagtacagatataaacccatgttcatattgtaaattgctttttgaatattttcgtgac

SEQ ID NO: 17899 - DNA, 201 bp, Homo sapiens
ttaacatgtacaacatcttattttatggagtctccaattgggtaactataattaagctttcaccttctccacttcccacatataaatttttttaatatacrctttcagagttactactttgaatactttgtgtatataaagctaggtcctctttggattaaaccgtatcagatggagatgctgaggagccctcaaaacaaa

SEQ ID NO: 17900 - DNA, 201 bp, Homo sapiens
aagcacttcaaaagacataagctggagatatcaaatgcaataaaaaagacatttccattccttgagggcctccgcgatcgggaactcatcacaaataaaaygtttgaagtaagtaaagtttatttcacaacctggcagatatgctttcatattttacaagtatttctgtaagtgctcctgtaaagtagaaaaggagaggag

SEQ ID NO: 17901 - DNA, 201 bp, Homo sapiens
acaggtgcacacaaccacatcaggctgattttgctaaatttttttcagacacaaggtcttgctatgtggtctaggctggtctcgaaatcctaggttcaggmgatgctcctgcgtcaccatcccacagttctacgattacaagcatgagccactgcacctggccagttttctcttttataatggaatctctctaggacttga

SEQ ID NO: 17902 - DNA, 201 bp, Homo sapiens
cagagtgagtactcagaaatgtcagatattttttaatgtactgaaacaagttataacctcttcattacacatctacttaacccagaatgctcattattttrttcaaatctttaacttgatttaattttgacttactggacttgtcaacttctaacagagatgccttaacatttttttactacaattgtgagtttttcagtt

SEQ ID NO: 17903 - DNA, 201 bp, Homo sapiens
tccagatatggttaggtgaagatatctttacaatgactttgttcagtttagactgggctttttcagtgccctctatattagtcttgcataggctccatgakatcttctattacatttttgtttgttgcttcaattccatttattctgggctctactgaggaccacctattttatatatgttggttcttcatagcttatccg

SEQ ID NO: 17904 - DNA, 201 bp, Homo sapiens
tttgatctcaacccagttctccaaataagagatagagacatcacaagaaaaacagggacatgccctgaagagggtggatgctatggggactggaaagagtraaagcatgtctgcaaaacaggacaaactggatttggctaaatcacagagtgagaagcagtataggagctgacttaagagagatcaattggaggaagatgg

SEQ ID NO: 17905 - DNA, 201 bp, Homo sapiens
tctaccttctatgacattttctcaggaccttcatttcttctagtgatttaaaaatttctgccatgatatttttaatttccaaaagcccttttaaaaagttrtttctcgtttatagcatcttgttgttgttgtttcaagaaatccaatattttctctctcctaatgaggatgatgatttttagaattgcatctgttccttcc

SEQ ID NO: 17906 - DNA, 201 bp, Homo sapiens
atttccggggccaatttttttcaataagcatatgtttgagctcctaccatgtgcgatacattgtgttgggcagtgggcatagagtagttaacaaaatagaygtgtcatgagtcttcttgaagcccatggtatatggctatggcaaaacaaacatctggaggtctgcttcactggccacttagactcacaggacaaccagag

SEQ ID NO: 17907 - DNA, 201 bp, Homo sapiens
ttatgtgtttttaagcaacagtttttattttgtatttgcttgatgttgatagcgaaactataacagccttatgaaataattgagggtgattaaaattatakgtatatatatatatataaatggtttctttaatacagacattacctgttccttgaaggattgctaaaaattgtccattaaatgatttgaaaccaatgtctg

SEQ ID NO: 17908 - DNA, 201 bp, Homo sapiens
aattttctcccattttgtaggttgcctgttcactctgatggtagtttcttttgctgtgcagaagctctttagtttaattagatcccatttgtcaattttgkcttttgttgccattgcttttggtgttttagacatgaagtccttgcccatgcctatgtcctgaatggtaatgcctatgttttcttctagggtttttatggt

SEQ ID NO: 17909 - DNA, 201 bp, Homo sapiens
gttgtagatacgcagcgttatttctgagggctctgttctgttccgttgatctatatctccgttttggtaccagtaccatgctgttttggttactgtagccytgtagtatagtttgaagtcaggtagcatgatgcctccagctttgttcttttggcttaggattgacttggcaatgcgggctcttttttggttccatatgaa

SEQ ID NO: 17910 - DNA, 201 bp, Homo sapiens
tatatctccgttttggtaccagtaccatgctgttttggttactgtagccctgtagtatagtttgaagtcaggtagcatgatgcctccagctttgttctttkggcttaggattgacttggcaatgcgggctcttttttggttccatatgaactttaaagtagttttttccagttctgtgaagaaagtcattggtagcttgat

SEQ ID NO: 17911 - DNA, 201 bp, Homo sapiens
gttactgctgtctttttgtttgtctgtgccctgcccccagaggtggagcctagagagacaggcaggcctccttgagctgtggtgggctccacccagttcgmgcttcccggctgctttgtttacctaagcaagcctgggcaatggcgggcgcccctcccccagcgtcactgccgccttgcagtttgatctcagactgctgtg

SEQ ID NO: 17912 - DNA, 201 bp, Homo sapiens
ggcaggcctccttgagctgtggtgggctccacccagttcgcgcttcccggctgctttgtttacctaagcaagcctgggcaatggcgggcgcccctcccccrgcgtcactgccgccttgcagtttgatctcagactgctgtgctagcaatcagtgagagtccgtgggcgtaggaccttccgagccaggtgtgggatataatc

SEQ ID NO: 17913 - DNA, 201 bp, Homo sapiens
gcaagcctgggcaatggcgggcgcccctcccccagcgtcactgccgccttgcagtttgatctcagactgctgtgctagcaatcagtgagagtccgtgggcrtaggaccttccgagccaggtgtgggatataatctcgtggtgcgccgttttttaagcccgtcggaaaagcgcagtattcaggtgggagtgacccgattttc

SEQ ID NO: 17914 - DNA, 201 bp, Homo sapiens
ttttctttctctcttcttctgtaatttccataatttgtatgttgtttcacttgatggtgtcccataaacacaataggctttttttcactcattttcattctttgttctttttgctcctctaagtagataatttcaaatgacttctctttcagttcactgattctttcttctgcttaagtaagctgttggaattttctgtta

SEQ ID NO: 17915 - DNA, 201 bp, Homo sapiens
tttctttctctcttcttctgtaatttccataatttgtatgttgtttcacttgatggtgtcccataaacacaataggctttttttcactcattttcattctttgttctttttgctcctctaagtagataatttcaaatgacttctctttcagttcactgattctttcttctgcttaagtaagctgttggaattttctgttaa

SEQ ID NO: 17916 - DNA, 201 bp, Homo sapiens
aacaatggtgttaccagtgggctggtacaggttcttgtcttcaccccagaaaagaatttgaaggccagaccaaactgaaagtacagaagatttattgcagmgtgaaagcaagtacatactcaagagaggattgtgagtgtgctcaaaagaataagctgaacccaatatggccaggactcacatactatacagataagcata

SEQ ID NO: 17917 - DNA, 201 bp, Homo sapiens
ctttatccagtctatcattgatgggcatttaggtggattacatgtttttgctattgtgaatagtgctgcaatgagcatacatgtggttgtatctttataayagaatgatttatattcctttgggtatatatccagtaatgggattgctgggtcaaatggtatttctgcctctaggtctctgaggaattgccacactgtctt

SEQ ID NO: 17918 - DNA, 201 bp, Homo sapiens
cttttctgccctgttaataagaaaggatcatgctggtgagaaacggaagttactcttagctgcataagttttcaagtttaatctggttaatgttacttagrgtgtttaagataagagtcctacttaataatagtgtatttcacacttcaacattgttaagagagtaaatatcaaatgttctcaccacaaaaaatgatggct

SEQ ID NO: 17919 - DNA, 201 bp, Homo sapiens
gacatcaaactaagtcttaaacaaggtaaaaatgacagaataaaaacggtttctcatccgctaagaggaaaaggagacaagggaggtgagggcccaaggtyctgaggggaaattgtgaaacagggaagacacagggaaggaccatggagaagtcaaggagggggttgtatgagctcctaatcagatgcagggtcctggaga

SEQ ID NO: 17920 - DNA, 201 bp, Homo sapiens
tgtacaaatatttcacctccttggttaaatttattcttaagtattttcattgtaaattggattgttttattgatgcctttttcagatagttcattgttagygtatagaaatgcaacagattttttatgttgattttgtatcctgcaactttaccaaatttattagttctagcagttttttggtagagtcttcagggttttc

SEQ ID NO: 17921 - DNA, 201 bp, Homo sapiens
ttgggaagaggttggaaatgccagactcacaaaacagaaacgcaggctgactatgtaccttggtctttttatctttcaggaaggatctctacctaatcctycaagaatatattacaggaacaaaaaggtgattattacataattttctacagattcttgtcacacaacagatttaacatgtacaacatcttattttatgga

SEQ ID NO: 17922 - DNA, 201 bp, Homo sapiens
actattttgttgaaaatttttatcatgaaaaaagttgaattttgtccaatgctttttctgcatctattgggataatcatataatttttgtccttcattctrttaatgcaacgtatgaccttttaagatttgtgtgttgaaccatccatgcatcccagtgataaagcttacttgatcatggtgagtgtgctgttgaatttga

SEQ ID NO: 17923 - DNA, 201 bp, Homo sapiens
gtctatgctggggcaggccttgagccagagtctgcagggatctacaccactggtgcagccatcttcaggcacttcagtgagcctgaagaccagtgcatgaraggcagcttggtactgggatgagactgaaggccagagccactggtagtagtctgggttcactgaggctgaagtagtgctggggcaggctgaagactgcat

SEQ ID NO: 17924 - DNA, 201 bp, Homo sapiens
acaatcttggctcactcactgcagcctctgcctcctgggttcaagtgattctcctgcctcagcctcccaagtagctgggattacaggcgcacgccaccacrcccagctaatttttgtatttttagtagagacagagtttcaccctgttggccaggctggtcttgaattcctgacttagtgatttgcccacctcagcctccc

SEQ ID NO: 17925 - DNA, 201 bp, Homo sapiens
ctggggccccagggggtcactaaagtgctacttccactgaaatgataaatttcaaggctgaagataggccattgctgtataaagggtataacccgtaagtratttagctgatcttcctctggctacacagaaagccacatgttgcacactaaggttgaaccagcgttgtggttagagatctgtgtcctaaggctttttggc

SEQ ID NO: 17926 - DNA, 201 bp, Homo sapiens
gagtttcaccctgttggccaggctggtcttgaattcctgacttagtgatttgcccacctcagcctcccaaagtgctgggattacaggcatgagccaccgcrccctgccacttcttactgttttcaaagaacattagtattttctggaatgataagagctttttaattttttctattttactctcaggactacaagtagaaa

SEQ ID NO: 17927 - DNA, 201 bp, Homo sapiens
atgtgtgtgacctctagaagctgaaaagacaaggaaataggttgtcctctccagaccccagaaaggaataaaggcctactaacataatgactttaggcagwgagacctgtgtcacacttctcactgacataactggaagataataaaatacaaaaataaaaataaaataacttttttgtttctcattagtatctggtgaac

SEQ ID NO: 17928 - DNA, 201 bp, Homo sapiens
gtcacacttctcactgacataactggaagataatatatttgtgttgttttaaaccactaaatttgtggtaatttgttatggcagcaattaagagtaatacrgattttagtacttggcagtggggtgtggctatcacatattcctgaaagtgttggggtgtctttgagattgcgcagtggaaagaggttggaagaattttaa

SEQ ID NO: 17929 - DNA, 201 bp, Homo sapiens
ttaaatagagtgataggaaaatcctagatgaaaaaatggaaattaagtcaattaataaccctacaatggcctgtaagtgctcaagttaaagaaagagtcgsccgggcgcggtggctcacgcctgtaatcctagcactttgggaggccgagacgggcggatcacgaggtcaggagatcgagaccatcttggctaacacggtg

SEQ ID NO: 17930 - DNA, 201 bp, Homo sapiens
cttttcatccccagctgctgagtggtggctgctgatgccagcagtccccagagtattacccttcgttaaatggaatcagcttcacctggaagtgacgcccygtggcctgaggccggcccctttgcctcaaagcaggaccaagggtgtggtgtgtggctactctgtgctcccaggtatcaggctggagctagtctccagctg

SEQ ID NO: 17931 - DNA, 201 bp, Homo sapiens
agataaagttggtaccacttttcatttgccctgcaggtcaatgcacatgttgaggttttgaggagcctagaagctttattgtttactagtcaaacttagtmaatttcagagcagtgaaatctaaaaaacagcaaacccattagaagccagagttgtaagttgattgtattcatatcatagatcttatctgtccaagttcta

SEQ ID NO: 17932 - DNA, 201 bp, Homo sapiens
atctgaaggcatcacaagaagtggtgaaattatttgtgtgaattacacatcattcaaggagttttgggcccagtttagcttgagggaaggaggaagggatycctaagatgacattttaagactttaagaaatcacacccattagacgctgactcgcacatggagtgtccagggggtacccaaagaacaaaagagaaggcag

SEQ ID NO: 17933 - DNA, 201 bp, Homo sapiens
ttctttctctcttcttctgtaatttccataatttgtatgttgtttcacttgatggtgtcccataaacacaataggctttttttcactcattttcattctttgttctttttgctcctctaagtagataatttcaaatgacttctctttcagttcactgattctttcttctgcttaagtaagctgttggaattttctgttaaa

SEQ ID NO: 17934 - DNA, 201 bp, Homo sapiens
tctttctctcttcttctgtaatttccataatttgtatgttgtttcacttgatggtgtcccataaacacaataggctttttttcactcattttcattctttgttctttttgctcctctaagtagataatttcaaatgacttctctttcagttcactgattctttcttctgcttaagtaagctgttggaattttctgttaaat

SEQ ID NO: 17935 - DNA, 201 bp, Homo sapiens
gggtgaagggaagcaggcacctcttcacaaatcagagcaagagagagggagtgagagacagcaaagaaagaaatgttacacttttaaataatcagatctcrtgagaactcactatcatgagaacagtatgggggaatccacccgcatgatccaatcacctcccaccaggtccctttccaacacatggggattacaatttgc

SEQ ID NO: 17936 - DNA, 201 bp, Homo sapiens
ttatttgaaatctcttatgtgctcattgtcctccaccattctctttgtcactgtaaatctaattcctttattatcattttaatgaactttaaccagaaactttttttttacaggaattcaaaacaataatgcgacattgtttcctgctttatgttgtgtactgggaagtgccaataattctcttctggttggataaaaaga

SEQ ID NO: 17937 - DNA, 201 bp, Homo sapiens
gaaggataaatagttttgttaaccctttacccacaagggataaaagaaacattaatcaaataatcacaaaactgattgctcggacagggactataccaaaytaaagtttggtattggtgctataccaaactaaagtttggtattggtgctataccaaactaaagttttgattcttgacttttttcctgagaaggcataatt

SEQ ID NO: 17938 - DNA, 201 bp, Homo sapiens
gggcattttttcacatacctgatggtcatttgtatgtgttcctttgagaaatatctgtttgaatcctttgcccactttataatctgtttatttgtttttgtttttttttttagtatggagttggttgagttccttacatattttagatattagcccttatcagacatatggtttgcaaatattttctcccttctgtaggtt

SEQ ID NO: 17939 - DNA, 201 bp, Homo sapiens
tcactctgctgattgtttccttgcccatgcagaaactttttagtttgatgtagtctcacttctttatttttgcttttgtgattgtgtttttggtgtcataccaaaaacataattgctcagaccaatgtcatggagcttttcccctgttttcttccagtaattttgcagcttcaggtattaaatttaaatatttaatccatg

SEQ ID NO: 17940 - DNA, 201 bp, Homo sapiens
ctcacaaggagacctcagtcccaccacagctcagaagacattcctccacctttctgagggcaggtttgaccccacagccttagttccacccttgtggggtrcatccaacatggagctgcctggttccaaatatccgatgatagctgatatttgtgctaatggggacccactggtgaacacaggaagatgccatcaggaatc

SEQ ID NO: 17941 - DNA, 201 bp, Homo sapiens
attttgtatcctgcaactttaccaaatttattagttctagcagttttttggtagagtcttcagggttttctctatataagatcatgtcatctacaattaaraacaatttaacttcttcctttccactttggatgtcttttatttctttttcttgcctaattgttctgtctaggacttgcagtactgtgttgactagaagtg

SEQ ID NO: 17942 - DNA, 201 bp, Homo sapiens
ggctgctcaagagtgtgtttaatttccatgtatttacaaaattaaaaaactcttcttgttattgatttctacttttatatcattgtggtcagaaaagatayctgatataatttcaaccttcgtgactttaagtttgtagcctaatgtatgatttatcttggagaatgttccatgtacaagtgagaagaatgtatatttcac

SEQ ID NO: 17943 - DNA, 201 bp, Homo sapiens
aaatacatttttaatgccagagttttctttttgtcattgttactgtttctgttattatttgcaatactgtggtagagagaatgatggccaccccaaaaaaygtccacctcctaatccctggacctgtaatctgctatcttacatggcaaacgggactttacagatacaattaatttagagaccttgaaatggggagatgat

SEQ ID NO: 17944 - DNA, 201 bp, Homo sapiens
ctactaaaaatacaaaaaattagccgggcgtgttggcgggcacctgtagtcccagctgcttgggaggctgaggcaggagaatggcatgaacctgggaggcrgagcttgcagtgagccaggatcgcgccactgcactccaacctgggagacacagcgagactccgtctcaaaaaaaaaaaaaaaaaagaaagaaagagtcac

SEQ ID NO: 17945 - DNA, 201 bp, Homo sapiens
acaaagatttttgtctttattttcttacaaaagtcctgccatttttgctcttttagaagattactacataatttggggaacccagtgaaaaataaaaatgrgggatccttgctcacaagttattaaggatttcagaacagtgaaagcagaacactaaactaagcacagagtcatttgtgactgcacaggatgcatgctcat

SEQ ID NO: 17946 - DNA, 201 bp, Homo sapiens
ttctgtgtcataatctctggttttataaggaaaacgtttttattctgacatataccccttcctcctgaacttcactgcagaccaggatttgttctgaaatytccatgccatatttttccttcatatcccagggagaagcatatgcctgtctatacaggctcacacataagcagtgtgttctagatgcccagaggggtggcc

SEQ ID NO: 17947 - DNA, 201 bp, Homo sapiens
agtcctgccatttttgctcttttagaagattactacataatttggggaacccagtgaaaaataaaaatgggggatccttgctcacaagttattaaggattycagaacagtgaaagcagaacactaaactaagcacagagtcatttgtgactgcacaggatgcatgctcatgaagccagccctgctcttacatttagatcca

SEQ ID NO: 17948 - DNA, 201 bp, Homo sapiens
tatggtgaaaccctgtctctactaaaaatacaaaaattagctgggcgtggtggcttgtgcttgtagtcccagttagttaggaggctgaggcaggagaatcrcttgaacccgggaggcagaggttgcactgagcagaggttgcaccactgcactccagcctgggcaatagagtaagactccatctcaaaaaaaaaaaaaaag

SEQ ID NO: 17949 - DNA, 201 bp, Homo sapiens
actgtcttttatatctgtattgctttttaagaacatttaaatcgattaagagaaatcttcctttaactattctcatctcaaattgttctttattgactcakatattctgtcatttcaatatttacattattttatccaggttttttttcgagacggagtctcactgtcacccagcccagagtgcagtggtgtgacctcggc

SEQ ID NO: 17950 - DNA, 201 bp, Homo sapiens
agttgtttattatggatgattaaagaaagtggtttcttgagatggaatctgctcctgggaaagatgctgtgaacattgttgaaatgacaacaaaggatttmgaatatattagttgataaagcagcagcaggttttgagagaatctactgtggtaaaatgctatcaatagctttacatgttacagagaaatctttcatgaag

SEQ ID NO: 17951 - DNA, 201 bp, Homo sapiens
tttgagcccttcaggccaaatcagtcttgggggaagagcaggggttgcccagccaacaaaacagccactcattgattgcctgctacatctatcccaaaaaygtatcaatcaggctcttaaagaactttgagcccacttttatccttcaaagttgctcctttttacatctaatgtaaatgagggtgaagcaatcaggctcat

SEQ ID NO: 17952 - DNA, 201 bp, Homo sapiens
cagccaaagaacctagcagggtagagggaagccatttttccctcccctgcaaagcggttggcatcctggcaccatctcctcttctgaccaggtcttttcayccccagctgctgagtggtggctgctgatgccagcagtccccagagtattacccttcgttaaatggaatcagcttcacctggaagtgacgccctgtggcct

SEQ ID NO: 17953 - DNA, 201 bp, Homo sapiens; identical to SEQ ID NO: 3144

SEQ ID NO: 17954 - DNA, 201 bp, Homo sapiens
ttcaataagcatatgtttgagctcctaccatgtgcgatacattgtgttgggcagtgggcatagagtagttaacaaaatagacgtgtcatgagtcttcttgragcccatggtatatggctatggcaaaacaaacatctggaggtctgcttcactggccacttagactcacaggacaaccagagccacactggcatcagattt

SEQ ID NO: 17955 - DNA, 201 bp, Homo sapiens
ttgttgtttaaatatgggttcatagtaatttatttcctccatcaaatttgtatagaaacttgttaaattctcacacaaggttgtatatttgccaattcctycttattttgttcattttctttaaatatgttgagaccattaatgactttataacttcttagtggatttcttttcttttatcattatacagcattctgcttt

SEQ ID NO: 17956 - DNA, 201 bp, Homo sapiens; identical to SEQ ID NO: 3145

SEQ ID NO: 17957 - DNA, 201 bp, Homo sapiens
ctggcactccttatgcttgggtgacctgcactgaggctcactgtcacctgcctggggcagcactgcccaccgccccacccagcacagcagcctacccaccytcagggagatgctgaagtccacacaggctgcccctgtgtcctctgttatgtttatctgggaactgttcatcctccctgacccaattaagccaacgttctc

SEQ ID NO: 17958 - DNA, 201 bp, Homo sapiens
tattttgttcattttctttaaatatgttgagaccattaatgactttataacttcttagtggatttcttttcttttatcattatacagcattctgctttatmcatattggtgcttttgccttaaaatctcttttaccaagtgctaatgttgttatacaaacttttttttcatatttttcactcaatttatgttaagccatct

SEQ ID NO: 17959 - DNA, 201 bp, Homo sapiens; identical to SEQ ID NO: 3146

SEQ ID NO: 17960 - DNA, 201 bp, Homo sapiens
aaggtcctgaggggaaattgtgaaacagggaagacacagggaaggaccatggagaagtcaaggagggggttgtatgagctcctaatcagatgcagggtccyggagaagtggccataacaagacattgttggctcaataaccatgaaggaaccagagccaagtgtgtcagtaggccagatttacagatgctaactacctaga

SEQ ID NO: 17961 - DNA, 201 bp, Homo sapiens
tctcttgtaacagcacttagcttttgcaattttatctgataatcttagctttttaatgaatttttatttgttttcatttattatgattccagatgtatatkgacctgtatcttctgtggtagtgttgaccattcttaatttgtgtttttttgtgtgtctctttcctgatttctgatggattgatataaaattctatattct

SEQ ID NO: 17962 - DNA, 201 bp, Homo sapiens
agatgagcaaggaagaacccccctaggcattctaagccagagccttgttcttaactctgtgatatccagggaacctaataataaaagcagaaacataaaaygcaaatgaggaaatttatgcagaaagaaagatacagaaaaaaaaaaaagaataacatgactggaggaaatggtggcaactcagacacagaatcctcatag

SEQ ID NO: 17963 - DNA, 201 bp, Homo sapiens
taatgaatttttatttgttttcatttattatgattccagatgtatatggacctgtatcttctgtggtagtgttgaccattcttaatttgtgtttttttgtrtgtctctttcctgatttctgatggattgatataaaattctatattctcccttttccccctgctggtttggaaattaaagacaaaatttctgtaatcttat

SEQ ID NO: 17964 - DNA, 201 bp, Homo sapiens
aaaaagtaataatcccaactgtggaaatgatttcacttttctgccctgttaataagaaaggatcatgctggtgagaaacggaagttactcttagctgcatragttttcaagtttaatctggttaatgttacttagggtgtttaagataagagtcctacttaataatagtgtatttcacacttcaacattgttaagagagta

SEQ ID NO: 17965 - DNA, 201 bp, Homo sapiens
tgtttttcaaaatgattatgccctcttgcattcccaccagtaatgtgtgaagcttctcattgctccacatactcaccaatacttgatagtgttagtaaaaytttaatttttttataaagtctacatttaccatttttcctttataatctgtgattttgaggtcctatttaaggaatcttttcctaactcaagaacctatgt

SEQ ID NO: 17966 - DNA, 201 bp, Homo sapiens
ctttcctgatttctgatggattgatataaaattctatattctcccttttccccctgctggtttggaaattaaagacaaaatttctgtaatcttattaatcwtgccccaaaccccagagatgacaaggatcttgtaatggtttcactacaaactgaataccccatctctaccatttggctattattgtttaatatttaattt

SEQ ID NO: 17967 - DNA, 201 bp, Homo sapiens
ctgatggggttgactatcttttatatataacttaatttttctattaggtaacatttcacaattattttttaatatcagctgcccatgattgcacagatgaraaaatctctgttcaataatgccctaaaactgaatgaaaaatgttgtaatagaaggtgcatatgttgccagtgtggcctcctgagccacagggcacctatc

SEQ ID NO: 17968 - DNA, 201 bp, Homo sapiens
caacacagcaacatagatgataagcaaaagaagccagacacaaaagcatgtatatgttttgctcatttatatgaaatccaagagcaggcagtattaacatmtgacagaataaatgacagcaatggttgccccctgagaggctgcctggctgcatgtgttcagtatgcaggttcacaggcagtatatgcattgctctgttca

SEQ ID NO: 17969 - DNA, 201 bp, Homo sapiens
atgacactgtattcaagcacttcaaaagacataagctggagatatcaaatgcaataaaaaagacatttccattccttgagggcctccgcgatcgggaactyatcacaaataaaatgtttgaagtaagtaaagtttatttcacaacctggcagatatgctttcatattttacaagtatttctgtaagtgctcctgtaaagta

SEQ ID NO: 17970 - DNA, 201 bp, Homo sapiens
tggaagaattttaaatagagtgataggaaaatcctagatgaaaaaatggaaattaagtcaattaataaccctacaatggcctgtaagtgctcaagttaaaraaagagtcggccgggcgcggtggctcacgcctgtaatcctagcactttgggaggccgagacgggcggatcacgaggtcaggagatcgagaccatcttggc

SEQ ID NO: 17971 - DNA, 201 bp, Homo sapiens
ggcggatcacgaggtcaggagatcgagaccatcttggctaacacggtgaaaccccgtttctactaaaaatacaaaaaattagccgggcgtgttggcgggcrcctgtagtcccagctgcttgggaggctgaggcaggagaatggcatgaacctgggaggcggagcttgcagtgagccaggatcgcgccactgcactccaacc

SEQ ID NO: 17972 - DNA, 201 bp, Homo sapiens
catgtactcactttaaataaaaatctagaaatgatgaagtttagtgaggaagctatgtcaaaagttgacataggctgaaaattaggccttttgcagaaaayaattggccaagttatgaatgcaaaggaaaagttcttgaaggaaattaaaagtgctactccagtgaacactttaatgataaagcagaacagtcttattgct

SEQ ID NO: 17973 - DNA, 201 bp, Homo sapiens
aggaggagtctcttgttagaggctaatggagcaggtgactttctcttgaagccaatgctcatttaccattctgaaagtcctagggcccttaagaattattytaaatctactctgcctgtgctctataattggaataaagcccagatgagagcacatctgtttacagcatggtttactgaatattttaaacccaccattgag

SEQ ID NO: 17974 - DNA, 201 bp, Homo sapiens
acaaggtgattaatgctatttccatgcctgctaacacaacatccattcagcaagcccatgagtcaaagagtaatttcaactagcaagtcttaatatttaaraaatacatgttgtaatgctatagctgtctttatatatagtgattcctctgatgaatctgggcaaagtcaattggaaaccttctggaaaggattcaccatt

SEQ ID NO: 17975 - DNA, 201 bp, Homo sapiens
tgaggcaggagaatcgcttgaacccgggaggcagaggttgcactgagcagaggttgcaccactgcactccagcctgggcaatagagtaagactccatctcaaaaaaaaaaaaaaagatgtggagcctgatgatgtgactgaatcgctgtgatctcatgataaaactgagtgataaggagttgtttattatggatgattaaa

SEQ ID NO: 17976 - DNA, 201 bp, Homo sapiens
atttgtaactgtgattttattattctactttctcagggagaaagagaggcaaacctggaacccactttactcagagtgacagagctccacagaaaagagtmcgatcaagaggtaaaaaagaaaagaggaatgcactttcaataactaaacatctaatttcctgtgctttatgctgtattttcagtaataaacctatgtctt

SEQ ID NO: 17977 - DNA, 201 bp, Homo sapiens
atctgtcagtcttttcatttatggtttccaggttttgtgtacaatttacaaatatattatcctcctcataatttgaaaacatttttacttgcttgtagaayatttgaaatactttttaatgtttaaatctataacacacatagaattcatttattggtgtatgatgtgagatgataattaagagatataaccccaatactt

SEQ ID NO: 17978 - DNA, 201 bp, Homo sapiens; identical to SEQ ID NO: 3141

SEQ ID NO: 17979 - DNA, 201 bp, Homo sapiens
gaactaataaatgaattcagtaaagttgcaagatttaaagatcagttgtgtttctacacactaacaatgaactatccaaaaagaaattaagaaaataatcmcatttacaatagcaacaaaaagaataaaatgggaacaaatttaaccagaggtgaaatatttgcacactgacaactatgacactgacgaaagaaattgaaa

SEQ ID NO: 17980 - DNA, 201 bp, Homo sapiens
ttaagaaaataatcacatttacaatagcaacaaaaagaataaaatgggaacaaatttaaccagaggtgaaatatttgcacactgacaactatgacactgaygaaagaaattgaaaaagatgcaaataaatggaaagacatatcctgttcataaactggaagaatattgttaaaatgttcataccatccaaagtgatctgga

SEQ ID NO: 17981 - DNA, 201 bp, Homo sapiens
atgaaatctctatcaaaatttcaatgacatttttcacagaaataggaaaaaggaatcctaaaatttgtatagaaccataaagacccaaatactaaaagtartcttgaaaaaaaggaacaaacctggaggcatcacaccgtatgattttaaactatattacaaagcaagagtaatcaaaacagtgctggcataaaaacacac

SEQ ID NO: 17982 - DNA, 201 bp, Homo sapiens
tttttcctttataatctgtgattttgaggtcctatttaaggaatcttttcctaactcaagaacctatgttttcttcaagtttttggtgttagcgcttattkagatctataacccattttgagttagtttttgcatatagtttgagctaaagattgatttcttttctttttttgcatgtggatactcaatcattccatcata

SEQ ID NO: 17983 - DNA, 201 bp, Homo sapiens
ccctgctggtttggaaattaaagacaaaatttctgtaatcttattaatcttgccccaaaccccagagatgacaaggatcttgtaatggtttcactacaaaytgaataccccatctctaccatttggctattattgtttaatatttaatttttaactataaattttgaaactattatttttacagttgatatttacttaaat

SEQ ID NO: 17984 - DNA, 201 bp, Homo sapiens
tttataatctgtgattttgaggtcctatttaaggaatcttttcctaactcaagaacctatgttttcttcaagtttttggtgttagcgcttattgagatctrtaacccattttgagttagtttttgcatatagtttgagctaaagattgatttcttttctttttttgcatgtggatactcaatcattccatcataatttgtt

SEQ ID NO: 17985 - DNA, 201 bp, Homo sapiens
tctctaaaagcttttttccccaatttttaatcatgaaaatttcaagcatgcagaagtcttgggagaattgtatactaaacatcaatatactttcacacagwttcacaattaacattgtatcattcctgctttatcgcttttctatctgtattagcccatttttacactgctgataaaaacatacccaagactgggtaattt

SEQ ID NO: 17986 - DNA, 201 bp, Homo sapiens
atttaaggaatcttttcctaactcaagaacctatgttttcttcaagtttttggtgttagcgcttattgagatctataacccattttgagttagtttttgcrtatagtttgagctaaagattgatttcttttctttttttgcatgtggatactcaatcattccatcataatttgttgaaaaaagtatcctttctgcattgaa

SEQ ID NO: 17987 - DNA, 201 bp, Homo sapiens
agcttttttccccaatttttaatcatgaaaatttcaagcatgcagaagtcttgggagaattgtatactaaacatcaatatactttcacacagtttcacaawtaacattgtatcattcctgctttatcgcttttctatctgtattagcccatttttacactgctgataaaaacatacccaagactgggtaatttgtaaggaa

SEQ ID NO: 17988 - DNA, 201 bp, Homo sapiens
aagatgacattttaagactttaagaaatcacacccattagacgctgactcgcacatggagtgtccagggggtacccaaagaacaaaagagaaggcaggaaygtcaattcacagatggaaaatgtcaggtattttactttgaatcagacagaaaagggaagaggccctcaacctcaagcttcatattctctctcccttctgg

SEQ ID NO: 17989 - DNA, 201 bp, Homo sapiens
aagtttttggtgttagcgcttattgagatctataacccattttgagttagtttttgcatatagtttgagctaaagattgatttcttttctttttttgcatrtggatactcaatcattccatcataatttgttgaaaaaagtatcctttctgcattgaattagttactttgacgtccttgttgaaagtcagttggccatata

SEQ ID NO: 17990 - DNA, 201 bp, Homo sapiens
aagattgatttcttttctttttttgcatgtggatactcaatcattccatcataatttgttgaaaaaagtatcctttctgcattgaattagttactttgacrtccttgttgaaagtcagttggccatatatgtttaggtctattacttgactttttttctgttccatttatctgtatgtctattcttatgccaatacaccat

SEQ ID NO: 17991 - DNA, 201 bp, Homo sapiens
caatcatggcagaaggtgaaaggcacgtcttacatggcagcaggcaaagacagagtgaaaaacaagtgaaaggggtttcctttataaaaccatcagatctygtgagacttgttcactaccatgagaacagtacaggggaaactgccccccgattcaattttatctcccactgggtccctcccacatgagaataagggagct

SEQ ID NO: 17992 - DNA, 201 bp, Homo sapiens
ggatactcaatcattccatcataatttgttgaaaaaagtatcctttctgcattgaattagttactttgacgtccttgttgaaagtcagttggccatatatrtttaggtctattacttgactttttttctgttccatttatctgtatgtctattcttatgccaatacaccatcttgattactacagttttacaaatcctgaa

SEQ ID NO: 17993 - DNA, 201 bp, Homo sapiens
accatcagatctcgtgagacttgttcactaccatgagaacagtacaggggaaactgccccccgattcaattttatctcccactgggtccctcccacatgaraataagggagctacaattcaggatgagatttgagtagggacacagacaaaccatgtcactatccatatatacatttttttatccactcaataactcatgg

SEQ ID NO: 17994 - DNA, 201 bp, Homo sapiens
atacaccatcttgattactacagttttacaaatcctgaaatcaggtagtgtaagacctccagttttgtttttcagaattgttttggctatttcagacccgygcattttgaagattcttctatcttgcagctcagctactgtcaagattacatcattgtccaaggtgcctgctaagctccagccacaatgtccatgttctag

SEQ ID NO: 17995 - DNA, 201 bp, Homo sapiens
atccactcaataactcatggtcaagtttgaaacatttcagggttgcagacatcagtacccttccccctcaaatacttctgcatgcattctttttttaagayaaaatttacaatgaaatgcacaagtattaagagtaccattggatgagttcttacaaccacacttttctgcaccatcgaaatctttatcaagatacagaac

SEQ ID NO: 17996 - DNA, 201 bp, Homo sapiens
ccagccacaatgtccatgttctaggcagtcagaaggagaaagggtgaagagcaaaattatcttccccagaggcctattacttttgcgagaagttttctccrgaactcccctcctcccacaatattctgctctcatcttagtggtcagatcttaaactggtggccatgtcaggtgtgagagaggttatgaactgtggttttt

SEQ ID NO: 17997 - DNA, 201 bp, Homo sapiens
ctgcatgcattctttttttaagataaaatttacaatgaaatgcacaagtattaagagtaccattggatgagttcttacaaccacacttttctgcaccatcraaatctttatcaagatacagaacatgatcatcaccctggaaaggttccttatgtcctttctggtatatctccacccactacctatcagggcaatcactac

SEQ ID NO: 17998 - DNA, 201 bp, Homo sapiens
attacttttgcgagaagttttctccggaactcccctcctcccacaatattctgctctcatcttagtggtcagatcttaaactggtggccatgtcaggtgtragagaggttatgaactgtggtttttctctggaaatatcgatgtctgcagtcttggaggtattctgttagttgatcaggagtggaaagtagatatgtggaa

SEQ ID NO: 17999 - DNA, 201 bp, Homo sapiens
acacttttctgcaccatcgaaatctttatcaagatacagaacatgatcatcaccctggaaaggttccttatgtcctttctggtatatctccacccactacytatcagggcaatcactactctttgtttttccatgataacttaatttgggtttttaaaaaactttatataaataaggttttacagcgtgttctctttattg

SEQ ID NO: 18000 - DNA, 201 bp, Homo sapiens
gtggctggggagaggtgggcatgtgaggggactgcttgaggacagtctgtccaatctatcctctttgtccatgacaccaaccaggtaacagtcaccccccyacccaccccaacaaatgactgagaacaggggtagggacaatgtctagagggttctatgtgggacctcagaagctgggcccagcccctgccgtctcatgcc

SEQ ID NO: 18001 - DNA, 201 bp, Homo sapiens
atcactactctttgtttttccatgataacttaatttgggtttttaaaaaactttatataaataaggttttacagcgtgttctctttattgtgagatttatytcactcagcatgtttttgagattcattcatatcattggatgtatcagtaatttgttcgttttcattgctagtgtccattgtctgaatatactgaattttg

SEQ ID NO: 18002 - DNA, 201 bp, Homo sapiens
tagagtcctattgaaaattgtttcttttcaccaatcatctatcttctgctcttctgttcttgccagtttaagtgtctgcccggcttgtggatgtacatttktgtttggaaagaaaaacaagtggttgcatttattttaagaatgggtgtttttggccgggcatggtggctcatgcctgtaaccccaacactttgggaggct

SEQ ID NO: 18003 - DNA, 201 bp, Homo sapiens
cacacacacacacacatttcataaaccgtgaatgctttaggtctttaggtcccttatgaccagctgaccacctctaaggtacaagtcactttatgtgaggsaagcaagttaatgcctggctttcatacaataagcacaatccccagagcacacaaggtgttcgaagaagggaagtgtttacaattgttgagcttccctgag

SEQ ID NO: 18004 - DNA, 201 bp, Homo sapiens
gtccctcccacatgagaataagggagctacaattcaggatgagatttgagtagggacacagacaaaccatgtcactatccatatatacatttttttatccrctcaataactcatggtcaagtttgaaacatttcagggttgcagacatcagtacccttccccctcaaatacttctgcatgcattctttttttaagataaaa

SEQ ID NO: 18005 - DNA, 201 bp, Homo sapiens
gtgaattctttagtttttctagtgagtgatctctaagtggtaaattctctaagtgctgtatgtacaaatttgtctttcttttgatagaaatttttagctargttaaaaattttaggttgatatttatttattctcagtatagtaaagtgattactacattgtcttctggaatctatggtatggctaataaaaatcattctt

SEQ ID NO: 18006 - DNA, 201 bp, Homo sapiens
tctccattgttctttttctttggtttcactttttgtctagctgaagtgaattctttagtttttctagtgagtgatctctaagtggtaaattctctaagtgytgtatgtacaaatttgtctttcttttgatagaaatttttagctaggttaaaaattttaggttgatatttatttattctcagtatagtaaagtgattacta

SEQ ID NO: 18007 - DNA, 201 bp, Homo sapiens
ctctgaagtctgagagggaaggccagaccctcctgctattgatcttcatcacaaattgggtggctctagatccaatgtggtgagtggccacagtctgagcrctgggaacaaagagggctcaggatcaagttaccctggtcttacaggaaccttggcaaagtgtatacagactgaggatggaaaatggttcacccccatgga

SEQ ID NO: 18008 - DNA, 201 bp, Homo sapiens
tatcaaaatttcaatgacatttttcacagaaataggaaaaaggaatcctaaaatttgtatagaaccataaagacccaaatactaaaagtaatcttgaaaamaaggaacaaacctggaggcatcacaccgtatgattttaaactatattacaaagcaagagtaatcaaaacagtgctggcataaaaacacacataaaccaat

SEQ ID NO: 18009 - DNA, 201 bp, Homo sapiens
atcacaccgtatgattttaaactatattacaaagcaagagtaatcaaaacagtgctggcataaaaacacacataaaccaatggaatagaatagggaacccrgaaataaactcatgaatgtatgttcaagtaatctttgataagggcaccaacaataggattttctttatgtaaatgttccacattttcatttttcttatct

SEQ ID NO: 18010 - DNA, 201 bp, Homo sapiens
cagttcatgtatcatgtaactcaccacttagagtataccaatcaatgattttttttgtattttcacaggattgtacagccattattatcacctaattttaraacaatttgtccttcactaaagaaaaccccatgtcaattagtagtcaatgcccattcccacctcaccccaatgcccagccctaagcagctgctaatctat

SEQ ID NO: 18011 - DNA, 201 bp, Homo sapiens
ttttcttatctgctttatagagctatatataaaacaaattcatcaccttaaggtataactgaatttgttttaacaaatgtgtgcagttatataaatacctycactatcatgatatgtatcatttccatcaccccaaagtccacttgtgttcttctcagctgtctctgattcttgacaacagctgatctgttttctgttcgt

SEQ ID NO: 18012 - DNA, 201 bp, Homo sapiens
ttgcctggaaacctcatcttccagaggcaggcagcaagatggagcaaaaagattaacatgcctcttggagaaccacagttccacctctttagtagtttttyttagcccttggctgttactatacaagcctcctacctccctatacaagtttattaaactcttctaaagctcttctttgagtgcctgttatcttggttaaat

SEQ ID NO: 18013 - DNA, 201 bp, Homo sapiens
attattgtttaatatttaatttttaactataaattttgaaactattatttttacagttgatatttacttaaatcaattttttaaatcattttatgtactcwccattgttctttttctttggtttcactttttgtctagctgaagtgaattctttagtttttctagtgagtgatctctaagtggtaaattctctaagtgctg

SEQ ID NO: 18014 - DNA, 201 bp, Homo sapiens
gaatacaggtttaattaactcacagtaccatgtgactggggaggcttcacaatcatggcagaaggtgaaaggcacgtcttacatggcagcaggcaaagacagagtgaaaaacaagtgaaaggggtttcctttataaaaccatcagatctcgtgagacttgttcactaccatgagaacagtacaggggaaactgccccccga

SEQ ID NO: 18015 - DNA, 201 bp, Homo sapiens
aatacaggtttaattaactcacagtaccatgtgactggggaggcttcacaatcatggcagaaggtgaaaggcacgtcttacatggcagcaggcaaagacagagtgaaaaacaagtgaaaggggtttcctttataaaaccatcagatctcgtgagacttgttcactaccatgagaacagtacaggggaaactgccccccgat

SEQ ID NO: 18016 - DNA, 201 bp, Homo sapiens
ttctgacatataccccttcctcctgaacttcactgcagaccaggatttgttctgaaatctccatgccatatttttccttcatatcccagggagaagcataygcctgtctatacaggctcacacataagcagtgtgttctagatgcccagaggggtggccttcctgaatcttgtgattcccagtgacgtggacactgtttta

SEQ ID NO: 18017 - DNA, 201 bp, Homo sapiens
ggacagtctgtccaatctatcctctttgtccatgacaccaaccaggtaacagtcacccccccacccaccccaacaaatgactgagaacaggggtagggacwatgtctagagggttctatgtgggacctcagaagctgggcccagcccctgccgtctcatgcctggtgcggagaggctgactcagcattctcagaggtggga

SEQ ID NO: 18018 - DNA, 201 bp, Homo sapiens
cctcagaagctgggcccagcccctgccgtctcatgcctggtgcggagaggctgactcagcattctcagaggtgggagcactggagcagggtgttttccttytggacaaaggatccagggtagttctgagagacagatatcaccaatgctcctgcttcctccatacctcctagggttggaggtgttcctgccttagatctct

SEQ ID NO: 18019 - DNA, 201 bp, Homo sapiens
tataaagctcaaataattatatttattcctctgtataattaactttattctctttggtttgaaggaaaaaagaaggggcatggctggagcagaatgggaaygagaacgcagaaaaacaaccaacaaaatggtaagcaggcaaagtgaagtagttacagcttttgagtttattaaggcgctgtccattgtattctggaaggc

SEQ ID NO: 18020 - DNA, 201 bp, Homo sapiens
aagctgggcccagcccctgccgtctcatgcctggtgcggagaggctgactcagcattctcagaggtgggagcactggagcagggtgttttccttctggacwaaggatccagggtagttctgagagacagatatcaccaatgctcctgcttcctccatacctcctagggttggaggtgttcctgccttagatctctggattt

SEQ ID NO: 18021 - DNA, 201 bp, Homo sapiens
cactttgggaggctgaggcggatggatcacttgaggttggagttcgagaacagcctggtcaacatagtgaaaccctgtctctacttaaaatacaaaatttygctggatgtggtggcgggcgcctataatcccagctactcgggaggctgaggcaggagaatcacttgaacccaaaaggcagaggttgcagcaagtcaaaat

SEQ ID NO: 18022 - DNA, 201 bp, Homo sapiens
tgcaagggaaggggaggggtcaggcatcacagcttgacttattttgaaagaaatagagcttttcttctacaacctgggtgtgagtgaggggctgaacctgkcataatcagttccaccaactctttctatggtcccataggtggactggtgcattgtcctaggatgcgggcgcttggaacttgggtaatcaactcaacctac

SEQ ID NO: 18023 - DNA, 201 bp, Homo sapiens
tcatcaagtccactgcaagggaaggggaggggtcaggcatcacagcttgacttattttgaaagaaatagagcttttcttctacaacctgggtgtgagtgargggctgaacctggcataatcagttccaccaactctttctatggtcccataggtggactggtgcattgtcctaggatgcgggcgcttggaacttgggtaat

SEQ ID NO: 18024 - DNA, 201 bp, Homo sapiens
actctgtcacacttctttctagaggttaataccaaccataacaattattttaaaacaactttaaattatattctgaccaccatagtatttattaaggtttrtgatagggtttcagtattgttaaatgggtattacagcctgagacacaataatatttgaatcctgccttgctcagccacttgattctgagagtaaaacaca

SEQ ID NO: 18025 - DNA, 201 bp, Homo sapiens
caacctgggtgtgagtgaggggctgaacctggcataatcagttccaccaactctttctatggtcccataggtggactggtgcattgtcctaggatgcgggygcttggaacttgggtaatcaactcaacctacttgcttgggactttctcaattttgccagtgaaactctcatgtcctgggcacccccttagtcctggacag

SEQ ID NO: 18026 - DNA, 201 bp, Homo sapiens
ctgtcacacttctttctagaggttaataccaaccataacaattattttaaaacaactttaaattatattctgaccaccatagtatttattaaggtttgtgwtagggtttcagtattgttaaatgggtattacagcctgagacacaataatatttgaatcctgccttgctcagccacttgattctgagagtaaaacacagta

SEQ ID NO: 18027 - DNA, 201 bp, Homo sapiens
actcacagaactgccatttatttgtgtctctgctaagagaaacccaaacaccttcacttaattttgtagttttgtctcaattttctctgaatattttagtstctgtaatgacagtaatcatcattttgatcttgcaaagattaaattagtggatgtgtgtttaacatatattatatgccatatatatatttcaaatatata

SEQ ID NO: 18028 - DNA, 201 bp, Homo sapiens
gagacacaataatatttgaatcctgccttgctcagccacttgattctgagagtaaaacacagtagtgctgtattatgaatttgctggatttaagctccagwttgttctgtaccaaaacctccatagactagagtagacttcatgttgtttcttttttctccctaaaaatatgaggcctaaacagatttaatgaaagctaaa

SEQ ID NO: 18029 - DNA, 201 bp, Homo sapiens
acttcatgttgtttcttttttctccctaaaaatatgaggcctaaacagatttaatgaaagctaaatccgacatacccactagtcccagaaaagatgtaacyagacagaaacagctagagagaaaggaagaaataactctgtattagctggactgttcaaggttgtggccagagctctagtgccaagcctggctggaatata

SEQ ID NO: 18030 - DNA, 201 bp, Homo sapiens
gagtccgatcaagaggtaaaaaagaaaagaggaatgcactttcaataactaaacatctaatttcctgtgctttatgctgtattttcagtaataaacctatktctttaattgttttatgaagctatactaactattgaaaaacatatcttattaagtcattttccaaaatgtatcaaggaaagaaggaagtaagttggtgat

SEQ ID NO: 18031 - DNA, 201 bp, Homo sapiens
agatttaatgaaagctaaatccgacatacccactagtcccagaaaagatgtaaccagacagaaacagctagagagaaaggaagaaataactctgtattagmtggactgttcaaggttgtggccagagctctagtgccaagcctggctggaatataggagggaaaagagcagcaaggatatgacatctggatctattctcac

SEQ ID NO: 18032 - DNA, 201 bp, Homo sapiens
agcttctcagagagccacacctgtgtggctgatgttctattgcctggaaacctcatcttccagaggcaggcagcaagatggagcaaaaagattaacatgcstcttggagaaccacagttccacctctttagtagtttttcttagcccttggctgttactatacaagcctcctacctccctatacaagtttattaaactctt

SEQ ID NO: 18033 - DNA, 201 bp, Homo sapiens
ggcaaagtgtatacagactgaggatggaaaatggttcacccccatggaatttgaaatcaaaggaggctacgcaagatcaaagaactggaggctgagtgtgygctgtggcgggtggcccctacgacggctgatggaggtattccaatgacaagaggccagacctgtgcccattcttcttgttccctaataatgaggagactg

SEQ ID NO: 18034 - DNA, 201 bp, Homo sapiens
ttactaagtgccattaatgtcttgaaaagagtaaatgacaggcttagatctattcattaccaacctaaagagaagagaccctcatacctggagctggaagrcagacagcaaggaaggtctggtacagacctgattttatgaatcgcagaacttcagagaacactgaattctaagctcaggatggtctcttatgccaaagtc

SEQ ID NO: 18035 - DNA, 201 bp, Homo sapiens
aatcagatttaggtcttttccacactgattttgatgcccggccaactcagggactcacgaatggttaaaacagccctggaggtcagtgtttgcgtggctgmttttgtatgagcttgacatggaggtttatgtctcacagcccacagccagatgtctgtgggaaaaagaggaaaacagatccagcaaaggtatggtcacccc

SEQ ID NO: 18036 - DNA, 201 bp, Homo sapiens
ataggccattgctgtataaagggtataacccgtaagtgatttagctgatcttcctctggctacacagaaagccacatgttgcacactaaggttgaaccagmgttgtggttagagatctgtgtcctaaggctttttggctttttaaaaaatctttgactgtgtgatcttgtgctgaccacttggccttctttgccttggttt

SEQ ID NO: 18037 - DNA, 201 bp, Homo sapiens
tgggtggctctagatccaatgtggtgagtggccacagtctgagcgctgggaacaaagagggctcaggatcaagttaccctggtcttacaggaaccttggcraagtgtatacagactgaggatggaaaatggttcacccccatggaatttgaaatcaaaggaggctacgcaagatcaaagaactggaggctgagtgtgcgct

SEQ ID NO: 18038 - DNA, 201 bp, Homo sapiens
gctacctaactgcagcaaaacagaatagctggagagcgcccatcaaaccaatgacaacaactgtatgtttcattgtcatataagaatcagtggagcttacyacactggaagttaaaacagttttactgaagtctaatttctctgataaagcattcaattttctgtgaaatttgaaaggtgaaattggggcacacattctgt

SEQ ID NO: 18039 - DNA, 201 bp, Homo sapiens
cattgtcatataagaatcagtggagcttactacactggaagttaaaacagttttactgaagtctaatttctctgataaagcattcaattttctgtgaaatktgaaaggtgaaattggggcacacattctgtagttaccgatcaaaaatgccacttggaagaaagactttgaaactctagagatttatggaatagaatttcc

SEQ ID NO: 18040 - DNA, 201 bp, Homo sapiens
ctttaggttttcccatcttcatgtacccaagattgatcagagtgactgacacccagtagcatgcaataagtgtgtgctgcttggatagctctggtgtaggractccagctggagtggcactggtgcaactggaaaagaagtgatagatggtatgagattatgaatgaaaacctcttaggacttaggaaagaagcacaagag

SEQ ID NO: 18041 - DNA, 201 bp, Homo sapiens
ccttccaaaaaaatgtacacacagatacacagaattctttctcaatgggaaattatttacctttgtcaagatggtgccattggggaggaagatctccagargcaaacgtattttacaggaggagctgaccaggaaaatcttttatgttgatgccacctctttggttctaccagagggactgtgcagacctgctttttatct

SEQ ID NO: 18042 - DNA, 201 bp, Homo sapiens
cctgctttttatctgtgaaagtgatttttccttcacttaagaacgcaacaaacaaataggttaagtgcagtgtagattcaggacaaggtgatggtttttcsaagactgggtgtgaatgagaacctgaggaggggaaagagaaaaatgtcatccttatgcacttcaggtagaaatatgcattcaagacattcacagacttct

SEQ ID NO: 18043 - DNA, 201 bp, Homo sapiens
tcacagacttctaaaacagctcacacatagctagccactaagcttcatattccactgggaacctgagatccaggcctttacattatctgatatactggctratttgaattctcagccactgagacatttcatccactgggtttcccgaagggaaactatgatgtcacctattcagtgagtacactaaagaccagcaactct

SEQ ID NO: 18044 - DNA, 201 bp, Homo sapiens
cagtgagatgccaattttaggcaaggtcaccttcttgcacaactccagggggcaggactcacatagaatatcatgcaatagcactgacacataatagttarcagaggagggatgctcaaatagttttatacacaccttacctccaaagcagtcctccaatcagatttaggtcttttccacactgattttgatgcccggcca

SEQ ID NO: 18045 - DNA, 201 bp, Homo sapiens
ctgggatttgttccacaacacatggatgcaaatactatcatattttaatttccccaaatgaaattaaatcttgctaaaggtctcacatattgagacttgtragaaatggagaattcattgatttaccattccttttatagaacaaagcaccagctcttttatgggcccaggaaatgaggagagggtctccatcttcaacac

SEQ ID NO: 18046 - DNA, 201 bp, Homo sapiens
gtgtggctgatgttctattgcctggaaacctcatcttccagaggcaggcagcaagatggagcaaaaagattaacatgcctcttggagaaccacagttccayctctttagtagtttttcttagcccttggctgttactatacaagcctcctacctccctatacaagtttattaaactcttctaaagctcttctttgagtgcc

SEQ ID NO: 18047 - DNA, 201 bp, Homo sapiens
ttcccacctcaccccaatgcccagccctaagcagctgctaatctattttctgctctataaatttgcttattctaggcattttctgcaaatggaatcctatsatacatcccctttcatgactggctgcttttaatcagcatgatgttttcaaagttcattcatattgtattagtacttcatttcttttcttgataaatcata

SEQ ID NO: 18048 - DNA, 201 bp, Homo sapiens
tatcttggttaaatattaacaggatgacaacttgcagatttgaaacttgtttgatcttgggataagatgtctgtaattatcaatattggttccttgggccrtttgggtcttaaatgggtaaaaacctggtcagtaactgtgtagtctaaagaccagaaagtggaattatattaccaagccataggtctactttgggtccga

SEQ ID NO: 18049 - DNA, 201 bp, Homo sapiens
tctattttctgctctataaatttgcttattctaggcattttctgcaaatggaatcctatcatacatcccctttcatgactggctgcttttaatcagcatgwtgttttcaaagttcattcatattgtattagtacttcatttcttttcttgataaatcatatatttcattgtatagatataccacattttgtttatccattc

SEQ ID NO: 18050 - DNA, 201 bp, Homo sapiens
ggaacattttgctttcctgctttggaaaataaaacacatttgaacattagtaaacattgagatgcccactcacagccaattaacatgcacttgggagaacrtcgtcggctgcagtgtctgccatgtcaatccttaattactatttggaatgaaggctgtggaagtctcaattctacccattcctcatggttaaccttcttc

SEQ ID NO: 18051 - DNA, 201 bp, Homo sapiens
ctaggcattttctgcaaatggaatcctatcatacatcccctttcatgactggctgcttttaatcagcatgatgttttcaaagttcattcatattgtattartacttcatttcttttcttgataaatcatatatttcattgtatagatataccacattttgtttatccattcatcaacttgggttattttcactctttggct

SEQ ID NO: 18052 - DNA, 201 bp, Homo sapiens
ggaagggcaggattagctgctcatcctcctggagtttttctttgaaaaactttcacacctacttctgtagtatccggttctcagttccccaccccctgctwggtacaattttcagattattctagagctccctgagctcctttctcagctgtggagaaagctgataggaggggaaaatggagcaaagcagagaataaaagt

SEQ ID NO: 18053 - DNA, 201 bp, Homo sapiens
ccaccagaaatgtatgaaggctcccatttctctacacactcaccaacacttgttattgtttgtcttttttattatgatcatcctagtgagtgtgatgtggyatctcattgtggttttgctttgcatttccctaatggctgatggggttgactatcttttatatataacttaatttttctattaggtaacatttcacaatta

SEQ ID NO: 18054 - DNA, 201 bp, Homo sapiens
atctcattgtggttttgctttgcatttccctaatggctgatggggttgactatcttttatatataacttaatttttctattaggtaacatttcacaattaytttttaatatcagctgcccatgattgcacagatgagaaaatctctgttcaataatgccctaaaactgaatgaaaaatgttgtaatagaaggtgcatatgt

SEQ ID NO: 18055 - DNA, 201 bp, Homo sapiens
ctgtgagtgctttttgtctgcagacccctttaggttttcccatcttcatgtacccaagattgatcagagtgactgacacccagtagcatgcaataagtgtrtgctgcttggatagctctggtgtagggactccagctggagtggcactggtgcaactggaaaagaagtgatagatggtatgagattatgaatgaaaacctc

SEQ ID NO: 18056 - DNA, 201 bp, Homo sapiens
atagtaaaaatattaacagctctgtggatttaggtagatgggttgtgtacaataaggcacaattcagcaactggggttgtctgtggagcactttaatgccrggctaagtaattcaaatctgtaattgatagcaacaatcagtgaaatcttctgagattggaaatgacatttaaaacagtattttagacagcaatggggctt

SEQ ID NO: 18057 - DNA, 201 bp, Homo sapiens; identical to SEQ ID NO: 3149

SEQ ID NO: 18058 - DNA, 201 bp, Homo sapiens
acctatagccatgggtcctcccttcccagggttcctgagcccctactaatgcccttttttcactatttatatttatccttctgtgagtgctttttgtctgyagacccctttaggttttcccatcttcatgtacccaagattgatcagagtgactgacacccagtagcatgcaataagtgtgtgctgcttggatagctctgg

SEQ ID NO: 18059 - DNA, 201 bp, Homo sapiens
aataaatttaatagcatttattggagcaaagagcaattcatgaattgggcagcactcagaacaagaagaggttcagagagctatgctgtagcagcccagayggtgaggccaacacaggagtaagacagagaaattatatttaatggattatcatggaaagatgctaattagaggtagatgacggattccagttggtaaatt

SEQ ID NO: 18060 - DNA, 201 bp, Homo sapiens; identical to SEQ ID NO: 3151

SEQ ID NO: 18061 - DNA, 201 bp, Homo sapiens
tgtgtatataaagctaggtcctctttggattaaaccgtatcagatggagatgctgaggagccctcaaaacaaacctcctgaatgtgtttcagcaatagatrcagatgttgtaagagtgtcaaagttggaaaatccaacacggtcatggaatacataaaaatatttcataataaggtgagagtatcatctccaactcaaaat

SEQ ID NO: 18062 - DNA, 201 bp, Homo sapiens
gcactccaaggtgcaggtggagcgaagatggtcttaagcatcagccagaaggaacagaccaggccaagctattatgtttaaggtgtggagcctgtcattaktcctgtaaaggagtacatacaggacaagaggtcctttacagagcccctatcaccagtctcagggaagccattagggtgctgagctggttaggactgaaac

SEQ ID NO: 18063 - DNA, 201 bp, Homo sapiens
tacctcttaaaagacagtcaacctgacatcttgtgatttggatagaagggagagcaggagactctcaggaagaagagctgcagcacagaggaccttggagkcattttatcaccagggctatgtccctaggggagctgcagaaagcagtgctcttctctgggacactttcatggcctccaggacactgggccctgtggtccc

SEQ ID NO: 18064 - DNA, 201 bp, Homo sapiens
aacctgacatcttgtgatttggatagaagggagagcaggagactctcaggaagaagagctgcagcacagaggaccttggaggcattttatcaccagggctrtgtccctaggggagctgcagaaagcagtgctcttctctgggacactttcatggcctccaggacactgggccctgtggtccctgtaggctgtgggggataa

SEQ ID NO: 18065 - DNA, 201 bp, Homo sapiens
cctctgaagtctgagagggaaggccagaccctcctgctattgatcttcatcacaaattgggtggctctagatccaatgtggtgagtggccacagtctgagygctgggaacaaagagggctcaggatcaagttaccctggtcttacaggaaccttggcaaagtgtatacagactgaggatggaaaatggttcacccccatgg

SEQ ID NO: 18066 - DNA, 201 bp, Homo sapiens
cacatcattcaaggagttttgggcccagtttagcttgagggaaggaggaagggatccctaagatgacattttaagactttaagaaatcacacccattagaygctgactcgcacatggagtgtccagggggtacccaaagaacaaaagagaaggcaggaacgtcaattcacagatggaaaatgtcaggtattttactttgaa

SEQ ID NO: 18067 - DNA, 201 bp, Homo sapiens
cactgctacactgatcataaagaattttgccccattcctgtggaccaaagtatgaaaaaatcttgtatactactagcatataaagctcaaataattatatktattcctctgtataattaactttattctctttggtttgaaggaaaaaagaaggggcatggctggagcagaatgggaacgagaacgcagaaaaacaaccaa

SEQ ID NO: 18068 - DNA, 201 bp, Homo sapiens; identical to SEQ ID NO: 3140

SEQ ID NO: 18069 - DNA, 201 bp, Homo sapiens
ttaccttatacccttccactatctgaattgttgaaagaacctagattgcttttctaacccactgaaataagcaaccaaaggcaaaaaagtaataatcccarctgtggaaatgatttcacttttctgccctgttaataagaaaggatcatgctggtgagaaacggaagttactcttagctgcataagttttcaagtttaatc

SEQ ID NO: 18070 - DNA, 201 bp, Homo sapiens
ctccatgccatatttttccttcatatcccagggagaagcatatgcctgtctatacaggctcacacataagcagtgtgttctagatgcccagaggggtggcyttcctgaatcttgtgattcccagtgacgtggacactgttttaccttctagatgagaaacttggatgagtgtgaggtgtgccgggacggaggggagctgtt

SEQ ID NO: 18071 - DNA, 201 bp, Homo sapiens
gtaagcagaatacaggtttattttcccactgccctttgaagtcctcctcctagataagttatttcttgtcctgagcaagccctatcgctttcctgttcccytttcacaacaataagagtctcatttcagtaattgagagtctttctgaccaagtattaaaactccaatgtcctccccagtttaaagcaccttccctccttc

SEQ ID NO: 18072 - DNA, 201 bp, Homo sapiens
tcacacaacagatttaacatgtacaacatcttattttatggagtctccaattgggtaactataattaagctttcaccttctccacttcccacatataaatwtttttaatatacactttcagagttactactttgaatactttgtgtatataaagctaggtcctctttggattaaaccgtatcagatggagatgctgaggag

SEQ ID NO: 18073 - DNA, 201 bp, Homo sapiens
atataccccttcctcctgaacttcactgcagaccaggatttgttctgaaatctccatgccatatttttccttcatatcccagggagaagcatatgcctgtytatacaggctcacacataagcagtgtgttctagatgcccagaggggtggccttcctgaatcttgtgattcccagtgacgtggacactgttttaccttcta

SEQ ID NO: 18074 - DNA, 201 bp, Homo sapiens
ataaattctgaactacaacccccagaatattccacttctttctccaggcatatgttctgtgtcatgactgctgttgcctgaagcatgttcagtctcagttrgagtatgtggctgtgtgaattcagttgcatcacccaagccaggtagatgtgcttgggccttggatgtcttgcagtgtgaaagcactctttccatctgttt

SEQ ID NO: 18075 - DNA, 201 bp, Homo sapiens
aaggggaaggagtaaatgtgagaggataacagcattctcaagtaaggggtatggatgaaagggaaaatcccaaaaatgcactccaaggtgcaggtggagcraagatggtcttaagcatcagccagaaggaacagaccaggccaagctattatgtttaaggtgtggagcctgtcattattcctgtaaaggagtacatacagg

SEQ ID NO: 18076 - DNA, 201 bp, Homo sapiens
caagtaaggggtatggatgaaagggaaaatcccaaaaatgcactccaaggtgcaggtggagcgaagatggtcttaagcatcagccagaaggaacagaccargccaagctattatgtttaaggtgtggagcctgtcattattcctgtaaaggagtacatacaggacaagaggtcctttacagagcccctatcaccagtctca

SEQ ID NO: 18077 - DNA, 201 bp, Homo sapiens; identical to SEQ ID NO: 3147

SEQ ID NO: 18078 - DNA, 201 bp, Homo sapiens; identical to SEQ ID NO: 3148

SEQ ID NO: 18079 - DNA, 201 bp, Homo sapiens; identical to SEQ ID NO: 3150

SEQ ID NO: 18080 - DNA, 201 bp, Homo sapiens
taattcttcataccttaaaggctagggtttaaatctttttatttatatattaaacaggcttttggaaagttacatttaaatggaatttttgaaaagcagcratatatgtaacacagctgctcatttgtaactgtgattttattattctactttctcagggagaaagagaggcaaacctggaacccactttactcagagtga

SEQ ID NO: 18081 - DNA, 201 bp, Homo sapiens; identical to SEQ ID NO: 3152

SEQ ID NO: 18082 - DNA, 201 bp, Homo sapiens
taatatttattttttccaaagccatgtgaacgaagccctggtcacatttactattactttcagcacaagggtacaaatatcttcccccaatgtgatatgtrcagcatacatctcacctatggagcacctaatagggtttcccttaactcacagaactgccatttatttgtgtctctgctaagagaaacccaaacaccttca

SEQ ID NO: 18083 - DNA, 201 bp, Homo sapiens
cggctgcagtgtctgccatgtcaatccttaattactatttggaatgaaggctgtggaagtctcaattctacccattcctcatggttaaccttcttctgatyagtttcttagatcctaatatttattttttccaaagccatgtgaacgaagccctggtcacatttactattactttcagcacaagggtacaaatatcttccc

SEQ ID NO: 18084 - DNA, 201 bp, Homo sapiens
aatcttgtgattcccagtgacgtggacactgttttaccttctagatgagaaacttggatgagtgtgaggtgtgccgggacggaggggagctgttctgttgygacacttgttcaagagtcttccatgaggactgccacatcccacctgtggaaagtgagaagtaagtgacatgcaggcacctctctttcatcctttaaggga

SEQ ID NO: 18085 - DNA, 201 bp, Homo sapiens
taggaataagtaggttggaaaatatttttccatggggcctacatgaccctgaccagcatccctagatggtggtcattggatggtggacatccagcacaagraggaaggaacattttgctttcctgctttggaaaataaaacacatttgaacattagtaaacattgagatgcccactcacagccaattaacatgcacttggg

SEQ ID NO: 18086 - DNA, 201 bp, Homo sapiens
ggggtggccctgggccagtctctttcctcctggtgctgcacaaggactgagggcatcctcggggtttctcatgaatggtccccaccttcagaaggtggccrgagggacttcctgtgttgttcaatgctccccttgtctttctgactccctacaatccttcacccatagcctcttcctccgcgccagggtacttcttcccat

SEQ ID NO: 18087 - DNA, 201 bp, Homo sapiens
tttgccacaaaaagacttgcacaagaacagcagttttattcatactagtctcaaactgaatccactccaatgtccatcaagagaaaaatgagtacgcagastgtggtagattcacacaatggaataccactcaacaacaaaaatgaacaaactaactgttcaacacagcaacatagatgataagcaaaagaagccagacac

SEQ ID NO: 18088 - DNA, 201 bp, Homo sapiens
gcaaaagcattttcattagctgtgtctggagtgaaatctgaatcccctgggcactcagaaggctgtgcctaccaggctgatggggaaagaatgaggcatcwtccctaggaatgaccagggtcacaacagaatcctgaattttcaagataggtctacagaacacttgcaatccccaccacttttgtcctggtcactatccgg

SEQ ID NO: 18089 - DNA, 201 bp, Homo sapiens
ctgaacaagcattcacagcttccaactattgtgcaataaacagcaaaaaaaaaaaaagtccttgaaccaaaattgtccttagctgctctgccctctaagakggggcatagtttacatgggagttgggggaggactccatgtttgccccttccccttgctgagatggctgggggtgggggctggaaaaagttggattcagca

SEQ ID NO: 18090 - DNA, 201 bp, Homo sapiens
gtgcaataaacagcaaaaaaaaaaaaagtccttgaaccaaaattgtccttagctgctctgccctctaagatggggcatagtttacatgggagttgggggargactccatgtttgccccttccccttgctgagatggctgggggtgggggctggaaaaagttggattcagcagaatgtaatttggaaaacatggctctggag

SEQ ID NO: 18091 - DNA, 201 bp, Homo sapiens
gttgttttcctctgtgttttatctgattttcctgggaattcctttgccttaaatcattggctaattaaaatggctggacctggtaaattgtaagcagaatrcaggtttattttcccactgccctttgaagtcctcctcctagataagttatttcttgtcctgagcaagccctatcgctttcctgttcccttttcacaacaa

SEQ ID NO: 18092 - DNA, 201 bp, Homo sapiens
ttcttttcaacactcataagcttagtgcttccaaaggcaaccttggcagaagaggatgaggcagacgagcagaaagagtagtcacaattcagagaaaggaracccaacaagaaaggactggataaataaataatggtgcatgcatttgatgaattctggagccgccatgagaaataaggctatatgtgaatatttaatgcc

SEQ ID NO: 18093 - DNA, 201 bp, Homo sapiens
tgcttgaaaccatgaggtggaagttgcagtgagctgagaccacaccactgcactccagcctgggtgacagagcaagactccgtctcaaaaaaaaaaaaaaagaatgtgccataggctgggcatggtgatggtggcttacacctgtaatcccaacactttgggaggcccaggtaagacaatcatttgagcccaggagtttga

SEQ ID NO: 18094 - DNA, 201 bp, Homo sapiens
tgtttggtgattggctagttggttgatcagttggttgcttgattggttgttcagctgactggccagttggttgcttggctagttgactaactggtggttcrttggagaattggctggctgcttggttggctagttcttagcttggttgactgattgagtggctggttggcattttggttggtaggttgttttgatggctag

SEQ ID NO: 18095 - DNA, 201 bp, Homo sapiens
gccagttggttgcttggctagttgactaactggtggttcgttggagaattggctggctgcttggttggctagttcttagcttggttgactgattgagtggytggttggcattttggttggtaggttgttttgatggctagttagttggttgcctggttagcaggttggttagttggttgcctggtttgttgtttggctgaa

SEQ ID NO: 18096 - DNA, 201 bp, Homo sapiens
ctgcttgaaaccatgaggtggaagttgcagtgagctgagaccacaccactgcactccagcctgggtgacagagcaagactccgtctcaaaaaaaaaaaaaaagaatgtgccataggctgggcatggtgatggtggcttacacctgtaatcccaacactttgggaggcccaggtaagacaatcatttgagcccaggagtttg

SEQ ID NO: 18097 - DNA, 201 bp, Homo sapiens
caaacaccagctctgttgcttaccagctgtgtggccttgaaaagtcacagtcacagaaagacagtttcttgaaggatacttttgctgggaatagaaccctctttttttttttgcttgagacagagtctcgctctgtcacctaggctggagtgcagtggtgtgatcttggctcactgaaacctccgcctcccaggttcaagg

SEQ ID NO: 18098 - DNA, 201 bp, Homo sapiens
gttttcaccatgttggccaggctggtctcaaactcctgacctcaggtgatccaccaacctcagcctcctaaagtgctgggatgacaggcgtgagccaccayacctggctgtttatcctttctttcatccacccatccctcttcctacccacgcagccacctatccatctttctttctctcaatcacccacccatctctcct

SEQ ID NO: 18099 - DNA, 201 bp, Homo sapiens
ttagcaccattcattcatacagtcactcactcagtccatattcatgagcacctactgtgcaccaggagccagagacatacaggccctgaaggaattggggrcacctggaccacagaacacagacaacaagtgatagggcaggtgtagttttccacatgaggaaaccgaggctctgaaaaataaatcaacttgtgcagagcc

SEQ ID NO: 18100 - DNA, 201 bp, Homo sapiens
ctgacaggtggcagttctcatctgatggtgcggacatcggcttcggagttttcctgaagaccaagatgggggagcgacagcgggcaggggagatgacagakgttctacccagccagcgctataacgcccacatggtgcccgaggatgggaacctcacctgctcagaggccggcgtctgtaagtctgccccagctgggacct

SEQ ID NO: 18101 - DNA, 201 bp, Homo sapiens
ttctcaggtaggggcaggccctaacccctcagagacccatcaggctgagcagcaacctgtctcctccccctccccctgacaggtggcagttctcatctgayggtgcggacatcggcttcggagttttcctgaagaccaagatgggggagcgacagcgggcaggggagatgacagatgttctacccagccagcgctataacg

SEQ ID NO: 18102 - DNA, 201 bp, Homo sapiens
aagttctgtgcatcttttcatgcccaggtgatccagaagtacatgcctgggggcctgtgtggctatgaccgtgatggctgccccgtgtggtatgacatcaytgggccacttgatcccaaggggttgctcttctcagtcaccaagcaggacctgctcaagaccaagatgagggactgtgagcgcatcctgcatgagtgtgac

SEQ ID NO: 18103 - DNA, 201 bp, Homo sapiens
ggagcttataaatccttactttctctttcttcctggtacctgagcctctgcctctacccaattccactgggatggggaacttgatagattatgagggcctrgtttgaagggtccaggctcatgccttctacgccttccaaagcctagagcagtgtgggttaccagcacagtccaggccttaagtccacagcctctgcccca

SEQ ID NO: 18104 - DNA, 201 bp, Homo sapiens
gtgctttttataccatggtgtgtgtaggcttgggccacccaggtcagcctggtctggggtctcaagggaggtgtgtaatgccaagttctgtgcatcttttyatgcccaggtgatccagaagtacatgcctgggggcctgtgtggctatgaccgtgatggctgccccgtgtggtatgacatcattgggccacttgatcccaa

SEQ ID NO: 18105 - DNA, 201 bp, Homo sapiens
tgactaactggtggttcgttggagaattggctggctgcttggttggctagttcttagcttggttgactgattgagtggctggttggcattttggttggtargttgttttgatggctagttagttggttgcctggttagcaggttggttagttggttgcctggtttgttgtttggctgaatcttagatgattatttggatgg

SEQ ID NO: 18106 - DNA, 201 bp, Homo sapiens
agacctggctttgccatttaccctctgtgagcaaggccctcccctgcaggacctcagctttctcacctgagacaatagcactgtcttccagggagggacavtgctttttataccatggtgtgtgtaggcttgggccacccaggtcagcctggtctggggtctcaagggaggtgtgtaatgccaagttctgtgcatcttttc

SEQ ID NO: 18107 - DNA, 201 bp, Homo sapiens
tgagttttctgctccttgaagccaggggctgtgattctccacttttgttgtagccctcacaggcctgggtccatggtggatgctccataggtatttgggtrattgttgtgggtagatgaaaggatggatggatgtttggtgattggctagttggttgatcagttggttgcttgattggttgttcagctgactggccagttg

SEQ ID NO: 18108 - DNA, 201 bp, Homo sapiens
acctaagaagtccaagggcctgctgagacctggctttgccatttaccctctgtgagcaaggccctcccctgcaggacctcagctttctcacctgagacaayagcactgtcttccagggagggacagtgctttttataccatggtgtgtgtaggcttgggccacccaggtcagcctggtctggggtctcaagggaggtgtgt

SEQ ID NO: 18109 - DNA, 201 bp, Homo sapiens
ttatccttacttctatctctccagctaccaaactgttccctgtgggctacaacctcatgaagccattcctgagtgaggacactcgcaggaaaattattgtrttgggaagtaagtagtgccagctcaatttcctgacctctatacatgacctttggagtgaggttgtcccattaccccatctagaactccacacattaggtt

SEQ ID NO: 18110 - DNA, 201 bp, Homo sapiens
ctggtgcagccttccctgtttgctgccttttagggatctccagctgttttatttgtgctcatcctgctttactggctgagttttctgctccttgaagccargggctgtgattctccacttttgttgtagccctcacaggcctgggtccatggtggatgctccataggtatttgggtaattgttgtgggtagatgaaaggat

SEQ ID NO: 18111 - DNA, 201 bp, Homo sapiens
ttaaccttcagaatctgtgttctccatcactaaacccgactcttctccacagaaagggacacgggagacatcaggggcagacctaagaagtccaagggccwgctgagacctggctttgccatttaccctctgtgagcaaggccctcccctgcaggacctcagctttctcacctgagacaatagcactgtcttccagggagg

SEQ ID NO: 18112 - DNA, 201 bp, Homo sapiens
tgtcccaggattgttgtgaggcaggttggtttcttggctgtatgcaaatcacttagaatgcctggcatagagtaagttctcaataaatggtaacttctagkgttggccttactgcaagagaaggcagctccagtcccagctctcccagggatcctcccttatttctcctgtccatgatgatctctccctccccagactgct

SEQ ID NO: 18113 - DNA, 201 bp, Homo sapiens
aaagaagtttagcccatcaaggcactgatgaggacagtgccaccactggcatcttagtagagtaatggtcacgtcttcacttgtagggcatgtacccggakctgggcactctgctttgccaactttatctcagggactttccccaacagtcccaagagtgaggggttatccaaaccattttacaaaaaaagtaggtagaat

SEQ ID NO: 18114 - DNA, 201 bp, Homo sapiens
tgggagaggttgggatcagggggcatcaagaggggcctggtctcaactgctccagagtgtctcatggctctcagggtccatccacacaatcttgcttcacrtgttcaggtccagaggagggaagggggtaggggagcaaggtctcacccaggcccccagtgtcctccatagctcccactggccaggagtaagacaaggcat

SEQ ID NO: 18115 - DNA, 201 bp, Homo sapiens
ccctaacccctcagagacccatcaggctgagcagcaacctgtctcctccccctccccctgacaggtggcagttctcatctgatggtgcggacatcggcttyggagttttcctgaagaccaagatgggggagcgacagcgggcaggggagatgacagatgttctacccagccagcgctataacgcccacatggtgcccgagg

SEQ ID NO: 18116 - DNA, 201 bp, Homo sapiens
gggaaagaagtttagcccatcaaggcactgatgaggacagtgccaccactggcatcttagtagagtaatggtcacgtcttcacttgtagggcatgtacccrgatctgggcactctgctttgccaactttatctcagggactttccccaacagtcccaagagtgaggggttatccaaaccattttacaaaaaaagtaggtag

SEQ ID NO: 18117 - DNA, 201 bp, Homo sapiens
cctgtggaacccgcaggcctgcagtctcctttcctacagtcataatgaatgtttcctgggggcttgcaaggtccaggcctaggttaagatgttagcagcakgagcttctttaatcatcacaatgatggatgctattgtccccattttgtggatgaggacactgaagcccagcaaaaattaggtaacttgcccacagtccca

SEQ ID NO: 18118 - DNA, 201 bp, Homo sapiens
accatgaatgaggggcagcaagcctgagaggcctgtggaacccgcaggcctgcagtctcctttcctacagtcataatgaatgtttcctgggggcttgcaargtccaggcctaggttaagatgttagcagcatgagcttctttaatcatcacaatgatggatgctattgtccccattttgtggatgaggacactgaagccca

SEQ ID NO: 18119 - DNA, 201 bp, Homo sapiens
agttccgagaaaacgtccaggatgtgcttcctgccctgcccaaccctgatgattatttccttctacgctggctccgaggtgagggcagaggtgggagaggytgggatcagggggcatcaagaggggcctggtctcaactgctccagagtgtctcatggctctcagggtccatccacacaatcttgcttcacatgttcaggt

SEQ ID NO: 18120 - DNA, 201 bp, Homo sapiens
tcaaacaccagctctgttgcttaccagctgtgtggccttgaaaagtcacagtcacagaaagacagtttcttgaaggatacttttgctgggaatagaacccyctttttttttttgcttgagacagagtctcgctctgtcacctaggctggagtgcagtggtgtgatcttggctcactgaaacctccgcctcccaggttcaag

SEQ ID NO: 18121 - DNA, 201 bp, Homo sapiens
cttaattttgtaattttagtagagatggggtttctccatgttggtcaggctgctctcgaactcctgacctcaagtgatccacccaccttggcctcccaaartgctgggattataggtgtgagccactgtgcccggccaacacctgctttttggggtggttgtgaggaggcaaacagtgtccagcaggcctgccccagaacc

SEQ ID NO: 18122 - DNA, 201 bp, Homo sapiens
agctgcctcctcctggcaggggacctctggcacacgctccatgcccgcctgcccctccagatctgtccccaagccaagcaggggacctcacttaatcccarttatgtaatctgcaatttaaacagttggcccatgaggaggcgcttggagccacgcccaggagtgggggcaaaaggacccagctgggtcagggctgacaaa

SEQ ID NO: 18123 - DNA, 201 bp, Homo sapiens
tgggaggcccaggtaagacaatcatttgagcccaggagtttgagactagcctgggcaacatagtgaaaccctatctctacaaaaaaaaaccaaacaaaacmaaataaaaattagccaggcatggtggtacatgcttgtagtcccagctacgcaggaggctgaggtgggaggatcacttgagcccaggaagtcgaggctgca

SEQ ID NO: 18124 - DNA, 201 bp, Homo sapiens
tcgcccttacagagctctcagcagctgtaaaggcaaacaagaaataggcgaattttaacccagagggatgagctgggaggggaagctcccagcagacgcaytggcccagtttggagggtcatagaaggcttgaggaggtgggagagtggggctaggatgaagaggatacttccaggaggtggtgaaagtgtctcaggcaga

SEQ ID NO: 18125 - DNA, 201 bp, Homo sapiens
atggcatgaagggaaaccctccagagccatctgaaacctcccaacaggagattgcacaggagatggaggtaggagaagatgtgatgtgctctctgaagggwtctctcttggttccacagttctttggcctccttgaagagaattacccagagaccctgaagttcatgctcatcgtgaaaggtatgtgacaaatgacttcac

SEQ ID NO: 18126 - DNA, 201 bp, Homo sapiens
aattcttttcttcccattatccttacttctatctctccagctaccaaactgttccctgtgggctacaacctcatgaagccattcctgagtgaggacactcrcaggaaaattattgtgttgggaagtaagtagtgccagctcaatttcctgacctctatacatgacctttggagtgaggttgtcccattaccccatctagaa

SEQ ID NO: 18127 - DNA, 201 bp, Homo sapiens
gtttcctgacctacaaaatggggatagcaatgtagggatacttcagcaagttgttatgtaaagtgtatatacactgcttggcaaatagtgaacatttaatmaacagtagtcattattattatactaccattattataatatttactaaaaacaattattatgtaattattattagagtatggttataatagtatgaggtga

SEQ ID NO: 18128 - DNA, 201 bp, Homo sapiens
gggctccctcattgtgactcaaactccagaaggccttaatacctttcctagaagatcccacagaatgggtttcagggacaacactgtactgagaccacacrttccagcttccaccaaaccctctccatgcttgtttcctgacctacaaaatggggatagcaatgtagggatacttcagcaagttgttatgtaaagtgtata

SEQ ID NO: 18129 - DNA, 201 bp, Homo sapiens
tggcacacacaaaaaagtgcttgataaatatcagtttatatttatcagtttatatttatattatggaaaaatggaggatgaataaattaatgacaatatgwatgaatggatggatggttcaattaattgatgagtaagttgatatatacgggggtgggtgggtggatggttggatagatggatggatggatggatggatgg

SEQ ID NO: 18130 - DNA, 201 bp, Homo sapiens
gggaacacaagcctgtcctcctccatggccaggggtggaaaaaagagtgtgtaaagccaagcccaatgcccctctttccatctgtcccccagatgtcctaygcttcgacaacacctatagctttgtccacgccaagaaggtcagcttcacagtggaggtcctgctccctgacgagggcatgcagaaatatgataaggagct

SEQ ID NO: 18131 - DNA, 201 bp, Homo sapiens
tttgttttgcttcagtgttttgaatatgtcatttcacctgtctgagcctcagctccttcacctataaaacagggatatgaataaataatggttgcaaaagygaaatgaaataatgcaagtatgcaatttagcacacagggcctaatatatatttctcaacaatggtagctattgctattccctctgagcctttctttgccc

SEQ ID NO: 18132 - DNA, 201 bp, Homo sapiens
attcaaccattaacccatcctttcatcaatgtgggccattttgcatgtgggaggaaaggagaggttgtgaaaacagtctttgagtctggaggccaaggctsaatgtgagagagccactttaaccagcatctctcttgccagttccgagaaaacgtccaggatgtgcttcctgccctgcccaaccctgatgattatttcctt

SEQ ID NO: 18133 - DNA, 201 bp, Homo sapiens
agtcacagtcacagaaagacagtttcttgaaggatacttttgctgggaatagaaccctctttttttttttgcttgagacagagtctcgctctgtcacctargctggagtgcagtggtgtgatcttggctcactgaaacctccgcctcccaggttcaagggattttcctgcctcggcctcctgagtagctgggattacaggc

SEQ ID NO: 18134 - DNA, 201 bp, Homo sapiens
agtgctgtggagcgatctcagctcactgcagcctctgtctcccaggttcaagcaattctcctgcctcagcctcctgagtagctgggattacaggcatgtgmcaccacacctggctaatttttgtatttttagtagagatgagttttcaccatgttggccaggctggtctcaaactcctgacctcaggtgatccaccaacct

SEQ ID NO: 18135 - DNA, 201 bp, Homo sapiens
cagctgtgtggccttgaaaagtcacagtcacagaaagacagtttcttgaaggatacttttgctgggaatagaaccctctttttttttttgcttgagacagwgtctcgctctgtcacctaggctggagtgcagtggtgtgatcttggctcactgaaacctccgcctcccaggttcaagggattttcctgcctcggcctcctg

SEQ ID NO: 18136 - DNA, 201 bp, Homo sapiens
gagtgctgtggagcgatctcagctcactgcagcctctgtctcccaggttcaagcaattctcctgcctcagcctcctgagtagctgggattacaggcatgtrccaccacacctggctaatttttgtatttttagtagagatgagttttcaccatgttggccaggctggtctcaaactcctgacctcaggtgatccaccaacc

SEQ ID NO: 18137 - DNA, 201 bp, Homo sapiens
gaggaggcaaacagtgtccagcaggcctgccccagaaccccacttcatccaagggggctgggaggtctctgatgaacccaaccatgtgccttcacagcccmgtcatgtgcgtctccaggtgtgagacaatgggatgtaatgaccattgttctcgatgccagtaaagccatgcctgggcacatgccaagaggaggttggtgt

SEQ ID NO: 18138 - DNA, 201 bp, Homo sapiens
ctgttgcttaccagctgtgtggccttgaaaagtcacagtcacagaaagacagtttcttgaaggatacttttgctgggaatagaaccctctttttttttttkcttgagacagagtctcgctctgtcacctaggctggagtgcagtggtgtgatcttggctcactgaaacctccgcctcccaggttcaagggattttcctgcc

SEQ ID NO: 18139 - DNA, 201 bp, Homo sapiens
acaaccacagtcagagggctctggggtcaaacaccagctctgttgcttaccagctgtgtggccttgaaaagtcacagtcacagaaagacagtttcttgaargatacttttgctgggaatagaaccctctttttttttttgcttgagacagagtctcgctctgtcacctaggctggagtgcagtggtgtgatcttggctcac

SEQ ID NO: 18140 - DNA, 201 bp, Homo sapiens
cagctgtaaaggcaaacaagaaataggcgaattttaacccagagggatgagctgggaggggaagctcccagcagacgcactggcccagtttggagggtcayagaaggcttgaggaggtgggagagtggggctaggatgaagaggatacttccaggaggtggtgaaagtgtctcaggcagaagaaacatgaacaatggccag

SEQ ID NO: 18141 - DNA, 201 bp, Homo sapiens
tgggatggactaagcccttcaagtggggtgagttctcatggacttggtcagagagacctggcttccaagctccacactattgccaatgggctttgctaccrtgaagactttatttaacctccctggctctcagtttcttcatctgtgaactggggacagtaggctcagccctaaagtgccttattcctatccattgtcctg

SEQ ID NO: 18142 - DNA, 201 bp, Homo sapiens
gctcactctcagtgacacagaggactccttgcattttttgctgctcttccgagggctgctggaacccaggagtgggggtaagtgggatgggggcaaaacaygtgagaaggttagggagagcacctgtctcagaaaggcccacatgtgcggccttgcaggactaacccaggttcccttgaggctccagattctacaccaggg

SEQ ID NO: 18143 - DNA, 201 bp, Homo sapiens
ctcactctcagtgacacagaggactccttgcattttttgctgctcttccgagggctgctggaacccaggagtgggggtaagtgggatgggggcaaaacacrtgagaaggttagggagagcacctgtctcagaaaggcccacatgtgcggccttgcaggactaacccaggttcccttgaggctccagattctacaccagggg

SEQ ID NO: 18144 - DNA, 201 bp, Homo sapiens
cgagagcatgctctgcattgcctcccgtggtcctcaccacagcccagtgggaggaaggcactgacattatgatgcccattttacagaagggggaactgagrctcagtaggataatgtgatttgttcaaggtcacacagctagtaagtggtgcagccaggattggaacccaagcatctggctccagcgttctttcttaagct

SEQ ID NO: 18145 - DNA, 201 bp, Homo sapiens
gaggtggaggttgcagtgagccgagatggcgccattgcactccagcctggacagaaagagcaaaaatccgtctcaaaaaaaaaaaaaaaaaaaaaaaaaaagagctggcatgggcttgggagtcagatagacctgggcatgactctgactggctttttattattcattctcctttctaagtctttttttggtggggtgtct

SEQ ID NO: 18146 - DNA, 201 bp, Homo sapiens
ggaggtggaggttgcagtgagccgagatggcgccattgcactccagcctggacagaaagagcaaaaatccgtctcaaaaaaaaaaaaaaaaaaaaaaaaaaagagctggcatgggcttgggagtcagatagacctgggcatgactctgactggctttttattattcattctcctttctaagtctttttttggtggggtgtc

SEQ ID NO: 18147 - DNA, 201 bp, Homo sapiens
gggaggtggaggttgcagtgagccgagatggcgccattgcactccagcctggacagaaagagcaaaaatccgtctcaaaaaaaaaaaaaaaaaaaaaaaaaaagagctggcatgggcttgggagtcagatagacctgggcatgactctgactggctttttattattcattctcctttctaagtctttttttggtggggtgt

SEQ ID NO: 18148 - DNA, 201 bp, Homo sapiens
ccctggcgggtggggagcgccgggtcgcgcgggcgttggagtggactcggagctgctgagaaggagcccagtcggcagatgttggggatatttttctggtrgaggaaggggaatcagcccctccaattcttaggtgctgttactgatcgcccactctgtgtgaggctctgtgccaactccgtttcgttccctgctcatcta

SEQ ID NO: 18149 - DNA, 201 bp, Homo sapiens
tggggctgatgccctgatcccagtccagacgggtgctgccggctcagccagcctcacgctgctaggaaatggctccctgatctatcaggtaagagccaggrgctgcagaaggtgggggaggggtggcgtgggcagcaggccccaggcctttactgcctctccactttgccctcctccatccctgcccatcaggtgcaagtg

SEQ ID NO: 18150 - DNA, 201 bp, Homo sapiens
ccgcagagcgcagcagttcggagcggcagccgagcggcctgtccttcgagtatccgcgggacccggagcatcgcagttatagcgaccgcggggagccaggmgctgaggagcgggcccgtggtgacggccacacgggtagggggctggcgaacagcggggttgtggttgaggctgggccaccaaagcggcgtttgacagtgc

SEQ ID NO: 18151 - DNA, 201 bp, Homo sapiens
ttggggcctctcccctgaatccttcctggggccatggaggcggcttaggctcttgcacttctgggcagagtagggtggggcaaaggcgggccaagggtgargaatctatcctgaaagtagcaagaagagtgaacatttaaccaagtttctaggaagagactgcctggcagggtgaacagatgctggggagggcttgagatg

SEQ ID NO: 18152 - DNA, 201 bp, Homo sapiens
tattcctatccattgtcctgtctatgtgcaggcccagggtgtggtgaaggacctggagccggaactgctgcggcacctggcaaaaggcatggcctccctgmtgatcaccaccaagggtagccccagaggggagctccgagggcaggtaggtggcgagtgtgggcagtgggggcagtggggagggtgcagagttggaggggc

SEQ ID NO: 18153 - DNA, 201 bp, Homo sapiens
tgtgagaaggtgcagtgtccccggctggcctgtgcccagcctgtgcgtgtcaaccccaccgactgctgcaaacagtgtccaggtgagagaggtggctgagmactgaggcctcacctttgggttgaggcaggctttgtcctgggtgaggggaagggtgctcagttaattgagcattatactgagcactgctctgtgcctagc

SEQ ID NO: 18154 - DNA, 201 bp, Homo sapiens
cgcccagctgcccacacccggtgcaggctcccgaccagtgctgccctgtttgccctggtgagttccccgcaggggagtggagggaggagttggcccagtgyggacaggtcctttggggagggaatgagggtggtcactctctgctttcaccatttctttggctccacagagaaacaagatgtcagagacttgccagggctg

SEQ ID NO: 18155 - DNA, 201 bp, Homo sapiens
acggtgatctgtgacccggtggtgtgcccaccgcccagctgcccacacccggtgcaggctcccgaccagtgctgccctgtttgccctggtgagttccccgyaggggagtggagggaggagttggcccagtgcggacaggtcctttggggagggaatgagggtggtcactctctgctttcaccatttctttggctccacaga

SEQ ID NO: 18156 - DNA, 201 bp, Homo sapiens
ctaggtcccgggccacttggatggggcgtcggactggcctttcccatggccagctgaagcccgtgttcttacccccccgcccgcagagcgcagcagttcgragcggcagccgagcggcctgtccttcgagtatccgcgggacccggagcatcgcagttatagcgaccgcggggagccaggcgctgaggagcgggcccgtgg

SEQ ID NO: 18157 - DNA, 201 bp, Homo sapiens
cctccctggctctcagtttcttcatctgtgaactggggacagtaggctcagccctaaagtgccttattcctatccattgtcctgtctatgtgcaggcccarggtgtggtgaaggacctggagccggaactgctgcggcacctggcaaaaggcatggcctccctgatgatcaccaccaagggtagccccagaggggagctcc

SEQ ID NO: 18158 - DNA, 201 bp, Homo sapiens
catccttgcctgggggggtctcatcagttggcatcttgcactcacttgggtttcccgccttttccgggagcagcctcagtggggtcgccgtaccaggggcyctggcagggtcagctgcaagaacatcaaaccagagtgcccaaccccggcctgtgggcagccgcgccagctgccgggacactgctgccagacctgccccca

SEQ ID NO: 18159 - DNA, 201 bp, Homo sapiens
gctgggggagctgcagatggccctggagtgggcaggcaggccagggctgcgcatcagtggacacattgctgccaggaagagctgcgacggtgaggcggggkgggggcctggtgcgccgggcatgcacaactgagagacacagacaagtgccagggtgggtgtgggagagatcctgtggactgggggtgtaagcggccatgg

SEQ ID NO: 18160 - DNA, 201 bp, Homo sapiens
cccagctgggggaccccatgcaggctgatgggccccggggctgccgttttgctgggcagtggttcccagagagtcagagctggcacccctcagtgcccccktttggagagatgagctgtatcacctgcagatgtggggtaagtggggagcagaggcttgtgtgaggtgggtactgggagcctggtctggagtagggagacc

SEQ ID NO: 18161 - DNA, 201 bp, Homo sapiens
tgcaagaacatcaaaccagagtgcccaaccccggcctgtgggcagccgcgccagctgccgggacactgctgccagacctgcccccagggtaagtcttgctscgccctgcggggagggaggcagggccacgatactaggtcccgggccacttggatggggcgtcggactggcctttcccatggccagctgaagcccgtgttc

SEQ ID NO: 18162 - DNA, 201 bp, Homo sapiens
ctgggaccactagaggtcaggattaaaaggcggtatgggagaaattaacctctattctttccctatctacccccacacataaagccactggagcttttctytggactccaagtcctgaaatactccattatctgaggccaagagatgggctaacagttctgggacttccttcctgagaccagctgcccaggaacgggcacc

SEQ ID NO: 18163 - DNA, 201 bp, Homo sapiens
cattttccagacagggaccttgaggcccagagagatgaagtagcttgtctagggtcacgcagcttgtaagtggcagagctggctgactctgcgggacatcyttgcctgggggggtctcatcagttggcatcttgcactcacttgggtttcccgccttttccgggagcagcctcagtggggtcgccgtaccaggggccctgg

SEQ ID NO: 18164 - DNA, 201 bp, Homo sapiens
ccctccaattcttaggtgctgttactgatcgcccactctgtgtgaggctctgtgccaactccgtttcgttccctgctcatctaactctcatggcagccttkctagatagagagtattattatccccattttccagacagggaccttgaggcccagagagatgaagtagcttgtctagggtcacgcagcttgtaagtggcag

SEQ ID NO: 18165 - DNA, 201 bp, Homo sapiens
cagccgcgccagctgccgggacactgctgccagacctgcccccagggtaagtcttgctccgccctgcggggagggaggcagggccacgatactaggtcccrggccacttggatggggcgtcggactggcctttcccatggccagctgaagcccgtgttcttacccccccgcccgcagagcgcagcagttcggagcggcagc

SEQ ID NO: 18166 - DNA, 201 bp, Homo sapiens
ccccggcctgtgggcagccgcgccagctgccgggacactgctgccagacctgcccccagggtaagtcttgctccgccctgcggggagggaggcagggccaygatactaggtcccgggccacttggatggggcgtcggactggcctttcccatggccagctgaagcccgtgttcttacccccccgcccgcagagcgcagcag

SEQ ID NO: 18167 - DNA, 201 bp, Homo sapiens
cggggtgatgcgctgcgtgctgtgcgcctgcgaggcggtgagtgcaccccgcggccggcccgggccctggcgggtggggagcgccgggtcgcgcgggcgtyggagtggactcggagctgctgagaaggagcccagtcggcagatgttggggatatttttctggtggaggaaggggaatcagcccctccaattcttaggtgc

SEQ ID NO: 18168 - DNA, 201 bp, Homo sapiens
gcagccgcgccagctgccgggacactgctgccagacctgcccccagggtaagtcttgctccgccctgcggggagggaggcagggccacgatactaggtccygggccacttggatggggcgtcggactggcctttcccatggccagctgaagcccgtgttcttacccccccgcccgcagagcgcagcagttcggagcggcag

SEQ ID NO: 18169 - DNA, 201 bp, Homo sapiens
gtcccgttcgcgtcatgccgagcctcccggccccgccggccccgctgctgctcctcgggctgctgctgctcggctcccggccggcccgcggcgccggcccmgagccccccgtgctgcccatccgttctgagaaggagccgctgcccgttcggggagcggcaggtaggtgggcgcccgggggaggcgcgggcggggagtcgg

SEQ ID NO: 18170 - DNA, 201 bp, Homo sapiens
tgagaaggcctatcctcccctgcccccaggccgtgggtatctgccctgggctgggtgcccgaggggctcatatgctgctgcagaatgagctcttcctgaaygtgggcaccaaggacttcccagacggagagcttcgggggcacgtggctgccctgccctactgtgggcatagcgcccgccatgacagtgagtgtccttagg

SEQ ID NO: 18171 - DNA, 201 bp, Homo sapiens
atgcatccatccatgcatccatccatccctccatccatccacccatccacccattgatgcatccatccatccatccatccatccatccatccatccatccrtccgtcccttcatccatccattcatctgcccacccacccatccaaatttatcacctactaagtgccagaaactgcaacgtgctgggtattcaaagagaat

SEQ ID NO: 18172 - DNA, 201 bp, Homo sapiens
tgcatgtggcacttgtgacactcactcacccttcaggggaggtctgggggcctctcatccggcaccgggccctggctgcaggtagggagcaaagagccccrggcgtgaagttctgagtcttctctatcacccaggaaagggggggagggtttctgacgggctctcatcatcgtcccttccccagagaccttcagtgccatc

SEQ ID NO: 18173 - DNA, 201 bp, Homo sapiens
catggccagctgaagcccgtgttcttacccccccgcccgcagagcgcagcagttcggagcggcagccgagcggcctgtccttcgagtatccgcgggacccsgagcatcgcagttatagcgaccgcggggagccaggcgctgaggagcgggcccgtggtgacggccacacgggtagggggctggcgaacagcggggttgtgg

SEQ ID NO: 18174 - DNA, 201 bp, Homo sapiens
tccccaggaaccaggctttgctgaggtgctgcccaacctgacagtccaggagatggactggctggtgctgggggagctgcagatggccctggagtgggcargcaggccagggctgcgcatcagtggacacattgctgccaggaagagctgcgacggtgaggcggggggggggcctggtgcgccgggcatgcacaactgaga

SEQ ID NO: 18175 - DNA, 201 bp, Homo sapiens
gagccaagcatggaggaccttgtgcatcaagctaaggagagcagctcttcataagccggcgctcggcgagttctcccaggagaaggccatgttcagttcgrgcgccaagatcgtgaaacccaacggcgagaagccggaggagttcgagtccggcatctcccaggctcttctggagctggagatgaactcagaactcaaggc

SEQ ID NO: 18176 - DNA, 201 bp, Homo sapiens
tcctacccacagttattgtgtaaaaggaggcattaagaaaggtcttgtatctccatacaaaataagacaatggggtccgcagaaaaagaagggaggggtgrttttgtttgggggaaaaagagcattttaaaagaagttgtgtgtgtgtgtgtctatatgtgtgtgtgtatgtgtgtgtgtgtgtgtggtgaaaagtgacac

SEQ ID NO: 18177 - DNA, 201 bp, Homo sapiens; identical to SEQ ID NO: 3264

SEQ ID NO: 18178 - DNA, 201 bp, Homo sapiens
caccgtgttagccaagatggtctcgatctcctgacctcgtgatccgcccgcctcggcctcccaaagtgctaggattacaggcgtgagccaccgcgcccggytcattcatcattattcattacaaaaatttgtgtgccaagtctgccacggtactgggtgttgtctgcatatcacaggaatcactgtccggggcaggtgttt

SEQ ID NO: 18179 - DNA, 201 bp, Homo sapiens; identical to SEQ ID NO: 3266

SEQ ID NO: 18180 - DNA, 201 bp, Homo sapiens
atttttatttttagtagagatggggtttcaccatgttggccaggctgatctcaaattcctgacctcaggtgatccacccgccttggcctcccaaagtgctrggattacaggtgtgagccaccacgcccggccaactctttatatattgaatatatttgatcctcatcacagattttgtgaagataacatcatctccatttc

SEQ ID NO: 18181 - DNA, 201 bp, Homo sapiens; identical to SEQ ID NO: 3265

SEQ ID NO: 18182 - DNA, 201 bp, Homo sapiens; identical to SEQ ID NO: 3267

SEQ ID NO: 18183 - DNA, 201 bp, Homo sapiens
aaagtaaacaaatgaaagtacaacaggtattatgatgaaaatttgctcaaacatccccaaatggttaaggtggtttcatgcctctgtacctttgtttatgytgctgctccccttacctggaacatcccctcctctccattctttttcaaaggaagtttgctaacagataaaactagagagagactggcagggactagggta

SEQ ID NO: 18184 - DNA, 201 bp, Homo sapiens
ctgaagtagctgggactgcaggcatgcaccaccacacctggctaattttaaaatttttagtagagacggggtttcaccatgttggccaggctggacttgawgtcctgacctcaagtgatctgcccacctgggcctcacaaagtgctggtgaacttttgcttcttgatggacttgcccatagtgaaacttctcagtctgatg

SEQ ID NO: 18185 - DNA, 201 bp, Homo sapiens
tgattgatgcatgggttaagtgaaagaggaatgagaaacagctcaggccccaagctacagctatcagccagcatgcctctttttctttcttgctgccttartgtgggtctcattgtactttggaatcctggggctgtgttctgtgataactggagggtgcattatctttctgcactggaggaagaacttgaggcgggaaga

SEQ ID NO: 18186 - DNA, 201 bp, Homo sapiens
aggatatagaaataaataagtcagactccctacctcaaggagctcactatccagtgggagagacaggcataaaagtaaacaaatgaaagtacaacaggtaytatgatgaaaatttgctcaaacatccccaaatggttaaggtggtttcatgcctctgtacctttgtttatgttgctgctccccttacctggaacatcccct

SEQ ID NO: 18187 - DNA, 201 bp, Homo sapiens; identical to SEQ ID NO: 3268

SEQ ID NO: 18188 - DNA, 201 bp, Homo sapiens
gcttaagctccctggaaatctagctttgactgaataagggaatgatgaggcaagtcaataagggagggaaggaacggtgagagtagttaagtggatggagygattgatgcatgggttaagtgaaagaggaatgagaaacagctcaggccccaagctacagctatcagccagcatgcctctttttctttcttgctgccttag

SEQ ID NO: 18189 - DNA, 201 bp, Homo sapiens
attcaataggtgaaccagtctctgatggaagtagtagtgacattccacccaaaaaatgccactggatgaagtcccctccttccattaacccaggaccactkcacaagcactgcccctagaatgcccaattctcagaacccagtgacctctcctttagagaacaaagggcctgggcattctggagactctgattggctgggc

SEQ ID NO: 18190 - DNA, 201 bp, Homo sapiens
tgagataatggctgggggaatttagccctgccattcaaatggagatggtactggtggtgggagccagctacggctttaagacagacttaagtgggtgggtkgggaaggcaatctagctcactcagcagggaaaatggagctccccaatggataactttttatgctcataaaccctgaaatagtactaaaaatgagaaaaat

SEQ ID NO: 18191 - DNA, 201 bp, Homo sapiens
atttgaaatatgcaaagctcaaatcaagtcatggaaaccctgaattctccctaaacagaaccaaaattgcttatacattaccaaaatagcttcactaaaamaaagtagatttaaatttcttaatatgagaaaacaacaaggtaggttaggttcgtataacaaacaatacacgctctataaagtctcaggaatacccaaatg

SEQ ID NO: 18192 - DNA, 201 bp, Homo sapiens
atggatgggacagtgcctggctgcctggaggagagctaagcagttaggagatagtctactctagaaaactaagaattattttaaggcaaagaccatgctckgatcaaccagagaagatactatcaatagcccaggactatcacagctgaatggaatgggatgggacattggtgtctctgtcaactgatgaactttcacttt

SEQ ID NO: 18193 - DNA, 201 bp, Homo sapiens; identical to SEQ ID NO: 3269

SEQ ID NO: 18194 - DNA, 201 bp, Homo sapiens
tcagacacattgagagaaaaaagaaatttttttatttagctaaattaaaatggctgtgttacttatttgaaatatgcaaagctcaaatcaagtcatggaarccctgaattctccctaaacagaaccaaaattgcttatacattaccaaaatagcttcactaaaacaaagtagatttaaatttcttaatatgagaaaacaac

SEQ ID NO: 18195 - DNA, 201 bp, Homo sapiens
ttcactaaaacaaagtagatttaaatttcttaatatgagaaaacaacaaggtaggttaggttcgtataacaaacaatacacgctctataaagtctcaggawtacccaaatgtgttctggtttggatatgaaagagggaccacttctagctggtgttggtaagcaagccaatgaggtgtgcagcaaacaaaacctgtcacta

SEQ ID NO: 18196 - DNA, 201 bp, Homo sapiens
ctgaaaggaatgttctcttccattccctcctgaatctggcccaggaagaccatagcttcaatgccaagccttttccttcagaactgtagcctcctctcacygaaggtgggagctgcaggaatcaggtgcagagtaggaaatggaactaacctcaggaaggtggtattgacagaggtcaggacccacctggatgtcatgcta

SEQ ID NO: 18197 - DNA, 201 bp, Homo sapiens
tgtggtaggggccaagtttgggtgtgtgaggccagggaggtgcgttgtgttctcgcggaagagagagacgcagcgagggagcccgggcacacggacccagytcaccaaccgcagccaaaccaccaattctgtcccgtggcccttggtgaccggtgacagggagggaaggaaacgtggccagcttccgccagaccacaggcg

SEQ ID NO: 18198 - DNA, 201 bp, Homo sapiens
ggccaagtttgggtgtgtgaggccagggaggtgcgttgtgttctcgcggaagagagagacgcagcgagggagcccgggcacacggacccagctcaccaacmgcagccaaaccaccaattctgtcccgtggcccttggtgaccggtgacagggagggaaggaaacgtggccagcttccgccagaccacaggcgaacacaggt

SEQ ID NO: 18199 - DNA, 201 bp, Homo sapiens
ttttcctccagaacaccacctgtggttgggacagtgccgtgcagccccagcatgtctgtgacgcacacctcctgcctgcggggtggtccccctcccgccacccggttcttccgggttttcgagccctgccctcagcttcccctccttcctcctctccccgattttccagccctgccctcggcttcccctcctccctcctct

SEQ ID NO: 18200 - DNA, 201 bp, Homo sapiens
gtggggcggcccactggcttgggcctaggagctgcaggagcaggggccacggtccagcctgacgcccctctcttggggcaggaagttccctctgtctgccrtgagcaggggcacttgggagggcccagcataggacctcaggagctcccggagcagcctcagcagccgcaacccctcgaccttgtccagcatcacgccccg

SEQ ID NO: 18201 - DNA, 201 bp, Homo sapiens
gttttagtggccccgagtttgttctattttctgttgagccagaaagaggagattgtattggattcccttgatccagggttgcaggcctgtttctgagttaytgatttctgtgccaaatgagtctccttgctcgctggtcaaagaccttgtccgttctctttttcttttttttttttttttttttaagcctctggggaattc

SEQ ID NO: 18202 - DNA, 201 bp, Homo sapiens
cggctccttggcttttccttgggctccgccatgtctctccaccgtgtctgtctccactgtctctctgctgtgcctccatcatgcccgcagcgcccgcaagygccctttgaataattgatttggtgcagcttgaagccgcctgggacgctggagcccctgcctgctactgagggatgacagacctcactggcttcctgcaga

SEQ ID NO: 18203 - DNA, 201 bp, Homo sapiens
agaacccaacaggcccctcttctgctcacagcttcaccttatgttatgcaaaatccccacaccactagagcatgctggcactgggtcatgggcgcctgcayttcccgcaagcttgtgactcggggtgcgatacctcagcccgtttccaagcagccccatgagatcagggcttattgtgtttgctccatgtatcatgagggt

SEQ ID NO: 18204 - DNA, 201 bp, Homo sapiens
cagagacccggccgccccaggagcacagagacccggcaacccaggagcatgcctccttggccccagttccgaacagggcttgtgcggtgaggggcgagggctgtcctgtgctccctacacccgcagaagccgtctggccaagtgcccgcctgcccagaggtacatccatcctggggcctggagcacgcagccccgggagcc

SEQ ID NO: 18205 - DNA, 201 bp, Homo sapiens
tccctcacgcatcttacttactagtggggacagacagaaactaagtaagcaaataaagaaggtaatttcagatagtgataaatgccataaaagataaaatwgggtaatgcattagagtgttgatttgaggacagggggaagttacactagatacacccgttagggaagacttctccagaagagcagtcagcttggattgaa

SEQ ID NO: 18206 - DNA, 201 bp, Homo sapiens
agtgataaatgccataaaagataaaatagggtaatgcattagagtgttgatttgaggacagggggaagttacactagatacacccgttagggaagacttcyccagaagagcagtcagcttggattgaaggatgaaaagtaaaagctccattcagagctcttggggaagagcctcttaggcaaaaaacagctggtgcaacag

SEQ ID NO: 18207 - DNA, 201 bp, Homo sapiens
ctagtgctgtcagtggagcattgaagttccccactattattgtgttgctatctatctgttttcttaggtctagtggtaactgttttatgaatgtgggagckccagagttaggtgcacatatatttaggattataatgtcttcttgtgaccttttttgccccccctttttttcttactattattgctttagtctgttttatc

SEQ ID NO: 18208 - DNA, 201 bp, Homo sapiens
tcttgctgataagcaccatgatcagaggtctcttcactttggcttaaatcataaacatgtttggagcacctaccatgtatggccactctcctaagagtgargtaggatattgaggtactcccagtgtagtgtctggcttctggggactcagtgttaaatgagtgtggagaagatgtgtatatgaagactgtgtcttaaggg

SEQ ID NO: 18209 - DNA, 201 bp, Homo sapiens
taatcaaccttttgattttttttatctggtatttcaaagattacttcttggtttggattcattgctggagagctactgtgaccttttgggggttgttatakaaccctgtttcgtatttccagaatcattttctggtttcttctcttttggatagataattttttctaattattcttgaatttatttttgattctactgtgt

SEQ ID NO: 18210 - DNA, 201 bp, Homo sapiens
tgaatgaaaaaagtaacactcaaaatttacaagataatctagtctagtactttacattttaagaaatacatgaatggacctggaactaatgtgtgtgtgtktttttctttttaagtaagccatataacctatgaggcaagcaagttgttctaattgccttctggttgattacatactatttgttgagtactagctactggg

SEQ ID NO: 18211 - DNA, 201 bp, Homo sapiens
tgcatctgtgtttgcttttatcagataatcttctacctactttgagtttaccttctatttctaattccttgcttaacttctgggttccttgcacagcagcrtctgatatcctgcatgttagttctttgttttccctacccaactgaaaattactaatgcaaaattatattagcaaaatgggcataaccagaatcaccactg

SEQ ID NO: 18212 - DNA, 201 bp, Homo sapiens
agtttaactctttgaaatataacggaggaagggtcagaaataaagcaatctttctttcttctggacttatttattcactcttctttaaacagttgttaaawctctcttatgcatttgacattgggctttgcactagtgatagaaaaatgaataagactgtgacatcttttggtactacatcatataaattgtctagattgt

SEQ ID NO: 18213 - DNA, 201 bp, Homo sapiens
catgacctgcatagggctggagaagagtgcagttagcccttgagggttgggggtgaatgtgttaagggtattaagggtggggagatactgctaagttggaraaaaactttcagcgaatttcactgatttcaaatcaagctgaatttgaagttcttgtctacatgagtgaacaatttttaaaacatttgaaggcatgcattt

SEQ ID NO: 18214 - DNA, 201 bp, Homo sapiens
accttttgggggttgttatagaaccctgtttcgtatttccagaatcattttctggtttcttctcttttggatagataattttttctaattattcttgaatktatttttgattctactgtgttttcttttttttccctcttgatgatgcgactttagtatttacagtttattctagcctaatgaagctcttggtgctttcag

SEQ ID NO: 18215 - DNA, 201 bp, Homo sapiens
agaaagggctttgctttttaccagtaatttagaattttatgactaagacaaagcagaaaattgggaagaacagtgaaaagggcaagaagttaatggagtgyggtcagagctgagaggacaaaatctaaatgaaagggggaaaagcaataaggattgaggaaggttgtttaggtcattaagcttacaagatcttctatttcc

SEQ ID NO: 18216 - DNA, 201 bp, Homo sapiens
tggatatttttgtgtgggccattattctgcctaccacagcttctaaatttggagccatttaatgaaaagacaaggtaagccatatgtgtgtgtgtgtgtgratatatatatatatatatatacattgtttgttgggcctatacctatatttcatccaacacagtatagggtctcaaaataatttaagaacaatagaaactt

SEQ ID NO: 18217 - DNA, 201 bp, Homo sapiens
aaaatattatcaaaagtaaataggacaaggatttttttcttaaaaaattgggtctactggtttttaaaaattggattttatttaaaaaaattcactgacayaattttctaagaatatatcaattaagcaaattaaataaaatacagtaatggttgaaatggcctgaaggatctccctgacacaaggggatccttttataaa

SEQ ID NO: 18218 - DNA, 201 bp, Homo sapiens
gaaaagggcaagaagttaatggagtgtggtcagagctgagaggacaaaatctaaatgaaagggggaaaagcaataaggattgaggaaggttgtttaggtcrttaagcttacaagatcttctatttcccaattagtacattctgaccctgaagacgtttaagtacatgacgaggatgtcactggagtgtgacaaattcttca

SEQ ID NO: 18219 - DNA, 201 bp, Homo sapiens
tttctcacagaattagataaaaacaattctaaaattcatatggaaccagaaaggagcctgaataaacaaagcaatcttaagtaaaaagaatgaagctagargcatcacattatccaacttgtttatactataaggtagtggtacaaaaacagacacatacaccaatgaaacagaatagagatcccagaaataaagctgcac

SEQ ID NO: 18220 - DNA, 201 bp, Homo sapiens
ttggacaatgtgttagataaaataaaaaaaataatttgtgatcaaattttgggtgatcttaaggagctagtttaggaatatggagttactttgataggcaytggaaagccattgaagacttttgaccagggaatgatgtgattagggcttagaattgcagtgctgattctagatatattgtagagctacgacataaaggat

SEQ ID NO: 18221 - DNA, 201 bp, Homo sapiens
attcatatggaaccagaaaggagcctgaataaacaaagcaatcttaagtaaaaagaatgaagctagaggcatcacattatccaacttgtttatactataargtagtggtacaaaaacagacacatacaccaatgaaacagaatagagatcccagaaataaagctgcacaactacaaccatctgatctttgagaaagtcaac

SEQ ID NO: 18222 - DNA, 201 bp, Homo sapiens
ggactatttgaaaaataactggtccagagtttaaagggttttaaccatctacatctagaactctggctctttcaattaacttattaactgtatgactttgkacaactataaactctctgaacctcagttctcttatatcttaattagagatgatacctatctcacaggttgtaatgaagactaaagttggatatatgctag

SEQ ID NO: 18223 - DNA, 201 bp, Homo sapiens
gaagaaacatgaacatattcttccctatttttttgttccaatatggttaaacaaaactcccagataatatagaaaccttgcttattccccttatgaatatyttaccagtattgctaagaagtgaaattgattgatattaatttaacttcctcctcttcccacccagacattagtaaatagtgaaatggttgtaagtgttca

SEQ ID NO: 18224 - DNA, 201 bp, Homo sapiens
cggtgggtcacgcctgtaatcccagcactttgggaggcccaggcggacggatcacaaggtcaggagatcgagaccatcctggctaaaacggtgaaactccrtctctactaaaaatacaaaaaattagctgggcgtggtggcaggcgcatggagtcccagctactcgggaggctgaggcaggggaatggcatgaagctggga

SEQ ID NO: 18225 - DNA, 201 bp, Homo sapiens
gatcttcatctctacactttacttctttctgatttccattatctggttttcacttcattcatttcatttccaaacatgctttttctgtattttctatttargttagtggcatctcaatccaagggatagtagttaatttgatgtgtctgaaatacagggtacaaaacaggctcatagtcggggagattgcccttaactctc

SEQ ID NO: 18226 - DNA, 201 bp, Homo sapiens
aacatactataaatgttcatacctttgctcatatttgttttttaactgaaaattctcttcctaccatacctatgaaatttaatatctatgaaaattaattyagccttctaggctgatctgaaatatcatcttttctgttatctttttcttattctctccagagataatcctgcaatactttgttgtgattttattttactt

SEQ ID NO: 18227 - DNA, 201 bp, Homo sapiens
cgcttgagcccgggagttcaacactaacctgggcaacatggcaaaacctcaactgtacaaaaaatatgagaattagttgggtgtggtgtggcactcctgtrgtcccagctacttgagaggctgaggcggcaggattacctgagccctgtaagggtgaggctgcagtgagccaagatcgcaccagcactccagcctgagcta

SEQ ID NO: 18228 - DNA, 201 bp, Homo sapiens
actgaattctgtcattatttatagttttccagttgattctcttgtgctgtccaggtaaataatcatatagtttccaaataatgatattttagttttatctyttataattttacctgcattttactgtctagttatgttattcaggacctccaaaaaattaatggtggtcatagtagacactcttgtcttcaacttattgtt

SEQ ID NO: 18229 - DNA, 201 bp, Homo sapiens
tccataagggtctaagataagcatagatgcatattggcatcatctgcttggaaggggcctttaaaatgtcaccattcctcactatgctacaccaaggaagkggggataattatcattgcttgtggtaggtgaggcaggatggtcagagcacgtactttgaacctcatcattctgctaagtactactatacgttattttttt

SEQ ID NO: 18230 - DNA, 201 bp, Homo sapiens
tattaaactctccagctattattgtggtgcagtctaagtctccttgaagttctctaggaacttgctttatgaatctgggtactcctgtgttgggtgcatayatatttaggacagttagattttcttgttgtactgaacaatttactattatataatgcccttctgtgtctttttgtttatctttgttggtttaaagtctcc

SEQ ID NO: 18231 - DNA, 201 bp, Homo sapiens
gatgtgagcaaataaagtctgactctaattagacatacttaatctgctcgttgaaacttggagtcaaataagtcttagagtgacatttcagtcttagagtracatttcactgatttcttataagagctttgctaaaaaatatgcttatcaatttaatcaattataggattctagaaatcacaggaaaaacatcacaattaa

SEQ ID NO: 18232 - DNA, 201 bp, Homo sapiens
taaaaataagttatatctaatgttatacaataaactgcctagtttggataatttcattagcttaaactcttccctttgctcagtattaaagttcagaagtkgccacctaacctaacattcttacatatccccctcatggggacttttaacacagtgaattaagtgtcccctttattccatttttttataagaatgtatgag

SEQ ID NO: 18233 - DNA, 201 bp, Homo sapiens
tttatacttgagtccaaaatcctatggtgacctacaaggtctttgtgatctggctctatttatctactactccttccttctttattttgctatgctactckctcttcctgtgtgaggattttcacatactctcttacttttatctgcagtgcttgtttgcatgctctctctctttctctctctttctgtttctctctctct

SEQ ID NO: 18234 - DNA, 201 bp, Homo sapiens
tgtttctttgtgggggtattccttctagtgggtcataacatatgccataaaaatccacattgtggccacttccatagacccatctgcagacaggcctttaytcagatcttcttgtcccagatctttcaatctttcttctttcaggtgcctgcccaattagccagggtattcttcactgtttattaatccttatatcttcta

SEQ ID NO: 18235 - DNA, 201 bp, Homo sapiens
tatttcacctaaggaatttagtaaatttctcttattacctttttaatatctgctacatctgtagttgtgtccctttttgattcataatattatttgtgccstctttctgtatttctcattcacttttgccagaggtatgccaattttattagtttttgcaaagaaccaatatttggctctgttgtttccttctagtctatc

SEQ ID NO: 18236 - DNA, 201 bp, Homo sapiens
actgaattggaatctctggagtggcacttgtttatctgccttttgacaagctgaccaaatatgcacactaaagtttgagtacctctggatgatgtagattytaaggttccttccagctctatgatactttgaatgagaaagacaaagacagacagcaattacggatttcatttcaggtttctttactattctttaatgtca

SEQ ID NO: 18237 - DNA, 201 bp, Homo sapiens
cagagaggtgaactggtaaataccaaatgaaggaagaatactttttataattaaaattcataaaaaagtaatgaactatcatttgaaatggtaagcatccsatcactgggcatttctaaacagaggtaatgtggtcatgtgtcaggactgttatagtgagagttttactttgagtgggaagttgtactttagaacagacgc

SEQ ID NO: 18238 - DNA, 201 bp, Homo sapiens
aagcaagctaaagaaatatatctggaggatatggttcaaaagtaggcaatattaaactgtatatctgtacacgtataattgttatatatagtcatatacayatatgtggtaaagtatgaagtggtaaaactgtagaaaagcaaggagtaattaagaggcaagacaggctagtgggtacctctggagggaggaaaagatctg

SEQ ID NO: 18239 - DNA, 201 bp, Homo sapiens
aaatactggagccaagcaatgcaaaagctgagagactccatttaatagcatgttaatatattaaaacccttaataataaattcatagcacttaaaatacawatatttctacaatgtaatattattttacagatggtatttagtaaatagccagtatttactgggaagtggggaattcattgtcctttgtgccttgctttgt

SEQ ID NO: 18240 - DNA, 201 bp, Homo sapiens
gcagtggctcacgcctgtaatcccagcactttgggaggctgaggcgggtggatcacctgaggttgggagttcgagaccagcctggccaacatgttgaaacsctgtctctactaaaaatacaaaaattagccaggcatggtggtgcacacctgtaattccagctactctggaggccaaggcaggagaatcgcttgaacccag

SEQ ID NO: 18241 - DNA, 201 bp, Homo sapiens
atattttctatcttttttaactgtttgctacctctttctgttagaaaagtgaagaaaaataccaaagaaatatttttgtaagaataacttaaaattaagastattccacatatcaatttaaaaacaaaatttcaacagattgctacagattgcttttatatggtttaaataataaattactttgattccatttatggagca

SEQ ID NO: 18242 - DNA, 201 bp, Homo sapiens
ctatgttgaacaggagtggtgagagagggcatccttgtcttgtaccagttttcaaggggaatgctttcagcttttgcccactcagtgtgatattgcctgtrggtttgtcatatatggctctgattatatcatgatatgaggttacatcccttccttggtatgagtttgtgccccttcctgtgtctgagtgttgacgatata

SEQ ID NO: 18243 - DNA, 201 bp, Homo sapiens
gctttagtaagtatcactctatttctaggtctgtttcaaagctgtcaccctgatatttctctttattccacttctagattagtttcactatttcttagatyctgtgtactcccttttaagaacatttctttttcctccccttcaggacatttattcaagtgattttttttccataaagggtgcatgggaggtaaacttcct

SEQ ID NO: 18244 - DNA, 201 bp, Homo sapiens
cttttttatctagtcatgatattagagtatgtgtggactttgacagtgacacctaaatggtttttacttgcctcattgtttccttactaactgtatgaaaraagaacacgtgttgagcccctccaatctaaaaatacaaactctggaatgctccaaaatttgaaactttttgagtaccaacatgactccacaagtggaaaa

SEQ ID NO: 18245 - DNA, 201 bp, Homo sapiens
ttcctaggggaaatacagagctagattcctgcaagcctctggtcacatttttctcaactggtcaatgaataattttattttatgtgttctgtttaaagacrccttactgagtatatattatcgattcattaactttgaactcattgccaagagctctagaactcatatctgaacaaagcttatcgcacacacatgttttct

SEQ ID NO: 18246 - DNA, 201 bp, Homo sapiens
gtgctttcaaaaaagtcttttggtctatttccactttcaaggtaacctggtggcttcttctctcaagtcctcacacaggtattcaggaataccaggatggygtgcccaagattccaacagcctgtattacggtggaagatgcagaaatgatgtcaagaatggcttctcatgggatcaaaattgtcattcagctaaagatgg

SEQ ID NO: 18247 - DNA, 201 bp, Homo sapiens
aaacaacttatgctcttaaagaaatttttattcatgtgtacgccagacatctaaagtgtcaaatgttattatcagccactggggaaaatgaacaagcaaayaaaactgaagcaaatgtaaccacaccagctaaagaatatgcaaggaaaatatgatgaaatgcaaagaaaaatcagcagcacctcctacttcctttccctt

SEQ ID NO: 18248 - DNA, 201 bp, Homo sapiens
ttttcattaagcatgacatgctggcttttgagatgcaacagagatattttgtcatattaagagaggaaacccttttttcttagtatagtacatgataaggrtttttgtcaaaaataacgttgaattttatcaaaagccttttcataatttattgagatggtattttagttttctctttttattattaacatggtaaattat

SEQ ID NO: 18249 - DNA, 201 bp, Homo sapiens
aacccaaatccaagaggtaaccagattttctttaggaatataagtttttccaaggcaatatccatgtgtgagacatctttggaagaataaatgtacagaarttggttgtattagtttcctagggctgctttaacaatttaccataaaaccagtggcttaaaagaacagatatttattctttcacagttctgaaaagctgaa

SEQ ID NO: 18250 - DNA, 201 bp, Homo sapiens
tcaagtagacaaagtcaaatggtaatacacaagatttgaataatataactaatgaggttgaataatataatttatgagtgaatagggatatggaacatttmatagtatattttattattaatcaaaaaattatgttatgtatgaatatatatgtacatgatatatattgggatatatatggggtatatgtatgtatatatg

SEQ ID NO: 18251 - DNA, 201 bp, Homo sapiens
tatggaaattatagctgttaagacctgttccacaaacacaggttatacatattatcacatctctttaatcttctttacagttaatcacccaagtctccacrgggcttattagcaggaaggctattatctcctcttgagatccctcccactgcccctgaattgtccatgaatcctgactttactcaggccaaatgggtcagt

SEQ ID NO: 18252 - DNA, 201 bp, Homo sapiens
ctttttcctgcagatgtgacatttgactatgaatattgaagttaaacttcaattcattgtattgtaaatggaaaagaagagtttttcattttaggtatatrtacataatacatatattcttttccttggctctcatcatgtttatattagatacaaaactagttaacatgtctagtctggcatttttcctccaagatatat

SEQ ID NO: 18253 - DNA, 201 bp, Homo sapiens
aacccttcttcgaagtgtgatttcctggctaatggatgcttctgggatgattattatatatatttttgtactcaattaagccctattcagaccaacttatkttttggtgaacttaaggaccttatgattagcatccattagcatttccattacatctatattgtaataataccatctaaaatttctatgctgtatctctca

SEQ ID NO: 18254 - DNA, 201 bp, Homo sapiens
tgtcctcagctagtatggcaagggcatgctccctatcactgctagtaatagcaaatgatcactaccactgagtatttgcatcatgccagctactatattargctctctgtatatattttctcatttaatactcctcataaccctgcaaagtaggaattgttattattccccccgttacatagaggggaactgcaatttaga

SEQ ID NO: 18255 - DNA, 201 bp, Homo sapiens
ggaactcataagagaacccaaagagaagaaaaactgtggcaagttttaggctacattgcctagcttatatcacaatgccagcagccttcaactgcaatacrtaggaactgggacttaaaaaccagcagaaacacattggtaaacatcataatgacacgcatatttaggaaaatgatgtttttaatttcaaaatctatgcag

SEQ ID NO: 18256 - DNA, 201 bp, Homo sapiens
atgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtat

SEQ ID NO: 18257 - DNA, 201 bp, Homo sapiens
atgtttgaatgaaggcactgtgtatgaggtgtccctgaacattggaagtctaaagagcatggatttggatgtcaaaactgggtccagattgaagttatgayatggaccacctgtgagagccttaatttcttcctgtgtgaatgtaaataatacctacctcatgggattaaaagagaaaataatataagaaagcatatatca

SEQ ID NO: 18258 - DNA, 201 bp, Homo sapiens
aggcttcccaaaaggtaagagttacctcctcaaagaagcgggggaaattgtctcttactactctatgacaatgagcaaatcactcaaattctctgactctstcttttggaagaaataacatttactggttgcttttgaggattgaatcagatgagatatagaaaagcccttagcccagtgcttgctaggggaaagatcaat

SEQ ID NO: 18259 - DNA, 201 bp, Homo sapiens
accaagagctgtcttacatcctctttggatttccgcatagattttgcaagccgtaaatacaaaatttgtctagagttcatagttggttctgtttactggatttttttttttttttttttttttgagacagggtctggctctgttgcccatggtggaatgcagtggtgcaatattgactctgtgcagccttcgcctcctggg

SEQ ID NO: 18260 - DNA, 201 bp, Homo sapiens
aaagatcttggtaaatatttagaaaattgttaactaatgtgtgaggatctcagtgacatgtttaactcaaaacacaaaatacttaacagattagttactayggtatgttcaaagatcctcttgaggtcagttgattcccagaaaagaaacaacttatgctcttaaagaaatttttattcatgtgtacgccagacatctaaa

SEQ ID NO: 18261 - DNA, 201 bp, Homo sapiens
aggctttgttgttttatacactcaggcaacttgaaaaggataaaagaaaggtggagaaaagaatagtaaagtgagctcaattaattttctaagaaggcaawctaaaaacttctcacatgtaaacagtaagatgtcagggacacaaaatgagttagcccgtgttgctgggatgaggagggatagcagagaaatggccatatg

SEQ ID NO: 18262 - DNA, 201 bp, Homo sapiens
gaggcctcctctggctggaaggttggctggaagagcgggaagaaaattgttgaattcacttaaatacatactttcccatcctattagacacaattcctctyttttaaaaacaaataatttgtaatgccttctttattatcctgaaataaacatcatagacaatctgcttgtgtacatttttaaataaatatattatcctaa

SEQ ID NO: 18263 - DNA, 201 bp, Homo sapiens
cattttcgaatgataatttttaggagaaatatttagaaacagaatcaaagggctttgttttgtttcctcgaaatataaacctattattagaatataattcmcagtatgagaaatgtaggttttgcttgagtttgcttccagatttaagtagaaaagaaagaaaatgacattataaagaattttatctctttttttgtgaaa

SEQ ID NO: 18264 - DNA, 201 bp, Homo sapiens
cagggtgccatggatgatggcggtggagcctttatatcatgggaagcactctcacttattaaagatcttggtaaatatttagaaaattgttaactaatgtrtgaggatctcagtgacatgtttaactcaaaacacaaaatacttaacagattagttactatggtatgttcaaagatcctcttgaggtcagttgattcccag

SEQ ID NO: 18265 - DNA, 201 bp, Homo sapiens
tcaatatcactcaggtcctgagccatggagaagggacagacatcaacttttggatccaagctggagtgcctggtaagaccaaaagatgaagttgtgttccytatatattgccaacaatttaaaataaaatttctgttttaatagagcacaatgaatactagtaggccaggttgtccacggaaaccttaagcttttgttcaa

SEQ ID NO: 18266 - DNA, 201 bp, Homo sapiens
tctttgtgcagagacattgtcccaactccttcaccatgtgctaacaattagataatgactccataaatgtagagaaaaagcagtgtcatggacggtgggtrgtttgttttcttagttctttattgaaaacatatggagatgtttatatataaatagaaaacaataaaacgctgccatcatgtaagcagcaacttaaaaagt

SEQ ID NO: 18267 - DNA, 201 bp, Homo sapiens
tggctcctgggaaacagatgagctggccagtttgaaggatcttaaagttgcaagttttcgggctgggtagcaatttaactgtgcaacctgtcaagagcctrttatattctaaatttgtgccgtgacaatattggctacatgaaataactgtgtgctttcttaccagactttatttggaaagagtttatgaactagtggcct

SEQ ID NO: 18268 - DNA, 201 bp, Homo sapiens
gagttatcctgtaaaataacccaaagacaaagacatggcttttttaatgtatatgtgtttttagaaataaatcattgaaaagctcagtaatccctttggaraacagctttagcattgatgctgtcaagacccttgtcaaaagaataaaccaaacctgattggcctggtggataaactcattccatacataactgaatagtt

SEQ ID NO: 18269 - DNA, 201 bp, Homo sapiens
ttatagtttcaggtttatctgctgcctgggaatcaaaacacaggtcttgattaactttctataaagcaaggatatggactagggatcactaagctctcttwtatctctacaatggtgtcattatatgattctaatccatcactagaaatgtattgtgaaatagttaattaatgtttgcagaatgcttagagaacttttaat

SEQ ID NO: 18270 - DNA, 201 bp, Homo sapiens
ccacatcttttgtttgcactcctaagcacacatttttattctttacatggccaggctgtgaattttcataatttttatgttctatttccccttaaattatraatactgtctttaaattatttctttcccctcacattctattatatacatttaaaagaagccacacagctccttcagtattttgcttagaaatttcttcca

SEQ ID NO: 18271 - DNA, 201 bp, Homo sapiens
ttccatcagatattctagtttatcactcttaaattctgccttctgttaaagccctcaggcatggacacactttagccaagttttttgccacttaataacamggatagcctttactacagtttccaatacgttgttcttcatttccatctgagacctcatcagaattgcctgtactgtccatatttctgtcagcattctggt

SEQ ID NO: 18272 - DNA, 201 bp, Homo sapiens
gtgatagtggcacctcccagtgtcacccagaatgatatccctagtggatgataagaagggaggaggtagttctcagccttgttggcttgcagcttccagtrtgggaccacctcctatgagtgagctgagaaaggggtgatcagagtcttagtattcttgatggctacttagggtagagtttccaccctatgagtaggactt

SEQ ID NO: 18273 - DNA, 201 bp, Homo sapiens
tcattatgtcccttaatcaacaatatgatatggacttttttgcataaataaacaagaacagattgccattggttatatagtacaagtaacactaccaatarcattgtggtcctctgtggttataggattagaatgaatttaataggacaaaaaggaatatagagcataatcatgaaaggaggtatctccaagggcattctg

SEQ ID NO: 18274 - DNA, 201 bp, Homo sapiens
cttagaaaaacattaagatttttcttctttagtagtagatggcttaaaggttttaggtctgctattggtaaatgcattggatgttcaaagcttgattgacwaagtgggtaataaataaaccactgggaccagatgacatcaacccagtatttttgaagaaagtagaaggtaatattgtcaaaacttggttcaattattttt

SEQ ID NO: 18275 - DNA, 201 bp, Homo sapiens
atgtcagtcttactatgattcaaaggacattaaagcaaatggggtgtttagtgacaaaagtatttacaaaaagcttttttttttttaagttcacactgccrtattgtactctcctcaaccttacttttaagtacattttctatacttaatttgggagaaattaccataaaacatttagtgctttgttttctgatatggttt

SEQ ID NO: 18276 - DNA, 201 bp, Homo sapiens
aggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatat

SEQ ID NO: 18277 - DNA, 201 bp, Homo sapiens
cccagtaaaccaattgtaatgtcaaaaaattatgagttgaaccatcataagtgcagatgctccttgacttacaatggggttatatcctgataagtccgttrtaaagttgtatagttgtaagttgaaccatcataaattggggaccgtctatatttgtaatccttgtgttctagcattggtgtctgcacatttgaagagaca

SEQ ID NO: 18278 - DNA, 201 bp, Homo sapiens
tggtctattctgctattgatacttgtgattgcattgtgaagctcttgtgttgtgtttttcagctccatcaggtcagttatattcctttctcacctattctkgttatctggctatcagctccagtattgttttattatgtttcttagcttctttgcattgggttacaacatgcttctttagctcaggaaagttcgttgttac

SEQ ID NO: 18279 - DNA, 201 bp, Homo sapiens
ttcaatgtcacctctaggagctgcagccagacattcctatgatgtacttatagctaatctagttgagctccatttgagaggattctagatatattacttastagagatctggctttctagaaggctcccactggatccaggtaatgtccagtggcttgaacgatagaaagctggagtcagcagctggccttccagacccat

SEQ ID NO: 18280 - DNA, 201 bp, Homo sapiens
agttcacttcagttcttaagataaagtaggttctactgagtatttgctaaatgaatgaacaaatcaatactctaaaatgttttcagctttttactcattgyagtgtaggaagagctacatggagttgaatttctatcaactagcccatcttttattactggagttagtcttctttggtaatttaatactcagagtacctca

SEQ ID NO: 18281 - DNA, 201 bp, Homo sapiens
caaatgggcctttcaattctttccaactctaaaataaatgtaattctagtagaaatccatatacaaatcatggttcataaaactgaaggttaacattgctrccatatggagaagttagctcacatacaaaaagagaaaaccatcagttctccaaatatttctttttaccaaatttgactttaacagcaaactggattgtgt

SEQ ID NO: 18282 - DNA, 201 bp, Homo sapiens
ggtagagtggataaagaaaatacattcattacctgggtgacaaaataatttataaaccaaaccccaatgacacacaatttacccatgtaacaaacctgcayatataccccctaaaccaaaaataaaagttggatagaaaaaagaaagaggtgtgagaaaagaccccactgtgacacataagtggcatagataacagtggag

SEQ ID NO: 18283 - DNA, 201 bp, Homo sapiens
taagaaaagacagataagatccatgctctcacagacaacacagactagtaatgagacctggttatttcatctgcaaaataagtctggtaacctatgagtcrttatttctaccaggcctccacttgtgttctcctcctcctctgtcccctatctcattagcaggcactataattcagaaacctcaaaagcacccaggacata

SEQ ID NO: 18284 - DNA, 201 bp, Homo sapiens
caacagcaacaaaaccaaattaggataattgaggtttagtttaataaagggactatttatatgatgtagagagggtatagggaaagcacaggggatcatgwttatcaaccctaaatctgaaggggcacagagaggaagtggtcatggaaacctggacacagaaagggtgctgcagaaaggaccctctaatgggcactgaga

SEQ ID NO: 18285 - DNA, 201 bp, Homo sapiens
cacctagtctctccactctccatgatctatgcacaataatcaccccttaaggtgaatttaagatcacagaagtgtgccttatcccctctggtccagtttayttgagacgctcaaactcacaggcaaatgaggagttgaatcacttcataccaagctcccagcaatctgcattattgaatacctgaagtgttctgtcctccc

SEQ ID NO: 18286 - DNA, 201 bp, Homo sapiens
atattcacaggattacagtgtctgcattccttagacgctcctatcatgctgtgctagtcgggcactgtgctaggcacagggaatgttgagataaaaggaasttggtttgttgtttaaactacccagattgtgcattgttaaaaattattatttttttggaactcttaaaattttgttttgcccaaaaaattacatgacact

SEQ ID NO: 18287 - DNA, 201 bp, Homo sapiens
taattcaaaacctcttaaaatgctgttcccaagtgtgctgggactttctggtcatgtctctgcgaaatggatattttggatcttgctttagcatacacagraaaccaatctccaggcagttcttccttataatttctttacaagtttccccttaaagaattcctaatgtactttcctcaatagtaacatagatttttctag

SEQ ID NO: 18288 - DNA, 201 bp, Homo sapiens
gaaaacagtatggagattcctcaaagaactaaaagtatatctaccattctatccagcaatcccactactaggtatctgcccaaaggaaaagaagtcattayatcaaaaagacacctgcacatgtacatttatcacagcatggttcacaattgcaaagatatggaataaacctaactgtccatcaatagataagtggataaa

SEQ ID NO: 18289 - DNA, 201 bp, Homo sapiens
agaggagtcaagcataaactgacagtttggggcccaaacaactgaaatgaggggagttaggcagggggaaaagggggagataaggagtatgggtttgaacmtgttaagtttgagatatcagactttcatgtggagaggtcaagtaggcagtttggtaaaaagtatagagttcaatgaattgacatttctcaaaagaagata

SEQ ID NO: 18290 - DNA, 201 bp, Homo sapiens
tcacaataaaagatcaataaatctcaggctttaaatcttagtctctctatcttttagcacattctctttccactgtgttcttttccacttctgtttgtctrttcgctctggcatttttatcatagcctgagacattttcgaatgataatttttaggagaaatatttagaaacagaatcaaagggctttgttttgtttcctc

SEQ ID NO: 18291 - DNA, 201 bp, Homo sapiens
cactcttctcaacttcagtattacagtaggtatgttagtttattcacatggcaggattgagagctctgcaagttatctgtggagagtttgaagaaggcagrtatacaagcaggccaagtccgaagagatgaaggacaaacttacaagacaggagaaagcacaatctccaatcagtcctgagataacatagcatacatcaga

SEQ ID NO: 18292 - DNA, 201 bp, Homo sapiens
tcaaactgttttgtcatttgaattaggaaaggtcaaagggaaaggaacataatagtagacagacagaaaagtgctttgtgaaaattacccattttttccamgtaaggaaaagtaatttgttttttttcagtgctagagatttttgttttgatagatttacagagagaaaagaaaccaccaagaattttgaaaggtcccatt

SEQ ID NO: 18293 - DNA, 201 bp, Homo sapiens
taagggttcttatgtttaaatctttaatctgtctcagatttattttggtgtaaggtgtgttatatatatctagcttaatttttcttcaattagttatcaakatttttttgtttttatatcactttttgaagttcattttttccgatgggattcaaatatacttatcacattaaaattttctaactatatttgtgtctattt

SEQ ID NO: 18294 - DNA, 201 bp, Homo sapiens; identical to SEQ ID NO: 3284

SEQ ID NO: 18295 - DNA, 201 bp, Homo sapiens
atgaggtcatgtgtcatacaggcatggaatgttacaaagctgatatttatggggcactgaccatacaccaggcactgttatatttaacctttttacttatrttgccccatttaatcatcactatatatctaagagctagatactatggtaagtcctatttgatcttcttaactagaaacagtacatggaaaatgggagagt

SEQ ID NO: 18296 - DNA, 201 bp, Homo sapiens
acttaacataatggtcttcaattccatctatgttgctgcaaatgacaggatttcattcatttttatggctgaatgatatttcattgtgtatatatatggcrttttctttcttcattcatctgttgatgggtacttagcttgattccgtattttcactattgttagcagtgctgaaataaacacgggagtgcagatatctct

SEQ ID NO: 18297 - DNA, 201 bp, Homo sapiens
gagacgggactttgccatgtgggccaggttgatctcgaccttctggcttcaagctatctgcctgccttggcctcccaaagtgttgggattacaggcatgarccactgtgcctggctcttttcagcatttttaagctgaattttaaacagaggaatgatatgattggattttccttagaaaatagctacagtaataatgttt

SEQ ID NO: 18298 - DNA, 201 bp, Homo sapiens
ataactaatatattatgtattttcattggaggaagaactgcgttcatgtctgcatttcatcaaagattcctaatgacttcagagggagccagcctgttttmcatgttgctagagaagtggagtaaaaagagagtgggtgacatgatgggggccatctatggtatagtgaagagttagggaattagaggaacttggatacag

SEQ ID NO: 18299 - DNA, 201 bp, Homo sapiens
ttatttctctaatttatcatattgtttagtacatatttcttgagagcttcctagttgctcagaaatttccgagtactaggattactaaggtgaattccatrtgttttttgtcctcaagaaatatttttatgtagccaaaagagaagggggtaagaacatgtaagtgattagtgttatttattttatatttagtgctaagtg

SEQ ID NO: 18300 - DNA, 201 bp, Homo sapiens
cagatatgaaatacagagaagaaatttgagctggcgcttccaaataactgtacttctttaatggtaagatatcccaagctttgatttctcatcttattcastttgtcaggaagagacaaacaggtgtgggtgctgggcagagggcttgatctcattttgcagagaaagtgtttggagactttgaactaagcaaagagtaac

SEQ ID NO: 18301 - DNA, 201 bp, Homo sapiens
atgtctccttttttgcattaataagttcttttttattttactgtaaattggcaaattatggttgtatatatttatgaaatacaaagtaatgttgatatatrtcataatacaaccttccatacaatgtggaatgattaaatcaagctaataaacatacccatcaccttaaatacttatcatttttgtggtgaaaatatttga

SEQ ID NO: 18302 - DNA, 201 bp, Homo sapiens
tgcttatcaatttaatcaattataggattctagaaatcacaggaaaaacatcacaattaaagagattttggtaaaactgagttaaaattgggtaggacttkttactataaaaataagttatatctaatgttatacaataaactgcctagtttggataatttcattagcttaaactcttccctttgctcagtattaaagttc

SEQ ID NO: 18303 - DNA, 201 bp, Homo sapiens
attataggtgataagagtcggtggaggattatatgagtgaatgtataaaagcacctggccaaaggcacagaatagcacttggactgactctcacaggcgayatcaagttctagtttgtctgctatggactgactgggtattcttcactgtaaaggagcctcatccctaatggtgatgtgaagatagtatgtatcccaaaat

SEQ ID NO: 18304 - DNA, 201 bp, Homo sapiens
agaatgtgtttatgtgccttgtaaaggagctagtcattcccttttgctttcctttattatgatgtgtgtatactctgtgtgtgtgtgtgtgtgtgtgtgtstctctgtgtgtatgtacaccaaagaagaaccacaccaggaattgagcataaaggctttctcttacccatctacacacctttcttgtaagttgctgctttt

SEQ ID NO: 18305 - DNA, 201 bp, Homo sapiens
agttgagtgattgttttgcaacagagactgtatggcccactaaacctaaaatatttagtctctgaccctgaaatgtaagattgatagcccaggaccaggcrtggtggctcacacttgtaatcctagcactttggcaggccaaggagggtggatcacctgaggtcaggagttaaagaccagcctggccaacatggtgaaacc

SEQ ID NO: 18306 - DNA, 201 bp, Homo sapiens
agaatcagataattgtctctctgtgcaatgtccaacaccagctttctatgtaataaaaataaactgaaaacaaacaggaggcaaaaataaagcttcatggrcttcttaaactgtttgtgaaagttgttgttctagagatcataaggtagggagttaataaatactttgttccttgacagggctaccccattgtaccactcc

SEQ ID NO: 18307 - DNA, 201 bp, Homo sapiens
ctctataaaatgattcttcattttacaagcttattcactgccgcattcctttactgatctattcctttactgatctattcctttactgatccctctatacmcaactccagatttatggcacagataaattagtgggcaatcatttgctctataaaatgattcttcattttacaagtttattcactgccacattcctttact

SEQ ID NO: 18308 - DNA, 201 bp, Homo sapiens
cagaacattctacccaagaactgcagaatatacatattctattcatcagcacatggaactttctccaagatagaccatatgataggccacaaaacgagtcytgataaattcaagaaaattgaaattatatcaagtactctctcagaccacagtggaataaaactggaaatcaactccagaaggaaccttcaaaaccaggca

SEQ ID NO: 18309 - DNA, 201 bp, Homo sapiens
cacctaacacttaagtgctcacataaacttaaggtaaacggatagaaaaagagattccatgcaaatggacatgaaagtgagcaggagtagctattcttttwtcagacaaaacaaactttaaggctctagcagttaaaaaagacagagggtcattatataatgataaaaggccttgtccaacaggaaaatatcacaattcta

SEQ ID NO: 18310 - DNA, 201 bp, Homo sapiens
cagcctgttttccatgttgctagagaagtggagtaaaaagagagtgggtgacatgatgggggccatctatggtatagtgaagagttagggaattagaggamcttggatacagacttggctctgctcccaaacaactaggtggtcttaggaatgtttcttaaacttctctaggcctcataattttcttctgttaaccagggg

SEQ ID NO: 18311 - DNA, 201 bp, Homo sapiens
agcaattttgaaatatacaacacagtataattaactatagtcatcatgctgacaatataatctcaaaaaatttattcctcttgtttaattgaaactttgamccctttggcattccccattttccccaacccctcagactttggtaagcaccattctactctacgcttcttagttctgttgtttagattccacgtagaagtg

SEQ ID NO: 18312 - DNA, 201 bp, Homo sapiens
tatattgtgaatcttaactgggggcttctcccaacctgttgtgtccggaattggtgggttcttggtctcactgacttcaagaatgaagccgcggaccctcrcagtgagtgttacagctcttaaggtggtgtgtctggagttttttccttctgatgttcggagtttcttccttctggtgggttcgtggtctcactggctcag

SEQ ID NO: 18313 - DNA, 201 bp, Homo sapiens
gcttattgcatttagcataatgtcctgcagcttcatccatgttgtcacaaatgacagaatttcctcatttttaaaggcagaatagtatttcattgtgcatrtgtgccacctattctttagccatttatctgttgatggacacttcggttgattctataatttggctattgtgaatagtgctgcagtgaacatgggattgca

SEQ ID NO: 18314 - DNA, 201 bp, Homo sapiens
tggccagggcaacgggctttttaaaagactttccaagtaattctaatgagtatctaagtttgaggaccactgatctagatcaattaaccatacatacatayatatatatatatatatatatatgcatttttttttaaaaagatacatttaacacctccccccacccaataaaccttatggaaacccaatgcataaaaaaga

SEQ ID NO: 18315 - DNA, 201 bp, Homo sapiens
gtggaagagtgaagcagaagaagtcagagagttaggaagatgtgattatggaagaatgttcaaagagagacagtgccactggctttgaagatggaggaagrgggccatgagccaaggaatgtgggtggccacgagccaaggaatgtgggtggccactagaaactgaggaaagcaaggaaatagattctctcctaaagcttc

SEQ ID NO: 18316 - DNA, 201 bp, Homo sapiens
ctaaatctggagccttgcaggttccctgacttcagacttactcactgcttgtgattctaatgcgtttctagtccacagagatgtttatctggttcttggaracaaactataaacatttttatgtttactttttatgtttcatctttaattatcacgtttggaataggaggagttttataatggtgtgaatttgctgaatca

SEQ ID NO: 18317 - DNA, 201 bp, Homo sapiens
tcagatcatgaacccaggggtccagcacaaagacgtagatccagccctgataggagaatgcctggtttttagaaatagggggattagcttccaaactataraaagaattcattcatccattcattcattcattttaaaattcaggtcttaattcaaatatcacttccccagggaggcctttctgatacattgtctacagaa

SEQ ID NO: 18318 - DNA, 201 bp, Homo sapiens
gtttccagaggatctgctggtttctttgtcccagcagcttccctctgcctgaacctaccctagattccattctctagaatgagccagcttagggtggcaartgtccctgaagttggctgcatgtcctcagatcacctctgaaatctttcctttctataattttactgttgttagaacttttggcttcattaactttctaat

SEQ ID NO: 18319 - DNA, 201 bp, Homo sapiens
aataaataatttgtaaaaaaaaaaaaaagtttaaaatgttaaatcccagtagcaatcaaatacatataattcaattcaaaacactgaaatgacacttgtastcttttaaattagtgattttaaaaaaacaaaacaacaaaaaaacagaatattggtaagagagcaatgaaaaatgagttttcatacactgtgggaaaataa

SEQ ID NO: 18320 - DNA, 201 bp, Homo sapiens
gaacagaattctgccataccatcccttgactaaatttcactagccttctacatgagaaaagaatgaactaccttgttgaagcctctgagattttgagattstgttacatgcagttgatcttacaatctgattctaaccaattcagatatggaggaaataaatgaataagaacttagtttctaggatttcaagccagtagcc

SEQ ID NO: 18321 - DNA, 201 bp, Homo sapiens
tatgcatatatgtgtataaatatgattgagattgtgtaggagcctgtcttagtccatttgtgctgctataacaaaattataataaaataccaccaactacrtagcttatatacaacagaaacttatttctcacagttttggtggctgggaggcccaagaccaaggagctagctgactcagtgtctgatgaaggctcacttt

SEQ ID NO: 18322 - DNA, 201 bp, Homo sapiens
agctcaggagcagtggttacagaattttctggggtttaaataccatctagaggtttcccattggttacttggttacatcctacataaatgaggtagtgggmcatgaccagtctgattagtcgcctttcatgatcagtcagagactgaagtggttacaaagttacacccctatgcaaatgaagactaggcctgtgaccagcc

SEQ ID NO: 18323 - DNA, 201 bp, Homo sapiens
aacaaaacaagaatatccacaaacatgacaccctctttggcagaatagacactaagtgcatatttgttgagaattgagaagatgcataagtcagagaaaakaaattatatttaaaaaggctttacaaatttttagtttttgaggtaatatatacaagtggaacacaactcaaaaagagtatgtagtgaaatgtaagtttcc

SEQ ID NO: 18324 - DNA, 201 bp, Homo sapiens
gcactacctaactgttgtgttttgtaatcaaaagctatattggcaggggtgagtgtgagcctgctgaaaactcagggaaactgttgaaggtttatcaaccygaagcaattttactctagttagtgggcctgtgttgctcagttagcagaatgtttggggatcagaagaataccccagagcacttcagccattgcatagaca

SEQ ID NO: 18325 - DNA, 201 bp, Homo sapiens
tgaagcctgagacaggagaactgattgtgtaattccaatcctaaagctagcagactggagaccaaggaagagttgacgttttacttcaaatgcaaaggcargaaacattcttcctcaattgccacacagtctgactgattttgctggctctcactttccagaaagggaaccatggccataaatgtcatgggaaggtattta

SEQ ID NO: 18326 - DNA, 201 bp, Homo sapiens
ccttgaggtaataatagccatctacaacaaacagataacattatactgaatagggaaagttgaaagcattccccctgagaactggaacaagacaaggattyccattttcaccacttctattcaacatagaattggaagtcctagccagagtcatcagacaagaaaaagatatcaagtgcatcccaatcagtaaagaggaag

SEQ ID NO: 18327 - DNA, 201 bp, Homo sapiens
tattctgtttatctcctctcttcctctcttgcctctatgggtcctggcacaaagtttatgttccataattgatgttaaatgaatgtcttgttttgactaaratatttgttccttaagaaccttatccgtcttacctttattctgtaggaccaagaacacaagatcttatgtgtacccatttagcgatgacagactgaccaa

SEQ ID NO: 18328 - DNA, 201 bp, Homo sapiens
ccttccaaagtcctgggatttcaggtgtgagccaccgtgcccggccccatgcttctttatactagttctttcctcccttctcacctccagcctgggatgtrgtctccactatggtctttattccatactccaaatttgtctctttccaagtatcttcctaattcctttttttaaagttacctttttaatttcctgccgtga

SEQ ID NO: 18329 - DNA, 201 bp, Homo sapiens
acaggctcctggtcctgggtctgacttttttccagtgcaacccagtctgacaatgccatatattcccagtatatctggggaactgcatcactatttcttcrcatgcatttgagattagttatcatagatcacattttggagctggaaggaccttggagattttttaaaggcacttcaaaagtcattatacatacatattta

SEQ ID NO: 18330 - DNA, 201 bp, Homo sapiens
tgctgtgtcaagttttgttaattacacattgttacatgtcaaggcttctaacctattcattctatcctgtaaccataatgtatttgttttggtcttcgttmtagagaattcagtacaactattagtcattttgccagagatttatcatgcatttcttgattgactgaagttaatgcactagcaatttcttccagaaatgga

SEQ ID NO: 18331 - DNA, 201 bp, Homo sapiens
ttttgcccacatccttgctgtcattacgctagtcctaactcttgactcggccatgcagaatattttaaaccactttatcctctacactgcctcagagttaratcataagttggatcatgttacttcctctctcagaagacctacattttgaaaaattgcttgtggaataaatcccaaactcctaatttggcatttaaggtt

SEQ ID NO: 18332 - DNA, 201 bp, Homo sapiens
ctatgtatccaacaaaagtctaatatccagactctataaggaacttaagcaattcaacaaaccaaaaactaataacctcattaaaacgtgggcaaaggacrtgaacagacacttatcaaaagaagacagacaagtagccaataaacatatgaaagaaatgctcaacatcattaatcatcagagaaatgcaaatcaaaagca

SEQ ID NO: 18333 - DNA, 201 bp, Homo sapiens
tcagtgtgctaaatcttataaaattcctttgcatcatccaccttgacagatggtcttcaggaatgtgctgaacctccaaaacagagggttgggaggaaacycaagagtgttcttcccctgtcttctgtcaatgactacgacacactgaaggccacattgaccttccatcaaacatacatgcaggcttcaagccacccttcc

SEQ ID NO: 18334 - DNA, 201 bp, Homo sapiens
acagtagggactctgtgtgggggctctgatcctacttttcccttctgcactgccctaggggaggttctccatgagagcaatgcccctacagcaaacttctrcctggacatccagatgtttccatacatcctctgaaatctaggtggaggttcccaaaccccaattcttgactcctgtgcactggcaggctcaacatcatgt

SEQ ID NO: 18335 - DNA, 201 bp, Homo sapiens
ttataaaattcctttgcatcatccaccttgacagatggtcttcaggaatgtgctgaacctccaaaacagagggttgggaggaaactcaagagtgttcttcmcctgtcttctgtcaatgactacgacacactgaaggccacattgaccttccatcaaacatacatgcaggcttcaagccacccttccttcttccccgtaagg

SEQ ID NO: 18336 - DNA, 201 bp, Homo sapiens
ttatagtccggttggtagagtaaaaaagcaatcaaacttaacagctttttaaaaaattaagaatgttatataggttgatgttatttttattattataaatrtaatatttactccttttgccaacttggaaaatgtagaaaagtcaagaaaaacataacattcatccatgatcccaccacccagacaaaaccacttttacct

SEQ ID NO: 18337 - DNA, 201 bp, Homo sapiens
cagagggttgggaggaaactcaagagtgttcttcccctgtcttctgtcaatgactacgacacactgaaggccacattgaccttccatcaaacatacatgcrggcttcaagccacccttccttcttccccgtaagggacaggttgaagcaaagatcatgctattaggtattaggtaacaagcctccacttacagagtatcct

SEQ ID NO: 18338 - DNA, 201 bp, Homo sapiens
ttacttccctttaacttttctattatgccacaaaggacaagtatgtgttttccttataaaaagaagttttggcaaaaaatgaagttttggtcctatagttyatagtggccccagaaaaaattgccttactatttccacaacaccattgcttgttttttgtttttgtttttttatatagtcccacactttcttttgctcctg

SEQ ID NO: 18339 - DNA, 201 bp, Homo sapiens
agattgaacggttgttaacactttgctatgttttcatcagataacttgggaagaaaggaaggaaggaaggaaggaaggaaatagtgcaaatatagttgaagttttactcagtatttcctgctctcttccctttcttccctatataatttacttaaaagtttgtatatattattcctatgtgcattttgattatttttatta

SEQ ID NO: 18340 - DNA, 201 bp, Homo sapiens
ggtgtgcaatagatatttgttggacaaatgtctgcatgagtgagtagacggctgtggaattgggtttaatgctgtgattccaatgcatataataaggaatkaagttctttcctaaaatactcacatcacactctagcaaccattggcttcttgctagttgatttattctctaagaattgccacaatagattaaagagatga

SEQ ID NO: 18341 - DNA, 201 bp, Homo sapiens
gtccggtttcaaatcctagctcttcttgtccttagctctgtggccttgagcaaatcacttggcttctctgtgcctcatctataaaatgcgaatagtgctaygtaccgctaccacaactgtaatgattgcagaaaatgttcacaaggaacctaacagtgcctagcacctggaaggcattcagtaagaggtgaaaatgcaaca

SEQ ID NO: 18342 - DNA, 201 bp, Homo sapiens
ccatcagtgcagagaggcccatccatgaatcaggtaatttttaagtgagagaaacacacaacaagcctaggattaaggatggtagagagattactgtgtgwtgctatggcatgggaagactttgtggaggagaaagccctcgggctggatgctgaaggccaagtaggtgttagactgggggagctaagtgaagagggcatt

SEQ ID NO: 18343 - DNA, 201 bp, Homo sapiens
ttacgggcagaaaaggaacagagacagatcatcacggtctcccagttgtgttctttcttccactatgcagcctacatttctctctaccatacattttgatwacttaacctaggacatcaatacctatgtattaatcaggactcttgggattttaaacgtcaaacacctagagaaacttgtttgataagcagggaagttatt

SEQ ID NO: 18344 - DNA, 201 bp, Homo sapiens
ctcttgggattttaaacgtcaaacacctagagaaacttgtttgataagcagggaagttattggcttgtgtaactgaagagttttggtagggctgaatccargtttccagaagatgtcaggtgtttgcctctccttcacaaggcttaacttttctcagtgtggcttcattctcaggcaagctgcctacaaatagtgtccaaa

SEQ ID NO: 18345 - DNA, 201 bp, Homo sapiens
agggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttca

SEQ ID NO: 18346 - DNA, 201 bp, Homo sapiens
cttatagattcacttttttgctcaagccttcagcttaaattatattcaattaatctaacagaagagttatttgtgctttgtaaatataatcagtctttccygagtaactgtctacagaaggctgtttgctgtgaagcgtcgttgaatacttttctgtgtctgtggtttactggacttgaaactgtttatttgaaatgttat

SEQ ID NO: 18347 - DNA, 201 bp, Homo sapiens
tttgctcttttcttaacttttctaagttgaaggttgtattagtcagggttctcttagagggacagaactaataagatacacacacacacacacacacacamaaaaaaaaactaataggatatatatatgtatatatacacatacaaaactaataggatatatatatatatatatacacacactcacacagaactaatagga

SEQ ID NO: 18348 - DNA, 201 bp, Homo sapiens
ggtcttttggcatcccacatctgttgacaattacagaggcacatacagtgccattcatagaatggcatgtgtctccctatgccttggttcacaggccctcrgggacatttacaaagtgtgtactttttaactgtcctagaactaaggagtttaattttgcctgagaatgtgtttatgtgccttgtaaaggagctagtcatt

SEQ ID NO: 18349 - DNA, 201 bp, Homo sapiens
aggtagataataggaggcctaagagaaagctcagttgtcctttggcctatggcctttgggcttgctgtagatcctctgttggcaactggatgctctgttgrgtccaggaattgatgataaccagtagtttgtgggtagatttccatgttgagcactgccttcagctaagtgctttcagttgcctcttgttatggttggagc

SEQ ID NO: 18350 - DNA, 201 bp, Homo sapiens
tcaggctaactgatgaattacaagattttcaccaatgagtgggaaatgtagcgataattattcagactgatttatatttgtctttgggctggtttttcatrtatatttttagacattttaatatatttggatctgattttttataaaatcatgaggttctctttatgctcaagtgctgccaagaagttggacagccctcct

SEQ ID NO: 18351 - DNA, 201 bp, Homo sapiens
gtcctcacagcttgaggtagcatttagcatgtgtcatgatttagtacaagggttggcaaactgttgctcttggattaagtctggctcattgcctgtttttsaaagaaaaaaattgtatatgtgtgtatatatgttatatataggtacacacacatatgtgctatatatagcatatatacacacataatatataaacatgta

SEQ ID NO: 18352 - DNA, 201 bp, Homo sapiens
actaaaaatacagaaattagctgggcgtggtaatgggtgcctgcaatccaagctactctggaggctgaggcaggagaatcacttgaacccaggaggcagargttacagtgagctgagatggtgccactgcactccagcctggacgacagagtgagactccatctcaaaaaaaaaaaaaaaaaaaaaaagatagtccaagat

SEQ ID NO: 18353 - DNA, 201 bp, Homo sapiens
ctggagccagtgagaataccccactgggagaggggagaagaatcagctgtgatgctggagccaagaattcataagatagccatcctgggtcttggcagcarcattgggactcctccagaaggtattgtttgtcttttcagtttgatttgtattttataaaactaatgtcccttggtgtaattgagtacaatatgcatgatt

SEQ ID NO: 18354 - DNA, 201 bp, Homo sapiens
ttcttacactgtaaaaaaaaaaaaaaatggtgggggggaatacaaatccagccccttctttcctcacagaaatgttgttaagatagataagaaaacaaaakcattgatctcttctggaggaaagatgatttaaattcaaagtattactcataaggtggatgctgttagatgactcagaaatgatgactgatgtgttattat

SEQ ID NO: 18355 - DNA, 201 bp, Homo sapiens
cacacacacacacacacacaaaaaaaaactaataggatatatatatgtatatatacacatacaaaactaataggatatatatatatatatatacacacacwcacacagaactaataggagatatatatatatatgagtttattaagtattaacttacatgattacaaggtcccacaataggctgtctgcaaggggaggaga

SEQ ID NO: 18356 - DNA, 201 bp, Homo sapiens
caaattctctgactctctcttttggaagaaataacatttactggttgcttttgaggattgaatcagatgagatatagaaaagcccttagcccagtgcttgmtaggggaaagatcaatattggttttcatctttcctttcttttttcctcccctcctacctccatcaggtggggagtgtgacttccggagcacactacacag

SEQ ID NO: 18357 - DNA, 201 bp, Homo sapiens
aggccaaggtaataggtttttcacatttggaaagctatttggaatgtaggagagttcttagtacacagattgtcccccacatagctgtctgtctagtgtcyccggcctctgccaactagttaccagtagaatctccataccatggtgacaagtaaaagtgctccccccacatattcaaaatggcccctaggggcagcatca

SEQ ID NO: 18358 - DNA, 201 bp, Homo sapiens
cctgttttcaaccagttgcttgtgcttatatatgcaatttgtctatttttttcatatctgttttcagcttctcccaaagaattatcattaggtcataacaytgggggaggtttactgaatgatcattcttttcaaagactttaccatttcccccagagccttggttggtttattgactagagcaaagcagttagtttgcta

SEQ ID NO: 18359 - DNA, 201 bp, Homo sapiens
aaattacaagactgttactgatcaatgttcaggcctattaaaatttcccctatcccaatggcacttgggcaactacttttcttgtatactttaggaagtawctaattcagacaggggactaagaagagactcttcacagtgcttgctgatagccccaaaatgcagcatgaaaccacccaaatgccaagacaaattgagaaa

SEQ ID NO: 18360 - DNA, 201 bp, Homo sapiens
cttggcagttctagggacccacccaccacctgttcctccccatattaccacagatgatgctctcttgaatgtgccacctcccagcaggaggataaccagcycaaaaatagtgcactaatcaatcaaagctaaggtatcctcacagagtccatttcacctccttgccgcctccaccagagcagatgctaatatccatggctg

SEQ ID NO: 18361 - DNA, 201 bp, Homo sapiens
ggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctattatattctaaatttgtgccgtgacaatattggctacatgaaa

SEQ ID NO: 18362 - DNA, 201 bp, Homo sapiens
gtaatcccagcactttgggaggctgcaaggtgggagaattgcttgaggccaggagtttaagaccagcctgggcaacacagcaagacccccatctgtctctmaaaaaaaaaaaaaaagaaaaggatgaagaaccatatttgggttcttcatcttttttctaaaagatgaaaatgaatttgtctgaaaaagaaaaaagtaaaa

SEQ ID NO: 18363 - DNA, 201 bp, Homo sapiens
taacataataaaggaaagagtatgatcatttcaggaggtgcataaaaagcattgcacaaaattcaacacccattcataataatgacttttggaaaattagkaatagtgacagcttcctcgacctgttaaaaggcagtgatgtcaaatcttcagtttaattatgaaagagtgaatgctttcctactacgatggggaataaga

SEQ ID NO: 18364 - DNA, 201 bp, Homo sapiens
tgggaatttagctacctttaaatgctaaatttacctctcagcttgtagatttcctacaaatgaatttctttgggtcaagattttttcatgagcattggcawttagtggatattccttgaaccaaccttttactttaagtgaaatgtatttgcattaagagcatattcatttcccaggctgcttcttaacacatttgtttcc

SEQ ID NO: 18365 - DNA, 201 bp, Homo sapiens
gtggagggctgctgccactttgacatcacccctaaaattgttgggcacaccctctctaaaataattttatttctcattatagcttaatcactatgaatttmtactagagtcatttaaaagaacaattttagcctgccctacttgttgggaagaataggggaaattaacagcatcttgtaactggaaggacccttataggtt

SEQ ID NO: 18366 - DNA, 201 bp, Homo sapiens
agtccgtaagtggatctgcttatagagaaacacctgttgcttctgttttttgtctcatatccagttagtttcccattcacagcaaaacattcccttcaatsccaaggaaactcaacctttttgattattagtatagtttcatcaaagtttctttgaaaggtaaaatatcccctttttcttgcctataatttttaaaccttt

SEQ ID NO: 18367 - DNA, 201 bp, Homo sapiens
tgagggtcttcttgccacatcataacatggcagaaggcatcgcacagaagaagggcaaagaggggatgagagagatcaaaggagacacaaaccccttcctrcaataaacattagtttattcataaaggtggagccctcatgtcctgaatacattttgaaagtccaaccttataataccgtcacaagcgcaattacatttca

SEQ ID NO: 18368 - DNA, 201 bp, Homo sapiens
tcagtcctttcactctgttatttctcattgaagcaattgctaaccagtgtatataatttttgaaaacatggatcttgttttatttagctttgggtcctctrtagcacttactagagttcattgcatctagaaatgttaaaatggcaagccaagtagaggttaacatagacatctagagaaatgttatccagttttccagag

SEQ ID NO: 18369 - DNA, 201 bp, Homo sapiens
tgtagttcagtggtaataaatgcatttatattctatttgtttctttgactcttctcccctctccccttcctggcctctgataactaccaatctctatcttyatgagatctacttttttagctcccacatgtgagtgagactatatgatatttgtctttctgtgcttggactttttcacttaacataatggtcttcaattcc

SEQ ID NO: 18370 - DNA, 201 bp, Homo sapiens
ctgcgttttccaatcaccagatggaatagcgcagcccagcggctctatatcccctgttgtccctaatttaatggtgcctcccttatggtgaaaacactgtrcagtgatgtttgaagggattgatgctccatggtaagcagacttcgccctactgggaacatgaaaaggaacctctctgatttgtggctgtaatcctcaagc

SEQ ID NO: 18371 - DNA, 201 bp, Homo sapiens
caatagggcctcagtctaaaaagacacatcaatttaataactcacttaaaaaatacatcatacttatctaatgaccattacattatatttcaggcaagttmttagagaactctgattcttatgtaagtgccagtgaaggaaaaaagattggagactcaaacaatgaggagttattataagctgccaggagaaactgaaaaa

SEQ ID NO: 18372 - DNA, 201 bp, Homo sapiens
actccttgatatattatctgaataaatccagattttcaaatatggggttgacttaaagcaagatacatctctagtagcctacatctatatttatcatataygaagatttttctgacttgggtattgaatatgaagatggggatctggagctggatcctctaattgttagagaccatttaaaatacaatggacatcatgact

SEQ ID NO: 18373 - DNA, 201 bp, Homo sapiens
ttagaaactaaaagtagaatacttttaatggatttgtgattgaggattttttttgtttttactttctggtcctgtcctgtcctttgttttcctttcatttyttccccctcttatgagttgagttgctttctcttctagggagctatgtgttaggaagctgctaatgaactgcttttgagtctaattttcaataagatttaa

SEQ ID NO: 18374 - DNA, 201 bp, Homo sapiens
ttaaagcaagatacatctctagtagcctacatctatatttatcatatacgaagatttttctgacttgggtattgaatatgaagatggggatctggagctgkatcctctaattgttagagaccatttaaaatacaatggacatcatgacttgcagctaaatccattcagctacctttactgtttaccaagcacctaacaggt

SEQ ID NO: 18375 - DNA, 201 bp, Homo sapiens
ataagccacttttattattttagctattaaagcaagatttctatattagtctagattcctacagtactaagttacagaggtctatctcagatgatctgaarcaaaaatggggaaattaagcaagccacggaaggatagagtttgatttggcctcagattttggcatttgaatgctgttaggacacatattctctctctctt

SEQ ID NO: 18376 - DNA, 201 bp, Homo sapiens
aaaagataatctttgtaaggaagaagaggtagttgtgactctttatgcatcaaacatttaaaaatgcatatctttaaaacatgtaaaactaatgattagawctatgagaaataagcgaagctatttgtaggacactttagatctgttgttttacatgacaaatcaagtagacaaagtcaaatggtaatacacaagatttga

SEQ ID NO: 18377 - DNA, 201 bp, Homo sapiens
agagcaaagccctgtctcaaacaaaacaaaacaaaatctcaacgttaaactttctagagaatgggtaatcacctttcaagtcatttttccaaacccatttytgaaccaggacaggcaataacagagattggcaggggaaggactgatgtctcctcacaagggaaaaaggactctgcattgaaaacacagatgagcctttgg

SEQ ID NO: 18378 - DNA, 201 bp, Homo sapiens
agctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaa

SEQ ID NO: 18379 - DNA, 201 bp, Homo sapiens
atttaaatctaggcagcctgacgccatgcccaacactcttttttttttttttttgagacggagtctcgctctgtcgcccaggctggagtgcagtggtgcgmtctcggctcactgcaagctccgcctcccgggttcacgccattctcctgcctcagcctcacgagtagctgggactacaggcgcccgctaccacgcccggct

SEQ ID NO: 18380 - DNA, 201 bp, Homo sapiens
taatctgaaatggtgatttgtgtggatagaagtacaaatagactggaggtggggaggcccttcactggacaggcaacattaatctagctgccattgtaccrcacacatgctgaatgatgatgatacaggaatgaaggaaacataattcacttgggcagctcaagagcatttttttaagctcttagtatatactggctagat

SEQ ID NO: 18381 - DNA, 201 bp, Homo sapiens
ggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttg

SEQ ID NO: 18382 - DNA, 201 bp, Homo sapiens
caggaaagattctgatttgccttacttgagtcattccagctctgtagtttaggtgcagagtacagggtgaggaatggtattgtgattgacagtcaacctaraccagagtgtagggatcagggaggactaccctaaagaaaataaagccagaacatgggaaagtatgctggtaaatcaaaaactgtatcgactggtctatca

SEQ ID NO: 18383 - DNA, 201 bp, Homo sapiens
gaacagttgtttacagcatgagagctaaaacaagaaggcaaagtatttacttgtttgacctaggctaggaacatgtgtatggagtgactcaattttttttwtttatttatttttttttttgctgtactgcacttgtgcacaaatgactgcaaaagcaatgcaagtatgattttggggttacaaataaattttagtgagtag

SEQ ID NO: 18384 - DNA, 201 bp, Homo sapiens
agttgtttacagcatgagagctaaaacaagaaggcaaagtatttacttgtttgacctaggctaggaacatgtgtatggagtgactcaattttttttatttwtttatttttttttttgctgtactgcacttgtgcacaaatgactgcaaaagcaatgcaagtatgattttggggttacaaataaattttagtgagtaggcaa

SEQ ID NO: 18385 - DNA, 201 bp, Homo sapiens
gtttacagcatgagagctaaaacaagaaggcaaagtatttacttgtttgacctaggctaggaacatgtgtatggagtgactcaattttttttatttatttwtttttttttttgctgtactgcacttgtgcacaaatgactgcaaaagcaatgcaagtatgattttggggttacaaataaattttagtgagtaggcaaatta

SEQ ID NO: 18386 - DNA, 201 bp, Homo sapiens
tttatttaaaaaaaaaatccatttaatatcagttatcacttgaagaatttaaagacagaattatttgctcagaaaaatttgatgctttgtgctattaaacmctcagtacacagaaatagatttaagcaacatggtggtgaatcaagccaaggagagctgggaagctggaattgatggctcagtattctctgtaataatgtg

SEQ ID NO: 18387 - DNA, 201 bp, Homo sapiens
gatgacaatattacttgctttgcagaattaaatgaggtaatattttgaaaattatatgagctattatctaaaaacatttagcacagtgactggcacagcayagagtgcccagtcaatcttggtcccttctccccagttttgccctgaatgttggccagctttgctgcagatgctttctccactatgccattactctcatcc

SEQ ID NO: 18388 - DNA, 201 bp, Homo sapiens
tgtttgagataaatagcccttcccctgagaggccaaatactttccttgaagaaatgccagtcctatgtccctgtgggtagggttcagtatttgtagagtcrccaattataatggcccagatctaataggaactcaaggattccagcctatttccacctaccccacctgcccaagaccagccttatttccaggctttactct

SEQ ID NO: 18389 - DNA, 201 bp, Homo sapiens
aggcaaaccccctttcagattctctatagtgctgtgttctgaacccttaacatgctcttgagaccacagttctacctttcactgaaggtcttttctccacwatgttgagacattggaggatgtctgtcaggggttctcattcttttcttcccctcacccttcacagctttacccagccctccatcttccttcctgacccag

SEQ ID NO: 18390 - DNA, 201 bp, Homo sapiens
gttaaatgcatatttaactttttttcagtttttggcatttatgagtagagctactatgtacgtacttatacaagtgtgcaagttttattttctttcttggraaaatatctaggagtgggattgccgggtcacaggttaaatatatgtttaactttctaagaagctgtcaaactattttccaaagtggtttttacccctttt

SEQ ID NO: 18391 - DNA, 201 bp, Homo sapiens
gtgtattacagtattgcagcttgaatgtggggctcctgcggccatttgtcacagtcttcaggaaaggctttttatcagattcatagtggcaagtgatacarattattggatttcttttccaacataaaaaatagctatttgcagccttttgaagctgggtaaatgagccattgatcttacctgtggaacaccgcagggtat

SEQ ID NO: 18392 - DNA, 201 bp, Homo sapiens
aagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcag

SEQ ID NO: 18393 - DNA, 201 bp, Homo sapiens
attgagtgcctgtatttgagtataacaattgaaggtgcagtggtgaataatttaccctacttgactttgatagtaagggagacaggtttataaacaaacakattagctgatagcatagttaattatggtagaaacacagaagatggtgcaaataactctggggtgttgtttagtgagcctttacagaaaaggtagttttta

SEQ ID NO: 18394 - DNA, 201 bp, Homo sapiens
catagcttcctggacttctaaatagaaagaggaatctgagaacagaagagagctccctaaatgacaagtgtaccccagatgtctgtggccatgtcccagarggccagctgcaatgcagggcctctcttttgatgtcccttgttcacaacgagccatttcacttctagtcaggactatctgcctcctaccatcatcttgaag

SEQ ID NO: 18395 - DNA, 201 bp, Homo sapiens
ctaaaaaccctccaggtttcttttctcttattctgtctcactctctgtcaaagcaaaccagcacctggtctgtttcttcatatgctctgggatatcttccygaagaacagcctgaaaagcagagtcttctcttgccattgtccacactgatctccaggaaatccttcatctttaaccctggaaaatggcagctggagaacc

SEQ ID NO: 18396 - DNA, 201 bp, Homo sapiens
aggatgctgcactggggaaactggggaaagtttacataggatctctctgtattctttcttataactcaatgtgaatctacagtgatcccaacataaaaackgtaatttaaaaaacttagcgtactttactgtatgtagctcctttccttgtacttgataaccttaagtctttttgtcaaccagtgatacactggtctacaa

SEQ ID NO: 18397 - DNA, 201 bp, Homo sapiens
tttgttacatgcatatagtgtttaatggtgaggtttgggcttcaagcatagccatcacccaaatagcaaacattttcaaccaagatgaaggtgtactgttmactctgggtaagagtgtgccaggcagaaggaacagttactaccaaggtactgaggtgggaatattgcccttcagcaaagaggctagagtgactggagcag

SEQ ID NO: 18398 - DNA, 201 bp, Homo sapiens
acttgccagttttctcagcaccatttgttgaatagggtgccctttcctcaatttatgtttttgtatgctttgttgcggatcagcacttacttaatatattkggctttctttctgggttctctattctgttccgtcggtctacatgcctatttttatacccctaccctgctgttttagtaactatagccttgtaggataatt

SEQ ID NO: 18399 - DNA, 201 bp, Homo sapiens
ccatctgctcctggtcttttcttaacttgagacattttattaatgattattactaatttttattctgctcaggctttctgtttcttcctggctcattcttkgtaggttttatgtgaccaggagttatccattttctctaagtttttccatttgttaaaatatagctgtttataatagtctccagtgattctttgtatttct

SEQ ID NO: 18400 - DNA, 201 bp, Homo sapiens
atcttccacatagtgttgagtctgtaggtacacagaagtcaagaactgaggtttgggaacctcttcctagatttcagaggatgtatagaaatgcctggctrcacaggcagaagtttgctacaggggtgaggctgtcacagagaacttctgccacggcagtgtggaaaaaaatgtggggttggaacccaatacagaaaccct

SEQ ID NO: 18401 - DNA, 201 bp, Homo sapiens
gtgcagacaaactgctgccctttccatgatggaaaaggtccaatataatcgacctgccaccaagtagctggctgatctccctgaggaatggtgccatatcragggctcagtgttggtcccggctgctggcaaattaggcactcagcagtggctgtagccgggtcagcttggtgagtggaagcccatgttgctgagcccatg

SEQ ID NO: 18402 - DNA, 201 bp, Homo sapiens
agaatggcagtaaggggatgatgtttttaaattcgcttaaaaagaactttgcagcaggtgttacagagtgcataatttggccatttgaccacttcagggaygttggttctttacatctttccatgttgccattctcagcatgtagacttttgtcaggcctgtctctttgtggtcccaggatggctgcagttgctctaagca

SEQ ID NO: 18403 - DNA, 201 bp, Homo sapiens
gtcaagaactgaggtttgggaacctcttcctagatttcagaggatgtatagaaatgcctggctacacaggcagaagtttgctacaggggtgaggctgtcayagagaacttctgccacggcagtgtggaaaaaaatgtggggttggaacccaatacagaaaccctacttcagcattgtctagtttagctgtgagaagaggac

SEQ ID NO: 18404 - DNA, 201 bp, Homo sapiens
tgggaacctcttcctagatttcagaggatgtatagaaatgcctggctacacaggcagaagtttgctacaggggtgaggctgtcacagagaacttctgccayggcagtgtggaaaaaaatgtggggttggaacccaatacagaaaccctacttcagcattgtctagtttagctgtgagaagaggaccaccatcctccagact

SEQ ID NO: 18405 - DNA, 201 bp, Homo sapiens
aatgcctggctacacaggcagaagtttgctacaggggtgaggctgtcacagagaacttctgccacggcagtgtggaaaaaaatgtggggttggaacccaayacagaaaccctacttcagcattgtctagtttagctgtgagaagaggaccaccatcctccagactgatagatccactgatagcttgcaccatgcacctgga

SEQ ID NO: 18406 - DNA, 201 bp, Homo sapiens
tgaaatgagttaagattttgggggactgttgggaaggcatgatttattttgaaatatgaggacatgagatttgggaggggccagcgcagaatgatatggtytggctgtgttccccacccaaatctcatgttgaattctcatgtgttgtggaggggacccagtgggaggtaattgaatcatgagagtggatttttcttgtgc

SEQ ID NO: 18407 - DNA, 201 bp, Homo sapiens
gaaatatgaggacatgagatttgggaggggccagcgcagaatgatatggtctggctgtgttccccacccaaatctcatgttgaattctcatgtgttgtggrggggacccagtgggaggtaattgaatcatgagagtggatttttcttgtgctattcttgtgatagtaagtctcacttactcactcgtgatagtgagtaaga

SEQ ID NO: 18408 - DNA, 201 bp, Homo sapiens
atggttctgtggaaagctctaggtgctgcctaagcccctataaattactaggacttaacttacaaattacttcctctgaagatcttgtcaagacttagttytaggcttttcttggactagtttagtctgtattcatagggcagtgtttctctatcttttttttcattactataaaagagatttttaagacatttttttccc

SEQ ID NO: 18409 - DNA, 201 bp, Homo sapiens
caaaagtacattcatagctcactgcaacctcaaactcctgtgctcaagcaatcttcccacctcagcctcccgagtagctaggactacaggctggcgccatkgtgcccagctaatttttttaaaatttttatttttagagatgaggtctcactatgttgcttaggctggtcttgaattcctgggctcaagcagtcctcccac

SEQ ID NO: 18410 - DNA, 201 bp, Homo sapiens
aagttacacagatctctggggcaggggcaaaatgccaccagtctctttgtgtaccaagagccaccattactccagttcccaacaagttcttcatctccatstgagaccacctcagcctgcacttcattgtttatatcagcattttggtcaaagccattcaacaagtcctaaaatattccaaacttctccacatcttcctgt

SEQ ID NO: 18411 - DNA, 201 bp, Homo sapiens
tatcacctcttaaaaacattgtttccactttaaaagtaaacacttaataaatttttggaagatctctgatttttatgtgttcatttatgaacattaaataygaaaatattatggtttatattatttattgaaggagtagaggaattactcaactttagtatgctcttaattgaatatatggaggcatttgactttctaatt

SEQ ID NO: 18412 - DNA, 201 bp, Homo sapiens
cttctgccttaaaggcatttatttcctatcatcacctgttttctccaagacatgtgagaagaataaagcctgtattgtggcattttgtgtgaatgctaagwtcttggcaatgtttcttataccttccctagctcttctattttccctaaaaagtattctctttttgaaagaaaaatttaatttctcaatttcttaaaccag

SEQ ID NO: 18413 - DNA, 201 bp, Homo sapiens
gaacctcaagaggcttggctctgaagggaggagacagagagagcagcagcaggagaagggtgtggggtaaaagaatgggttggtttaagacaggaggaacrtaaacaggactttaatgtgttttagaatgaagaggatgagtgaatgaatgtttggtgagaagcaattacaggatataaagcaaataattagaatataggc

SEQ ID NO: 18414 - DNA, 201 bp, Homo sapiens
ttccactttatggaggaggaaacacaggttcagagaggtaaagaaacgtatgcaagattgtaagtggaagagtcaggatttttagtcaggtctgtcagacyttatagcccatgttttctcctctatgcctaagtaggagtgggctcagtggtgatgttttaagggctaatgttgatgttttaagggctaatgagaaggagc

SEQ ID NO: 18415 - DNA, 201 bp, Homo sapiens
gattgtgttgtttataatcttttgaagtacatttttaaaattcagtattatactgctcagaatcatccatattgttgcatattatagtcattcataccttytgactgctctgtaatattcaatgtgtgaatataacagcttgctatggcttgaatatttgttctttccaaaactcatattgaaatttaatccccaatgtgg

SEQ ID NO: 18416 - DNA, 201 bp, Homo sapiens
gccagcgcagaatgatatggtctggctgtgttccccacccaaatctcatgttgaattctcatgtgttgtggaggggacccagtgggaggtaattgaatcaygagagtggatttttcttgtgctattcttgtgatagtaagtctcacttactcactcgtgatagtgagtaagatctgatggtttttaaaagagaagtttccc

SEQ ID NO: 18417 - DNA, 201 bp, Homo sapiens
ggaggtaattgaatcatgagagtggatttttcttgtgctattcttgtgatagtaagtctcacttactcactcgtgatagtgagtaagatctgatggttttwaaaagagaagtttccctatacaagctctctctcttggcctgctgccatccacgtaaaacgtgacttgcttctccttgccttctgccatgatggtgaggcc

SEQ ID NO: 18418 - DNA, 201 bp, Homo sapiens
aatgggctaatacaccaactattgttgtactggagtctgtctctccctttatatctgataatatttgttttatatatctaggtgctctgctgttgggtgcwtgtatgtttggaattgttatattctctttctgaattgatcccttcatcattatataatgactttctttgtctctttttacaggttttaacttaaagtctg

SEQ ID NO: 18419 - DNA, 201 bp, Homo sapiens
agacagttgctgttagcatcttgctgcacttctttcactctattttcttctatgagtatctttataaagttataatattttatagatactgtcaaatctarttgttgtttaacatcaggcaaaatatcccttgaaacagaatttttaatgtatttaagttattctaacaaatggatatcctgcaatttacttaacctggta

SEQ ID NO: 18420 - DNA, 201 bp, Homo sapiens
atttttggttgttttatatatcatttgtctctttcttccttttttattttttatcattgtggtttagtggttttctttagcggtaatgtttcacttctttktctttctcatttgtgtatcttacttttatactttcatgtgtttttattatggtagagattatccatttgctttcagatgtaggattccgttaagtatttc

SEQ ID NO: 18421 - DNA, 201 bp, Homo sapiens
gctcgtgccactgcattccagcctggggtgatagagtgaaactccatctcaaaaacaaacaaacaacaaaaaaacaaaaaacaacaaaaaaacaaaaaacaaaaaaacagagttagctcagtgttttatgatttataaatattttcttaattttctaggcatttgtgttttgattttttgttatgaaatactttttatttc

SEQ ID NO: 18422 - DNA, 201 bp, Homo sapiens
actatatttgtgtctatttctgggttctctgttctgtttcattgatctatttttctgtttacaaaccagcaactcaccattttaaataatagctttacaayaggtttttatatcttgcattgctaatcccgatcatttgtgttctttttcagaatgtttcttgttattcttatttttcctgtgaacttcagaatcaaatca

SEQ ID NO: 18423 - DNA, 201 bp, Homo sapiens
cttcctacttgatactttctttgatagatgtctttaggggagccaacttttctttaacatctttcctttgactctaaagctctcctctcccaacatttccycctcagtttaacccgagttatgtgttcatgacataaatagggccacgtttgccgctgaatgatgtcacagtgcaggtgatccacagatagagaatacaaa

SEQ ID NO: 18424 - DNA, 201 bp, Homo sapiens
tatgtgtgaacatattaaatttatagaataagtcaggtagaactgacatctttaacatttagagttttcttatccatcaatatccctcacttttccatttrtttaattcttgtgggtccatcagtaacattaaaagttttattcacatatttcttgttatacatttttctagttactctataattttggttgctactttta

SEQ ID NO: 18425 - DNA, 201 bp, Homo sapiens
ttttattcacatatttcttgttatacatttttctagttactctataattttggttgctacttttaatgcaatctattcttactttggatctcctatttgcrttgttcgtatgtatgaaaagtagtggtgtcacaatattatttttgtattcattcacttaactgaattctgtcattatttatagttttccagttgattctc

SEQ ID NO: 18426 - DNA, 201 bp, Homo sapiens
gccatgggtatgcaaagacaaacagggtggtataatggacactggagacttagaaagggggagaatggcaggtgaatgaaggatgaaaaactacctattgkgtataatgtatactattcgggttacgggtgcactaaaatcccaggcttcactgctatacagtgcatccatgtgaccaaaaaaccactgtacccctaaagt

SEQ ID NO: 18427 - DNA, 201 bp, Homo sapiens
gggaatatagtgcccttagaggctctgtctcttcatcttgaagatcccctggtcctagggtctggattctccacaagcctcctttatcacatcatcatgaycctcactggaatcagtctctctgaactgttttcttcctcctcctgatgtctcactcccctctctcctttctccagggctattgttgccaccagttcctaa

SEQ ID NO: 18428 - DNA, 201 bp, Homo sapiens
aggaatcattctcccctccctcccaccacatagaatcaacatatggtagggattacagtgggggcatttctttatatcacctcttaaaaacattgtttccmctttaaaagtaaacacttaataaatttttggaagatctctgatttttatgtgttcatttatgaacattaaatacgaaaatattatggtttatattattta

SEQ ID NO: 18429 - DNA, 201 bp, Homo sapiens; identical to SEQ ID NO: 3277

SEQ ID NO: 18430 - DNA, 201 bp, Homo sapiens
actaatgtcccttggtgtaattgagtacaatatgcatgattcatattataatttggataatttcctattccattggcttaatgagttctctaccctttttygtcctcccattttttacttctgtttcttttgtgaaagggaactgatcatgttggatcgctttttaaatgtagaatctgtagctactggtccatgatactt

SEQ ID NO: 18431 - DNA, 201 bp, Homo sapiens
cttgtgtgacctagaaaagattggaagaaattgaggatacttcaattagggaggttccccaaataacttgatttttctaattagatagagatatctttcayatttaaaattttatttctgtgcagatttgctgtgactttggtgtggcctaatctttagcagtaatcactttagcagtgaaatttaacttagaagtccagt

SEQ ID NO: 18432 - DNA, 201 bp, Homo sapiens
tttctaattagatagagatatctttcacatttaaaattttatttctgtgcagatttgctgtgactttggtgtggcctaatctttagcagtaatcactttakcagtgaaatttaacttagaagtccagttagggttaagataaaaaggccacatgaggtaacaaatgagaatatgtactctggagttatacagatctgagtt

SEQ ID NO: 18433 - DNA, 201 bp, Homo sapiens
atttatgtgaataaaagtctatgtcttgggcttctgtaaactcacctctcaaccccagcatacagcacaagaatatggaaatagaaggaagtatgtatgcmtatatgtgtataaatatgattgagattgtgtaggagcctgtcttagtccatttgtgctgctataacaaaattataataaaataccaccaactacatagct

SEQ ID NO: 18434 - DNA, 201 bp, Homo sapiens
gggataatagcaatacaaacattattggtctgtatgaagattaaacaatataaaatatgtaaaacagcataatgcctggtatgtggtaagctttcaataartgttaccttcatttgttatatatatcatgacagttaatacaatgctgagcgaatatttgatgattgtctgaaataacttgaaaaagtttagtgaaaaaat

SEQ ID NO: 18435 - DNA, 201 bp, Homo sapiens
aagaatactaataatagagttttcattaagcatgacatgctggcttttgagatgcaacagagatattttgtcatattaagagaggaaacccttttttcttrgtatagtacatgataagggtttttgtcaaaaataacgttgaattttatcaaaagccttttcataatttattgagatggtattttagttttctctttttat

SEQ ID NO: 18436 - DNA, 201 bp, Homo sapiens
gcataatgcctggtatgtggtaagctttcaataagtgttaccttcatttgttatatatatcatgacagttaatacaatgctgagcgaatatttgatgattstctgaaataacttgaaaaagtttagtgaaaaaattgggggatggaggggttgggaactgggcacagacaattcagccatctaaggaagcagtggcacttt

SEQ ID NO: 18437 - DNA, 201 bp, Homo sapiens
tactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacacta

SEQ ID NO: 18438 - DNA, 201 bp, Homo sapiens
aaaagatgtttccaaagtatgaccagcattggaatttgttcagacccatatttataaacagtaactatgacaactcattcctcccaaccatgctcaacccytcatactttcccaactgtctgttttacaagatgacataagtagagggtttggaaaaaagaaaaaaaaatctttggatgataaacgctttttgcaaacaga

SEQ ID NO: 18439 - DNA, 201 bp, Homo sapiens
tctaatgcgtgggtggacttacagcctggaagctggaggagggaggaggtacagaggacacagagaacatctctttccttcctgaaggatggagggagaaraactttccccctgtctgctccaggcctgacctgaagcttggctggccccagggagagcaaagaagagctttatactagctatgaaactggaatttaaaat

SEQ ID NO: 18440 - DNA, 201 bp, Homo sapiens
ctttcaagagtcaaagtttaaatgccatctactttggatccgttcaaaatattttcactaaccctttataatttaattgactttttaacttttttgttctrttttgttttaacacagcgatctacccttttatgtaaccccttctgctccacatatcactgggctggggccaaaagtaactgagtgactaatatctgggaa

SEQ ID NO: 18441 - DNA, 201 bp, Homo sapiens
ttcaaggaaaaaatgaggaagattacataattgttttaaaataattatccttgactacaaagatcaataagaagggtgcgatgggtacgctaaaagcccasacctcacaactgcacaatatatacacgtcttctgcacttgtacccactaaccctataatttaaaaaaataataataaaaaatagcaagagtgacaccttc

SEQ ID NO: 18442 - DNA, 201 bp, Homo sapiens
tgggtgggatctgatgagtatttgatgttttctaaatcccaaactatctttttcaatgaagtcaatgcattttcaaagcatttttctgcttaatttggaakattaaatgtatctaactggaagcgcatactagaaaagcatgagaaagggcttcttgtcctgatcagaaagatgaggaggctccgaagagatctgaggtag

SEQ ID NO: 18443 - DNA, 201 bp, Homo sapiens
ctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgat

SEQ ID NO: 18444 - DNA, 201 bp, Homo sapiens
tccagcttctgaatgctgtctatgtttttggcttgtggctctttcctccatatttaaaggcagcaatgaccagtcaagtattgtcatattgtgtcactctkacactcaagttagaaatctagcactgttctcactgggctaaaatcaaggtgccctcagggctgctttattttctggaggatttaggagagagtccatttt

SEQ ID NO: 18445 - DNA, 201 bp, Homo sapiens
tgcagaaaatcagagaaagggcagcatgtatatattcactacccagattgaacggttgttaacactttgctatgttttcatcagataacttgggaagaaargaaggaaggaaggaaggaaggaaatagtgcaaatatagttgaagttttactcagtatttcctgctctcttccctttcttccctatataatttacttaaaa

SEQ ID NO: 18446 - DNA, 201 bp, Homo sapiens
ggatatttttgtgtgggccattattctgcctaccacagcttctaaatttggagccatttaatgaaaagacaaggtaagccatatgtgtgtgtgtgtgtgtrtatatatatatatatatatacattgtttgttgggcctatacctatatttcatccaacacagtatagggtctcaaaataatttaagaacaatagaaactta

SEQ ID NO: 18447 - DNA, 201 bp, Homo sapiens
cgtgtctcctggcacatacatacaagagttgctctagggtatatacctaggagtggaatttctgggtcacgaggtttacacatacttggctttgctaggtwatgccaaattgttttcaatgggattatgccaatttacattcccattagaagtatgtaagaattctggttgttccttttcctccttagtgcatggtatttg

SEQ ID NO: 18448 - DNA, 201 bp, Homo sapiens
tccatgtgttaatgagaagaatgtatattctgcaattcttgggtagaatattctgtaaatattattaggtcaattttttttatagtgtagattaagtccgrtgtttctttgttgactttctgcctctatgatctgtctagtgctgtcagtggagcattgaagttccccactattattgtgttgctatctatctgttttctt

SEQ ID NO: 18449 - DNA, 201 bp, Homo sapiens
ggtcgataggactgggtgccgtggagcaaggggtggcactcattggggaggctcaggccacacaggagcccatggagggggtgggaggctcaggcatggcrggctgcaggtcccgagccctgccccgcaggaaggcagctaaggcttggtgagaaatcgagcgcagcgctggtgggctggcacttttgggggaccaagtac

SEQ ID NO: 18450 - DNA, 201 bp, Homo sapiens
cttcagattctccctgaccaagatcatttctcccattttctaaataggctgaaggaaggcaagggctgaaacggagacaggatgctactgcagtactccasgtgaaggctggtggtcgcttggactgagtcagaacagggaaactgatgggaagttgtcggagagtaagtctatgttgaaaatagagccaacaagatttgt

SEQ ID NO: 18451 - DNA, 201 bp, Homo sapiens
gttatctcacctttacatatttttcttaaaaatgacaattttctgcataactgtaatactattatcactcccattaaaattaactatataatttcttaatrtcctgtagtactgcaaattcaaattgctcaattgtccccaaattgtcttttgcagccagtttgttcagtcaggatctaatcaaggatagtgaatttctta

SEQ ID NO: 18452 - DNA, 201 bp, Homo sapiens
ccgggcacagtggctcatgcctataatcctagcactttaggaggccaaagtgggtggatcacctgagcccaaaagttcaagaccagcctgggcaacctggygagacttttcctctataaaaacacaaaaaaattagctgggcgtggtggtgcacctgtagtcccagctactcaggagactgaggtgggaggattgcttgag

SEQ ID NO: 18453 - DNA, 201 bp, Homo sapiens
tgtctcaggtgtggccagggcaacgggctttttaaaagactttccaagtaattctaatgagtatctaagtttgaggaccactgatctagatcaattaacchtacatacatatatatatatatatatatatatatgcatttttttttaaaaagatacatttaacacctccccccacccaataaaccttatggaaacccaatg

SEQ ID NO: 18454 - DNA, 201 bp, Homo sapiens
tgatctgaccataagaggttaccttggagcattcctctacattgcattatgtatattacatggtaatgaatgacagttttcatggctcctaataatgagcwgcttctctttatttagagaacaaaatagggggtttacagataatatctgagtttatcattgagctgctcagcctcctcttctatgtgcctcagcttgtct

SEQ ID NO: 18455 - DNA, 201 bp, Homo sapiens; identical to SEQ ID NO: 3288

SEQ ID NO: 18456 - DNA, 201 bp, Homo sapiens
tcagggaatatctataatatattccatggcaattaaattgcataccccagactgttcaagatgtgtttataaaaggagaaatggatttcccacagctgctygcctgtgaatgcatccttcacacagaaccacagtagccagtatatgcactaaaataacagacttgaatttaaactttcagtgctttcaaacgtctttcaa

SEQ ID NO: 18457 - DNA, 201 bp, Homo sapiens
tagggatgttcatgaagagttgtgcatagagtgttatctacgtaaatcaaatgacactttcagtgcagtaggggagtccacaatatccaaagtgttatgaytaaattttttatgaggcaaataatccctttataaaatgaacaatcagtcactccttgatatattatctgaataaatccagattttcaaatatggggttga

SEQ ID NO: 18458 - DNA, 201 bp, Homo sapiens
tgaaaaacactgctttaagcatctataggacataatttcgagctgtagaaccacagattttagaactcaaagggaatttagagaccatgtactctaatttwactatgatttagtagatgttggttagcaactgtggagctgcaggacaacaaccaacttgtgtgcctgattttctaaaaaactaggggcatctcaaacaaa

SEQ ID NO: 18459 - DNA, 201 bp, Homo sapiens
ttcagcaccaagtaaaacggcctacacatcctctcaccagactcttttgcttataatcatcattattaccttaaagccaaagtttactcatctgtaaaatsaggataataataattatagaatcattgtgaggctttgataagataatgcctgtaagtgtttagtacaggctcatagaaagtacttagtaaatcctggcta

SEQ ID NO: 18460 - DNA, 201 bp, Homo sapiens
ggtgccgtctgtcacccctttctttgactaggaaagggaactccctgaccccttgtgcttcccgagtgaggcaatgcctcgccctccttcagctcgcgcaygacgcactgcacccactgtcctgcgcccactgtctggcactccctagtgagatgaacctggtacctcagatggaaatgcagaaatcacctgtcttctgcg

SEQ ID NO: 18461 - DNA, 201 bp, Homo sapiens
ataaaattgagataatttttacctttaacataaaagttcggctctaaaaaatgtttggcaaagcagaaactctaagtactaatgaggatatgagttgctcytacagccactttagagagctactaaatgcaaataagcatgacctgattctaggctcacaccctaaaaaatctctcccacagtactaagacagacttgtac

SEQ ID NO: 18462 - DNA, 201 bp, Homo sapiens
caaaccttactttcttggaaagaccgttttctggccgctgaggtctctgccactatctgtcatagaatttgattttattttttcacatcatgtgtcagtcyctggaattatttttgttaacttgtacatctactgtcctccaattagaatgtaagttgagaagaacagagccattgtctgtcaagttcattgctgtatccc

SEQ ID NO: 18463 - DNA, 201 bp, Homo sapiens
cctaccttggagaaaaatttgggggcacttaagaaaaatgtgtattctgccactgctgggtgaaatgctccgtatgtatctgttaggtctgtttgatctayaatattattcatgtcctctgtttccttacttatcttccgtattgatgtcctcttcattattgaaagtgtggtatcgaagtttcctactattactgtattg

SEQ ID NO: 18464 - DNA, 201 bp, Homo sapiens
tttttgacttagagtatgttttgtctaaggatagccacccatgcattcttttggttaccatttgcttagaatacctttttctagcccttcactttcacccygtatgtctcactaagtctaaagtgagtttcctgtggagtgcatgtagttgggtattttgtttgttttccattcagctactctatgtctttggattgggaa

SEQ ID NO: 18465 - DNA, 201 bp, Homo sapiens
gactttccaagtaattctaatgagtatctaagtttgaggaccactgatctagatcaattaaccatacatacatatatatatatatatatatatatatgcatttttttttaaaaagatacatttaacacctccccccacccaataaaccttatggaaacccaatgcataaaaaagattaaagtggaggtgctttacataagg

SEQ ID NO: 18466 - DNA, 201 bp, Homo sapiens
gaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagt

SEQ ID NO: 18467 - DNA, 201 bp, Homo sapiens
tgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtcc

SEQ ID NO: 18468 - DNA, 201 bp, Homo sapiens
aggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtg

SEQ ID NO: 18469 - DNA, 201 bp, Homo sapiens
gaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtcca

SEQ ID NO: 18470 - DNA, 201 bp, Homo sapiens
taactttcatttaaactgcacagactatcatggctgggtatttttcaaagctacatagggttctggaattttagaaaccattaggggccaagaagaatctktcagcttatagatctaaatgttcaaaatttaagttaaagcctgtttcttttggtaggaagcaccttgactcccattttttataatgaaagattgatgata

SEQ ID NO: 18471 - DNA, 201 bp, Homo sapiens
aggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaa

SEQ ID NO: 18472 - DNA, 201 bp, Homo sapiens
agaggaattcttgaaaactggcatggaatatcgtattagatggaaccttggaaggttttatttatcccttctcttttagctttctgtctaaggcctcagawtgtagtctattttagaaaatctccaaggcaggaaatttttcataacctttcccctgttagtcattttttttaacttcaacaaaagcctgcatcagaagct

SEQ ID NO: 18473 - DNA, 201 bp, Homo sapiens
ggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaa

SEQ ID NO: 18474 - DNA, 201 bp, Homo sapiens
ctaaaaaaattatattgaagtataatattctcagagaaagtgcacgaatcctaagtgtatatggtgaacttttacaaactgagtacacctgtgtaactgcyacccagatcagaaaacagaacatgaccagcaccccaaaaggtttcctctaccccctttttgtcacaaaccctcctcaccaagagtaatcactctcctgtt

SEQ ID NO: 18475 - DNA, 201 bp, Homo sapiens
caggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaat

SEQ ID NO: 18476 - DNA, 201 bp, Homo sapiens
ctgagtatcgtttttatgattattagtaatttgcatatctttctttgtgaattgtctgttcatatacatatatatatatgctgaatattttctgtttttcygtgggttaccttttcactctcttagtggggtcttttgatgactagctttcctagtttaaaaaaaaacactctcacatattaaagatcttagtaaatattt

SEQ ID NO: 18477 - DNA, 201 bp, Homo sapiens
cctttgcccactttttgatggggttgtttgtttttttcttgtaaatttgtttgagttcattgtagattctggatattagccctttgtcagatgagtaggtygtgaaaattttctcccattttgtaggttgcctgttcactctgatggtagtttcttttgctgtgcagaagctctttagtttaattagatcccatttgtcaa

SEQ ID NO: 18478 - DNA, 201 bp, Homo sapiens
acgacttcactcccctgctaattccatcagagcaggtgctggcatccatggctgcaagacctgaagacagatcacatcacaggactctttgcagacactcyccagtaccagcctgaagcccagtagctcctctgggtggctagacccagaagagcaaaaacaatcactacagttcagctctcaggaagccccattcctagg

SEQ ID NO: 18479 - DNA, 201 bp, Homo sapiens
aaagactttccaagtaattctaatgagtatctaagtttgaggaccactgatctagatcaattaaccatacatacatatatatatatatatatatatatatrcatttttttttaaaaagatacatttaacacctccccccacccaataaaccttatggaaacccaatgcataaaaaagattaaagtggaggtgctttacata

SEQ ID NO: 18480 - DNA, 201 bp, Homo sapiens
cagacctagaaatgatagtgatgatgaaatttgtagacaggcactataagcaactattatacatatattcaaggatttaagagaaatcagaaacataatgmaaagagaaatggaaactatagaaaaggaatcaaatgtaattctataactgaaaaatacaatatatgaaataaaaaaattcaccttatgggctcaacagta

SEQ ID NO: 18481 - DNA, 201 bp, Homo sapiens
tctttatgctcaagtgctgccaagaagttggacagccctcctgttcttctcccagttccccagtccctattccagatgaggggatgcagagttagttgtcmattcattcaacaaacatttattcagcagttagagtgactatctcatctcagtttccctgagacttttctggtttgagcactgaaaagttctatattctag

SEQ ID NO: 18482 - DNA, 201 bp, Homo sapiens
aagactttccaagtaattctaatgagtatctaagtttgaggaccactgatctagatcaattaaccatacatacatatatatatatatatatatatatatgyatttttttttaaaaagatacatttaacacctccccccacccaataaaccttatggaaacccaatgcataaaaaagattaaagtggaggtgctttacataa

SEQ ID NO: 18483 - DNA, 201 bp, Homo sapiens
tgaccctaactttccatattctccagcttggagatgcctgtgggaggtttgctttgagaaggccccagctttggcattgtcagtttttcatctggctcctmatctatttcactttgtctcaagcttcccttctttggtgacccactaaaaactgaagttgtgctggcaagatggtgctttgttgtcatggaaagaggctgt

SEQ ID NO: 18484 - DNA, 201 bp, Homo sapiens
ttattgttcatggagtttcccccccaaacacacacacccattccacatttggtcatttgtttgtaatatcttctttggcttttctggattccaagcatcayttgtgcattcctttaaaaagctttaaggcttttcacatccacagtgatcccattacattccttatataactaatatattatgtattttcattggaggaag

SEQ ID NO: 18485 - DNA, 201 bp, Homo sapiens
gagcaagtgcaagctattattatgatccttattatgtttgatgttgttgttatgtctccctagagtttggtggattttggtttggatttccattccactcyccatcattgagaaggaactgagtcaaaagacccatagtggatcagcagagaccaaccactcaccatggtcataagtaatttcagagcccatagtatctct

SEQ ID NO: 18486 - DNA, 201 bp, Homo sapiens
aataaatgcaattaattagagatttaagtcccacagaggaaagcttctctatggaacaatttgtcttgcattatttctctaatttatcatattgtttagtrcatatttcttgagagcttcctagttgctcagaaatttccgagtactaggattactaaggtgaattccatgtgttttttgtcctcaagaaatatttttatg

SEQ ID NO: 18487 - DNA, 201 bp, Homo sapiens
aggaaagttcatagcattaaatgcctaaaccaaaaatctgaaagagaaccaatagacaacctaaggtcatgcctcatggagctggagaaacaagaacaatygaaacccaaacccagcagaagaaaatgacgaagatcagagcagaactaaatgaaatttaaaaagaaaaaagataaatgaaacaaaagctggttctttgaa

SEQ ID NO: 18488 - DNA, 201 bp, Homo sapiens
aagatacagaatctctgaacagaccagtaacaggcagtgagattgaaatggtaattaaaaaaaattccaaacaaaaaaattccaggaccagatagattcayggctgaattctatcagatgttcaaaaaagaactggtaccaattctactatttcaaaggataaggaaatagagaatcatccctaactcattctatgaagcc

SEQ ID NO: 18489 - DNA, 201 bp, Homo sapiens
gctttagtggctttagaaaccaggaccctatgcatataaatagttgtaataaaaagggaagcagcaacagtgtatagttttcataatttttcaaaatagtwtaaatatgatagcaactttttactcttacagcttagttgtgaaggaggcaaggccagtactcttatactctgggaagctaagacctagagagattaaatg

SEQ ID NO: 18490 - DNA, 201 bp, Homo sapiens
caggacacagttccttgcgtcaaggagctcatagtcaggcaacaatggcttcacatggatagaggcatttaaaccaggccttgaaaagttaggaagtggtaaaaaaaaaaaaagaacaaattagaactcatgaaagtacatagtttgaggagtagaagatgtcttcataaatctagagtaatgggtgagtgaggagggggt

SEQ ID NO: 18491 - DNA, 201 bp, Homo sapiens
agttctcctggataatatcctgcagagtgttttccaacttggttccattctcccggtcactttcaggcacaccaatcagacgtagatttggtcttttcacrtagtcccatatttcttggaggctttgctcgtttctttttattcttttttctctaaacttcccttctcgcttcatttcattcatttcatcttccatcgttg

SEQ ID NO: 18492 - DNA, 201 bp, Homo sapiens
aggacacagttccttgcgtcaaggagctcatagtcaggcaacaatggcttcacatggatagaggcatttaaaccaggccttgaaaagttaggaagtggtaaaaaaaaaaaaagaacaaattagaactcatgaaagtacatagtttgaggagtagaagatgtcttcataaatctagagtaatgggtgagtgaggagggggtg

SEQ ID NO: 18493 - DNA, 201 bp, Homo sapiens
gtttttgttcatttcattaagggttttgagagtcaggttccattaaccagtgtcattccaccattttattctgtgacttcttttggtgctattacatttaraaaattcttcctctctaaaatgtggtaaatatttacctacttagcttttaaaatatattttcatttaattctaaaatgtatttgaaattaatttttatat

SEQ ID NO: 18494 - DNA, 201 bp, Homo sapiens
tgcagatgtaaccagtgttctgagattgttttaaactcactctagaatatgtatataaaaaatggtatcatatagtttttgtgattttgaatttacataastggtattttcttccatattcaggtttatccttttgtttatttcttctatctttttgaggtaaatatttagtctattaattttcagtctttcttattttct

SEQ ID NO: 18495 - DNA, 201 bp, Homo sapiens
atacaatgaaatgaaatgatctgtgccaaatacttgaaacagtgcatggcacatggtaaatggtaaatgttttatttcctccccctttttcttattctgtwtctttctttttcaaaaaatttagatttgtcagaactttgttgatttaaaaactttgtttcccagataataacctcttctgcttatcttttaatctactta

SEQ ID NO: 18496 - DNA, 201 bp, Homo sapiens
aaaagtactgtgtcatttgaaagaagtatattaaaaggccccattaggattgtgattttataaatttctcctttaatttctatcagcttagctctatgtartttggggttttattgctttatacagtttagccaaaagaccttctttatccttaatgatgaattttctctgcaagtctattttatcaaatattaatatcat

SEQ ID NO: 18497 - DNA, 201 bp, Homo sapiens
caagaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaata

SEQ ID NO: 18498 - DNA, 201 bp, Homo sapiens
tctgcattttcaccatgatttgtttagggacactttaaaaaaatatttccttgctcttacttttttttcttcttcaatctgagaactgggagctcttatgttttttttttaattcagtaatgtcataagctattattgcctcaaatattgccttcctgcattctattctgtccttctgtaatccatacagaataaatctat

SEQ ID NO: 18499 - DNA, 201 bp, Homo sapiens
aagaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaataa

SEQ ID NO: 18500 - DNA, 201 bp, Homo sapiens
ataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagta

SEQ ID NO: 18501 - DNA, 201 bp, Homo sapiens
agaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaataaa

SEQ ID NO: 18502 - DNA, 201 bp, Homo sapiens
aaatccaaatggcaaggtctgatagcagctgaatagttagaattggggctcagataaagatctgagctgaaatttagacttgtgaggtttttttttttttwaaaaaaaaacacttctattttaagtttaggtgtgcaagtacaggtttgttacacaggtaaacttgtgtcatgggggtttgttatacagattatttcatca

SEQ ID NO: 18503 - DNA, 201 bp, Homo sapiens
gataatgtgatattaagtccttaggacttttaaagttgacatagtattataactgttacctccgctaatagcgtcaaaccttgggtctaatcagggctcaktctctttactatttgtgtgaccttcctaaccattttgccattctgtctcccttctgaacatagcaaatataactagcttgctttggccttcaaattaata

SEQ ID NO: 18504 - DNA, 201 bp, Homo sapiens
ttaacactgatgaccttacatggaggatttagtgaaagttatattagaaagcaattcagttacttccagattgttattgaagtccagcctctgtggtctayctatgccattagtatttgtcctaggttatttttgctttcgtatgtcagagaatggtctcaacgtaagggggtctgagtcagggtggtctagttgaaaagg

SEQ ID NO: 18505 - DNA, 201 bp, Homo sapiens
aaggtaagagttacctcctcaaagaagcgggggaaattgtctcttactactctatgacaatgagcaaatcactcaaattctctgactctctcttttggaaraaataacatttactggttgcttttgaggattgaatcagatgagatatagaaaagcccttagcccagtgcttgctaggggaaagatcaatattggttttca

SEQ ID NO: 18506 - DNA, 201 bp, Homo sapiens
ccctctgtcctcttcccaagccgtttttggcactccctagaggaaaccagttctcctctcctcttttacttctgcagtgggcacttgggctccaagtatcttttttttttttttaagttcatcttcatcatcctttaaattaaacacctactcccctgataaatatgatgctctttttaacaattagtctttggatataga

SEQ ID NO: 18507 - DNA, 201 bp, Homo sapiens
cctctgtcctcttcccaagccgtttttggcactccctagaggaaaccagttctcctctcctcttttacttctgcagtgggcacttgggctccaagtatcttttttttttttttaagttcatcttcatcatcctttaaattaaacacctactcccctgataaatatgatgctctttttaacaattagtctttggatatagaa

SEQ ID NO: 18508 - DNA, 201 bp, Homo sapiens
gtcataaagtgagttaggatagcttttcctactttaacctaccctggaatggattatataatgcgggtctcataagtttcttgaaaacgtgaaaggcctaraaccagttttgcaaattatcccttaataacatttgctaaattttccatggctattcagctttcttataatattgaatcaatgttattaattcatatttct

SEQ ID NO: 18509 - DNA, 201 bp, Homo sapiens
aatatttcatccattattcagactattgtcatgatttaacttgtttcatatttggaccattcttgggaaatgttttgggtttaattgccttttttcttgaraaaagaaacacatatctttttaccatattgccaatatcttgcaattgtttaatgctttagtaagtatcactctatttctaggtctgtttcaaagctgtca

SEQ ID NO: 18510 - DNA, 201 bp, Homo sapiens
aattcattttcaccaatgctacctggttaccttgtaactccagagttttttagagaggttttgtatatgattgcttgagctatagctttttccctttttgyaagctattattgaaataaaaacgtaacttacctatttcacggtgtatggatgtttttaagtggaataagttcatgctgttttaacttaggttcaccaaac

SEQ ID NO: 18511 - DNA, 201 bp, Homo sapiens
ttgcagatgaagcatctagccccttacagtcttctcttctccagtgtaatatattctgctgctcttcaagcagtgcatttctagacactggaaaatcctgwcagttcttttctgaccaccgtctcttttccaaactctttcctcaggtgtcctggacggaaacaaaagggagtaaaaaagtgttggatttatttagaataa

SEQ ID NO: 18512 - DNA, 201 bp, Homo sapiens
ttaaggatagtactggaatttcctcatcttcctattgtccacattgcccagcgtgaaattttggcccagtaggaaggctatacatttgttgaattaatttkgatctgtaaggcatattcttccacgaaaaggacattgcacaatcacaatattctccataaacaaatggacactcagaaagaactgttgtgttcttttatc

SEQ ID NO: 18513 - DNA, 201 bp, Homo sapiens
ccccttacagtcttctcttctccagtgtaatatattctgctgctcttcaagcagtgcatttctagacactggaaaatcctgacagttcttttctgaccacygtctcttttccaaactctttcctcaggtgtcctggacggaaacaaaagggagtaaaaaagtgttggatttatttagaataaaaagggagtattacttcac

SEQ ID NO: 18514 - DNA, 201 bp, Homo sapiens
ttagaaaacttaagtttgtggattcatatccaaatattgccctttactgatctagctttttctgctgtaagttctaggaaccttttaattcagagaggggwaaagaaaagagctagcatacactcaatagcttttatgttttggatgcttcataaatatcacctcatttggacccttacaagagctttgggaggcagggag

SEQ ID NO: 18515 - DNA, 201 bp, Homo sapiens
ttcaaaaaatgcacaattgagaaaaaaagtccacttttctttctttttttttaaggttttccacaggttgtgattattcaacacatggctacaatcgactratgagatttaactgatttaatgtatgataatataatctaatgacaagtcaaaataattagggggacagggacaacctcatgagtgttgactttaaaaatc

SEQ ID NO: 18516 - DNA, 201 bp, Homo sapiens
gtctctttgtaaggtcatattcgtaaaggttgcaaaagagaccaaacaatgtattccaattgagaagtccaggtagagtatttggttcatttgtgctgctrtaacagaataccatagactgggtaatttataaagaatagatctttatttctcacagttctggatcctgggaggtcaaaaaacaaggcactggcagcttct

SEQ ID NO: 18517 - DNA, 201 bp, Homo sapiens
ataaatatgttatttggtaatggacttgttttcttaacaattataatatattctttccaaatgctgtaatttaattctgccattgtgctaattagtcagcygatcagccttcagcattgtttcaatatcccacccaccacatttttatattaaagctcatttaattggtgttgtgggttgaattctgttcctccccaaatt

SEQ ID NO: 18518 - DNA, 201 bp, Homo sapiens
caacttttccctcacaggcttaaatttttataaaactgcttctcttagtgtgtcgtgttttttgttgttgtagttgtagttttgtttttagcttcttcttmttagcccaacctccttgtttggctttacagttaacctggcttaggtctccttatctccagtgagccaattttagattctcttatcctgtaggagcagaat

SEQ ID NO: 18519 - DNA, 201 bp, Homo sapiens
agttgatgagtgcaccagaatctcagaaattaccactaaataacttactcatgtaaccaaacaccacctgttccccaaaaacctattgaaataaaaaaaawttttttaaaagaatttgttcctttcctttttttaattacatgtaaaactaggtttatggccatggggcatctgtgactcctcctctttttctttagagat

SEQ ID NO: 18520 - DNA, 201 bp, Homo sapiens
atggggagtggtgttgatcattgttggctagtggccctgaatggagcagggagtaggttcctgaatgggcacaggtaggaatcatgtgggaaatgggcacrtgtgcatctttcaaatccctccatagggctgctgcctactgcttgtattaaaaggcattttatgttgcatctacttgaagatgcctaaatatgctatact

SEQ ID NO: 18521 - DNA, 201 bp, Homo sapiens
gcagtgcatagtaccctaaaccagtgcccgcataagcagtctgtataaaacatgcttatgcttttcagcttcccaagtgaatctttcctagagagaattgtttttttttttgaatgtttgaggtcatcttacaataattatgcataatcagtaatggaaacaatttaaagagtttacactatgtgcccggaatatgatcat

SEQ ID NO: 18522 - DNA, 201 bp, Homo sapiens
ataattttttcaagcggagagattagttgtggtcacagtagaaaatttttcataattctccaagtactataaaaagtaacttgatggcataaagtgaattsccatgatgagagtcatcctgtcactgtgaattgctgtgatcatctttaaagtgatatatctttccacactgtctgtcagcaactatgtagggtttgtttt

SEQ ID NO: 18523 - DNA, 201 bp, Homo sapiens
gtgaggtgggtcaagggagaaatagaggttattaaggagtataggtaggtattgaagaagagcctcattttatacacatacagacacatgcacacatatayacctatatatactctctctccatatatacatatatttatatttatgcacatgtaaatacatatatgtaatttatatttattttcccccaatactcctcat

SEQ ID NO: 18524 - DNA, 201 bp, Homo sapiens
ggctccttggctgacatgctgaaggatatgtcttcacattcttaaactccaaacctcccttggaaataatttcctaacagtgaaactgccctaataatgcygtagtttgtttccaggggagaatatttgccttcagagcaggctccttctgccagctttccatttcataaatgcattttatgactccctcttcagagctca

SEQ ID NO: 18525 - DNA, 201 bp, Homo sapiens
gttgcttgttggagatgcattacttttttataatacatgattcaagtacaaacagttgtttttcctcacacagcttgatcttcacaaaaaataaaatttawaaaaccattttggtaaatgtaaatttgtaaaaggaggttttggtacttgtacttgatttaccatcattttctttaaaattgtactgttgtttaacttctc

SEQ ID NO: 18526 - DNA, 201 bp, Homo sapiens
aatagaaataatgaaaatctatagaagtaagaaaaccctggggcctggcatttgtctgctaatccctgtttgcctagagcatgggttttaatgagcagtgrgtgcatctaggacaagtacaaaacttggggccactagtgtactttataagatattgattaactttagacttattaagatgaatatgtaacctataatttc

SEQ ID NO: 18527 - DNA, 201 bp, Homo sapiens
gagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccc

SEQ ID NO: 18528 - DNA, 201 bp, Homo sapiens
aacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatat

SEQ ID NO: 18529 - DNA, 201 bp, Homo sapiens
agcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatg

SEQ ID NO: 18530 - DNA, 201 bp, Homo sapiens
actaaatgaaattgaaacaagaaaatacaaaagataaatgaaacaaaaagctggttttttggaaagatagataaaattgatagaccattagcaagattaamcaaggaaagaagagagaaaagcaacataagctcaattagaaatgaaagggacatattacaactgacaccacagaaatgcaaaaggtcattcaagggtact

SEQ ID NO: 18531 - DNA, 201 bp, Homo sapiens
tcttacatcctctttggatttccgcatagattttgcaagccgtaaatacaaaatttgtctagagttcatagttggttctgtttactggatttttttttttytttttttttttgagacagggtctggctctgttgcccatggtggaatgcagtggtgcaatattgactctgtgcagccttcgcctcctgggctcaaacaatt

SEQ ID NO: 18532 - DNA, 201 bp, Homo sapiens
actcctccagaaagctcctagaactgatacaagaattcagaaaagtttccggatacaaaattaacgtacagaaatcagtaggtcttctatataccaatagygaccaaactgagaatcaaatcaagaactcaaccccttttaaaatagctgcaaaaagataatataataaaatacttaggaatatacctaaccaaggatgtg

SEQ ID NO: 18533 - DNA, 201 bp, Homo sapiens
gattctaataaaagtagacacagttctggtacactactatgtggttatttccagaaatataaatgagtgttattttatatatatatattatatatatatawaatatataatatgtacatatatagtattgaaccgacagtaggtacttatgccttctaaaaatgtagtagtaagtgaacataggcaggcaatataggaggt

SEQ ID NO: 18534 - DNA, 201 bp, Homo sapiens
acgtttatagcagcacaatttgcaattccaaaaacatatatatatactgtatatagtatatatatacagtatatatatactatatatagtatatatatacagtatatatacagtatatatatacagtatatatacagtatatatactgtatatatagaaactgtagtgtatatatatacactatgtatatactatatatat

SEQ ID NO: 18535 - DNA, 201 bp, Homo sapiens
atttggaatgtaggagagttcttagtacacagattgtcccccacatagctgtctgtctagtgtccccggcctctgccaactagttaccagtagaatctccataccatggtgacaagtaaaagtgctccccccacatattcaaaatggcccctaggggcagcatcatccatattaaaaacaactggcttagattaatgggac

SEQ ID NO: 18536 - DNA, 201 bp, Homo sapiens
cgtttatagcagcacaatttgcaattccaaaaacatatatatatactgtatatagtatatatatacagtatatatatactatatatagtatatatatacagtatatatacagtatatatatacagtatatatacagtatatatactgtatatatagaaactgtagtgtatatatatacactatgtatatactatatatata

SEQ ID NO: 18537 - DNA, 201 bp, Homo sapiens
cttactgttctcatcaagacttggtaaattttcttggatgaatgttgtcctttgctgtatgcccttaggggagttttgagagacattaaattattttttawataatttttcccactaaatattttgtggggtgaagatctgctgagttactcatgctgccatgctggaagaatcactgggatagccagttttgatctctct

SEQ ID NO: 18538 - DNA, 201 bp, Homo sapiens; identical to SEQ ID NO: 3283

SEQ ID NO: 18539 - DNA, 201 bp, Homo sapiens
gcagcacaatttgcaattccaaaaacatatatatatactgtatatagtatatatatacagtatatatatactatatatagtatatatatacagtatatatacagtatatatatacagtatatatacagtatatatactgtatatatagaaactgtagtgtatatatatacactatgtatatactatatatatacacactat

SEQ ID NO: 18540 - DNA, 201 bp, Homo sapiens
ttgcttattatagaaagcatgtacataaatataaaaataataaaaatcacctgtattggtccattttcacgctgcttataaagacatacccaagactgggcaatttacaaaagaaagaggtttattagacttacagttccacgtggcttgagaggcctcacaatcgtggcagaaagtgaaaggcatatctcacatggtggc

SEQ ID NO: 18541 - DNA, 201 bp, Homo sapiens
cagcacaatttgcaattccaaaaacatatatatatactgtatatagtatatatatacagtatatatatactatatatagtatatatatacagtatatatahagtatatatatacagtatatatacagtatatatactgtatatatagaaactgtagtgtatatatatacactatgtatatactatatatatacacactata

SEQ ID NO: 18542 - DNA, 201 bp, Homo sapiens
tgtattggtccattttcacgctgcttataaagacatacccaagactgggcaatttacaaaagaaagaggtttattagacttacagttccacgtggcttgaraggcctcacaatcgtggcagaaagtgaaaggcatatctcacatggtggcagacaagagaagagagcttgtgcagggaactcccctttttaaaaccatgag

SEQ ID NO: 18543 - DNA, 201 bp, Homo sapiens
acagtatatatatacagtatatatacagtatatatactgtatatatagaaactgtagtgtatatatatacactatgtatatactatatatatacacactatatatatatatactatatatgttactcaaccataaaaacgaatgaattaatggcattcgcagtgacctggatgagactggagactattattctaagtgaag

SEQ ID NO: 18544 - DNA, 201 bp, Homo sapiens
cagtatatatatacagtatatatacagtatatatactgtatatatagaaactgtagtgtatatatatacactatgtatatactatatatatacacactatatatatatatactatatatgttactcaaccataaaaacgaatgaattaatggcattcgcagtgacctggatgagactggagactattattctaagtgaagt

SEQ ID NO: 18545 - DNA, 201 bp, Homo sapiens
ttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaac

SEQ ID NO: 18546 - DNA, 201 bp, Homo sapiens
ctgtagccacagtcttctggactcaagtatcctcctacctcagtccaccttcccctctccagtagctgggactatagacgtgcaccactacacccggctattttttttttttcaatagagatgagttctcactacattgtacaggctggtcttgaactcctggcctcaattgatcctccctccttgacttcccaaagtgct

SEQ ID NO: 18547 - DNA, 201 bp, Homo sapiens
ggtgacatcttagagcctcacactactcccttcctcaacttatttatttattggaaaatataataaaattgagataatttttacctttaacataaaagttyggctctaaaaaatgtttggcaaagcagaaactctaagtactaatgaggatatgagttgctcctacagccactttagagagctactaaatgcaaataagca

SEQ ID NO: 18548 - DNA, 201 bp, Homo sapiens
gctggggagcggcgggttgggagcctgtggctgccccttcggtgacagtggagtcaccgagcctagaaatggggaagctgtgacgtgggggtggtggaggrtgctgcgggacagcagcgagcacggccctcagccgtccttcccaacacggtttcacttcccctcagctccagggctcagccccaagccgcccccttcatc

SEQ ID NO: 18549 - DNA, 201 bp, Homo sapiens
catgctgtcaaaagcatatcacatttctccactgctatttccttccttcttaactaaaaacaaaacaaaacaccatagacaacaaatagacacacacacamaaaaaaagacactaggtgagagtgaaggtagtttgtactattttcatttttcgtgtgttcaatcgtatttctctcagcaaatatgattggaagtggtgct

SEQ ID NO: 18550 - DNA, 201 bp, Homo sapiens
gaacagctggcaatttaaaaagcagagacttgctaagggggaaggaggtaaagaagatcaaacagaaatgcctccccctttagtgaagtatgaactgaggrtgctgcatagtagcaataaaatcagattcttaaatgctttcccttgtttagtgtgtatatgtgcttatttttatttagtcttcaaagatgactttcctta

SEQ ID NO: 18551 - DNA, 201 bp, Homo sapiens
atttatggagattaaaattcataaattgttatagagttaaaacagatgaaataatgcttctttgacagaccatttagttttttctttcatctttaaacaaygctgcactaaaatttgtctgtaatggcataaaaaaaaccctgatatttgccttttcttctccattccccatgcttgtcaatcgttacagagattatgctc

SEQ ID NO: 18552 - DNA, 201 bp, Homo sapiens
ggaagtcacaggcagacagtgtagaacatcagaggtatcctagctgtggaaaagaagctttcatcattggctgaggactgatccctggcacattatcttcygcacttccaggctgctcctgaagcaggctgagaaagccctggggagactgcataggatggcctacctctagtgagaaacactgagtgccacactggttgt

SEQ ID NO: 18553 - DNA, 201 bp, Homo sapiens
tgaaatagtcctcagctctgggtcaaactctctggcttctattttcaggccctgccacttgggcaaacattccttctctgtggaaaagtagaatgttggcyacaatctcctaaagtcattctagctttgatagggtgtgattgtaggagcctgcaaaggaatctagaatcattgtaggtttcctaatgtctgtagctctat

SEQ ID NO: 18554 - DNA, 201 bp, Homo sapiens
ataaaatcatgaatggggactttgtgagtcacttaacatttgcaagaagcatatgaacgtgattgttcttttagagtttgttaggtgggtggtggtaaagyaatacaattttctaaatggtaaaatcatgaatctcatgcatgtcaaaaaatttattcaattcattaattaatgagaatatcagtaagatgttacaccatt

SEQ ID NO: 18555 - DNA, 201 bp, Homo sapiens
cttcacagagcattcaatcatggcagaaggcaaagggggagtgaggtgtcttagatggcaggagcaggagcaaaggggaggggagatgccacacacttttmaacaaccagatctcatgagaactcgctaacacaagaacagcaccagggggatggtgctaaatcattcatgagaaacagcctgtataatccaatcacctct

SEQ ID NO: 18556 - DNA, 201 bp, Homo sapiens
attctcaagaaatgctagctaatattgaaatatgaaataatacttctttggtccaaagatgtttaagcattcctatttggtaaagagaaggagcaaaagamcaagagaaaaattagataattggtacagtatgaacagagtatttggctttggaaaggagggtgggcagttctttcactgggacaggagctcagaatgact

SEQ ID NO: 18557 - DNA, 201 bp, Homo sapiens
cagactccacagccaatgcctttctgtaccctacaccgtccatcatggatttaggtagcctggggacctgaactccccactaggtttaaggtctaattctygaatgaaacctcacgcatttctcttaggttcagggacaatcagattgtcagagtagaaagagactttggattcaacatttgctaacccactggcttccta

SEQ ID NO: 18558 - DNA, 201 bp, Homo sapiens
ttttctatgtgttgtggtagaccacaacatcatataagggttgttctagattcagcaacattcaattaatattttctgaacatgtactatgttccatacaytatgttatgcattaatgttagcatcaaaaagatctaccctgaccttacaaagcctacattctaaaggacactgacgattaacttgaattataaggtgtta

SEQ ID NO: 18559 - DNA, 201 bp, Homo sapiens
atcctcgaggcaagagagtaacttatttttaagaagaagctctaaaattctatacatattggactttatataaaaaaaagaatagttaaaagaactattctttttttttttttttttgagatggagtctcactttgttgcccaggctggagtggagtggcaccatcttggctcactgcaacctccgcctcctgggttcaag

SEQ ID NO: 18560 - DNA, 201 bp, Homo sapiens
accaacaacatgtgggagtcctagttgctccctatctttcccagtatgtggtatcattagcctttttatttttagccattcttataggtgttatgtgtttwtatttttcaaagtacagttctgaagagttacaagaaaaatcctgactcctctcctaatggccactattcttttgccctccctgcttcttcttgccttaag

SEQ ID NO: 18561 - DNA, 201 bp, Homo sapiens
tataataggcctcattatggtacatatgataaattatcttgtccaattaatttatgccactttagactaaggactgtcatatatatacatatatatacachcatatatatacacacatacatatatatgcacatatatatatatagtttctttaggtcttaccaaagtattaaatactttttgaacaaataacgtattttg

SEQ ID NO: 18562 - DNA, 201 bp, Homo sapiens
ctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatct

SEQ ID NO: 18563 - DNA, 201 bp, Homo sapiens
ctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttg

SEQ ID NO: 18564 - DNA, 201 bp, Homo sapiens
tactaacctaagtaaaacaattgccttttaaagttactcctaagaatgttgtgccaaaactttgaggtttcttgtcaattatttggctggcatttattctyccctcctgaaaccgtgaagaatggcttcagcttgtatctagtctgttttaccagcttacaggagagtgccttctggcacaaatagtttctgcctcagtgc

SEQ ID NO: 18565 - DNA, 201 bp, Homo sapiens
cccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtg

SEQ ID NO: 18566 - DNA, 201 bp, Homo sapiens
attatgatgttagctggttattttgatcgttagttgatgcagtttcttcctagcctcgatggtctttacaatttggcatgattttgcagtggctgctaccrgttgttcctttccatgtttagtgcttccttcaggagctcttttagggcaggcctggtggtgacaaaatctctcatttgcttgtctgtaaagtattttatt

SEQ ID NO: 18567 - DNA, 201 bp, Homo sapiens
tgggtttttggtgtggatgtcctttctgtttgttagttttccttctaacagacaggaccctcagctgcaggtctgttggagtttgctagaggtccactccygaccctgtttgcctgggtatcagcagcggtggctgcagaacagcggattttcgtgaactgcgaatgctgctgtctgatccttcctctggaatttttgtct

SEQ ID NO: 18568 - DNA, 201 bp, Homo sapiens
ttgagggttttctttttttgtttcattttgtttttgtttttctgaggcagagttttgctcttgttgcccaggctgcagtgcaaatggcatgagttcggctmactgctacctccgcctcccgggttcaagcgattctccggtctcagcctcctgagtggctgggattacaggcacccgccaccacgtccagctaattttttg

SEQ ID NO: 18569 - DNA, 201 bp, Homo sapiens
gcagcggtggctgcagaacagcggattttcgtgaactgcgaatgctgctgtctgatccttcctctggaatttttgtctcagaggagtacccggctgtgtgwggtgtcagtctgcccctactggggggtgcctcccagttaggctgctggggggtcaggggtcagggacccacttgaggaggcagtctgcccattctcagat

SEQ ID NO: 18570 - DNA, 201 bp, Homo sapiens
cagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgt

SEQ ID NO: 18571 - DNA, 201 bp, Homo sapiens
gctccttgagctgtggtgggctccacccagttcgagcttcccggctgctttttttacctaagcaagcctgggcaatggtgggcgcccctcccccagcctcrctgccgccttgcagtttgatctcagactgctgtgctagcaatcagtgagactccgtgggcatagtaccttccaagccatgtgcgggatataatctcctgg

SEQ ID NO: 18572 - DNA, 201 bp, Homo sapiens
agcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtg

SEQ ID NO: 18573 - DNA, 201 bp, Homo sapiens
gtatttaaaatactgctcattgcaatccttttgaaaagagattctgatgctcgtaaatactccaaaaaggcattaaggtgttacactgatttttatttttwttttattttattttatttatttatttatttatttatttatttatttatttattgagatgcagttttgctcttgttgcccaggctagagtgcagcagtgag

SEQ ID NO: 18574 - DNA, 201 bp, Homo sapiens
ctcattgcaatccttttgaaaagagattctgatgctcgtaaatactccaaaaaggcattaaggtgttacactgatttttatttttattttattttattttwtttatttatttatttatttatttatttatttatttattgagatgcagttttgctcttgttgcccaggctagagtgcagcagtgagatcttggctcaccac

SEQ ID NO: 18575 - DNA, 201 bp, Homo sapiens
gggggggttggtaaaattatcaaaaacagatgacagctgagaaggcctcaatggaggagtctgacaggcaaagaggagagaacacacctggtggagggagmaaggacacccatttggattatactctatttaggagactatacagcaggtaacactgacttagccctatcactgctaccaccacttctttctctccttccc

SEQ ID NO: 18576 - DNA, 201 bp, Homo sapiens
tttattactacctcaatttcagaactcattattgttctattcagagatccagtttattcctggttcagtcttgggagggtgtatgtatccaggaatttatycatttcttctagattttttagtttatgcgcatagaaggttcataatattctctgatggttgtttgtatttctgtggagtcaggggtaatatcccccttat

SEQ ID NO: 18577 - DNA, 201 bp, Homo sapiens
atgtcagtattttttaacactatcagacaatgagaatattcctggccaggtccacttagtgatttcttcattgaaggatacaatttagaagattggaggarcaattataaaagaaagtaatacaatttagaagattgggggagcaattataaaggaaagtagctgtaggtctccaaaagttaaagtcccttaatcccagtt

SEQ ID NO: 18578 - DNA, 201 bp, Homo sapiens
tcaaataatatttttgaatgcataaaataaaatgcatagtattacaaggatatgaattttattaaaatatagttaccaaaaattttaagctaaatttgcartatagttatatatgtggttttccaaatgaattaaacaagatcttgaaggattatttaattatgactatgatatcaaagtaatgatgaacataaagaatac

SEQ ID NO: 18579 - DNA, 201 bp, Homo sapiens
attgcttgagcctgggaagccaaagctgcagtgagccaagatcatgccactgcactccaggcttggtgacagagtgagaccctatctcaaaacacacacayacacacacacacacacacacaaattgtgttgttcaagtcagtgactttgtggtaatttgtgacagcagcaataggaaactaatacacaattagacatcta

SEQ ID NO: 18580 - DNA, 201 bp, Homo sapiens
gaatagtgcagcagcttttagtcattcttttacaactgctgtacacattgcagccagaaaagacattttagttgtcaggtagtcaataaatatttattacmtgcttcctgtatactggttctccactgggaactgttcctaaaggtttgttttcttgttacttttcttgtccctgtgttcctcataactcaaaactgctga

SEQ ID NO: 18581 - DNA, 201 bp, Homo sapiens
gacattgcaaacattggactgcctgaaaacataggtttgtctcagaacagaatacctctgtgcacacacacagaatgataggtctggaaagggatctccartggctactcattctgttcctgtctccaggtacgatggtggctaaaccatagtaggagtgcagtgacaagatggttagatccacagaggctcctgcatgtg

SEQ ID NO: 18582 - DNA, 201 bp, Homo sapiens
attacaagagtttaacacattttctaagacaccaagtgagtaatgtagatactgaggagatattcagtagaaaaagccaaatcactaataatagcatattytcaatatacaggcaatttctcagttgaaaagcttagctattattgctatggccatggcttcaaagctgtgaggttcgctttttatttatattggcaattt

SEQ ID NO: 18583 - DNA, 201 bp, Homo sapiens
aaccctgagcagatattaactaatcctatgatctgaccataagaggttaccttggagcattcctctacattgcattatgtatattacatggtaatgaatgwcagttttcatggctcctaataatgagcagcttctctttatttagagaacaaaatagggggtttacagataatatctgagtttatcattgagctgctcagc

SEQ ID NO: 18584 - DNA, 201 bp, Homo sapiens
tggtgaaggtgagggtaaagggaagaagagttgaggctgaattaatgagcttatttcttttgcatatggcatgtaggagaggaaaaggattcctaggtttmtcatagtcaagaatgtactgattatatgcatttgcttcattaatgaatacagtgctattttgtttagtgtttcaggaaatgctttgattccagcattgtt

SEQ ID NO: 18585 - DNA, 201 bp, Homo sapiens
tcagatatttgtaggtgttcagccttatttctgggctccctactctgttccattggtcttgtgtctatttttgtaccaataccatgctgttttgattaccrtaatcctgtagtataatttgaagttgggtaacgtgatgcctccagctttgttcttcttgcttaggattgccttggctatttgggctattttggggttcca

SEQ ID NO: 18586 - DNA, 201 bp, Homo sapiens
tttggatgatttgacttacccttcctttttaaaattcagactctaaatttaaggctatacatcaccatagtgtttatgaagtgaattaaatcttacagaaygttccagtgcaatctgaaactacagcaactacttgaggttttatgtctgaaaagtgttttaatcagtgatggatttggaattattgcagctgattcctga

SEQ ID NO: 18587 - DNA, 201 bp, Homo sapiens
gatatagaagaatatacaaaatatgggtggtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaa

SEQ ID NO: 18588 - DNA, 201 bp, Homo sapiens
gaaattctagattttttctgagcctgaaatatttcaacaagaacttcttaaaaattgagaaaccctgaataagctgctgtgtggtagctgtgaggaaaagmctggtagactgtgggtgaatgagagtgcagacggggggtggttcaaggtgaggtaaggagctgaaacctaagacagaattgggaacaaaaacttgtccct

SEQ ID NO: 18589 - DNA, 201 bp, Homo sapiens
atatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagttt

SEQ ID NO: 18590 - DNA, 201 bp, Homo sapiens
caaatgctgaataagcaggatccatgtctgtaggaagagtaagataatgccaatgaggtttattaactataatgcaagacacaactgtaagttatgattamtttagtaacgacatcactcattgagctgtcctctttcattgcatattgtgttgttttaaaaatcatattttagtttatgtcatcttttctataatagttc

SEQ ID NO: 18591 - DNA, 201 bp, Homo sapiens
tatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagttta

SEQ ID NO: 18592 - DNA, 201 bp, Homo sapiens
ggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgt

SEQ ID NO: 18593 - DNA, 201 bp, Homo sapiens
atgaattacatggattgcttagttaatttaattttcagattactctttgctattgttttgcttttgcatcgttcattgctgctgcacaattgatttttgtrtgctgatcttttatctgctaaccttgatgaacttcttaattagttctaatcgttttgtgtgtgtatgtgtgttccttaggattttctatatgtaagatca

SEQ ID NO: 18594 - DNA, 201 bp, Homo sapiens
tgttgaatcccagacatcacgtaaggtaatatgaataataaatatttagattgtcttcctacatgttgcaaggtaatttttggtcattaatcactccactrgctcagtgggaaaaattaacaccaaagaagtaataacaactaatttttactaagtaattactatgtgccaaacactgtcttaaatcctttatgtatacta

SEQ ID NO: 18595 - DNA, 201 bp, Homo sapiens
ccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatc

SEQ ID NO: 18596 - DNA, 201 bp, Homo sapiens
tacagaaatagttcattgattattataaatatcatgtttgaaaaacttttaaaaatgaagttacacacagatattgtttaatacctttagcactatactgygaagtgcactgcagaaataaagccattgtttatttagatgggtcagtgattccagactcactactcctcacacaagattttatctgagataccctgatca

SEQ ID NO: 18597 - DNA, 201 bp, Homo sapiens
tgctgtgagggacagtccctcctggtccattgagtccctggatgccagaacattaagaatacagaaaataagagaatatagttaatacattgtataccaaygccaggaaagattctgatttgccttacttgagtcattccagctctgtagtttaggtgcagagtacagggtgaggaatggtattgtgattgacagtcaacc

SEQ ID NO: 18598 - DNA, 201 bp, Homo sapiens
aaggcatagcaagttgtcaggctgcagataatattttaaggaaggagcgaacagaatctgatggtggattgcatatggagtatgagagaaatagaggagtyaagcataaactgacagtttggggcccaaacaactgaaatgaggggagttaggcagggggaaaagggggagataaggagtatgggtttgaacctgttaagt

SEQ ID NO: 18599 - DNA, 201 bp, Homo sapiens
aacaagccagacgtggtggtgcacatctgtaatcccagctacttgggaggctgaggcagaaggattgcgtgagcccagggtttgtgatcagcctgagcaaygtagcaagaccccatttcaaaaaaattagaaaaattgtgcttaagtagccttttggtcctgatttgcttgagagtccagcttgtacccattgtcctgaca

SEQ ID NO: 18600 - DNA, 201 bp, Homo sapiens
atcagattatgaattgcagtgaaataaacttacttttatttttaaaatacaaccaccattaacagctccccagttagaacaactgaatgtcaaataattgyattctcaaatttaaactagaaaatagtagagcttgaggaaggggagtggaaactcaatagtgacacattgagatgggttagaaggtattcagttctccat

SEQ ID NO: 18601 - DNA, 201 bp, Homo sapiens
tcctgccctagatctgaaatcagctatctcttcaaagaatccaatttattttcctaggtcatagtatttagaggccacagtctgaacagtaagtgtgtgtrttgctactggattgttcattgtttctaggtcttttcagcagacaggactaggaaacactttttttctccaacatgaaattatattactaattatatgata

SEQ ID NO: 18602 - DNA, 201 bp, Homo sapiens
tctttttgtttttagtatgtatattctactagagatgtacaaatttctgttaacctatgatgcatattactctaaatatgatatcatttccatttctctcyctctctctctctctctctctctctctctctctctctccctctctccttttttagagatgggatctcacccaggctggagtgcaaaagtacattcatagct

SEQ ID NO: 18603 - DNA, 201 bp, Homo sapiens
ctttttgtttttagtatgtatattctactagagatgtacaaatttctgttaacctatgatgcatattactctaaatatgatatcatttccatttctctctctctctctctctctctctctctctctctctctctctccctctctccttttttagagatgggatctcacccaggctggagtgcaaaagtacattcatagctc

SEQ ID NO: 18604 - DNA, 201 bp, Homo sapiens
ccagttagcaataagcccagatttgaacccaagcagtcttgttccagaccttctgtttttaacaattctacattgcagtttctctaagtaaatagtcaccygaaatatggctacaacaatacagtcacaccaagaatgtagttagagataagaatgcatcattgtgtttgtgcatgtggagactggagctgcttctatagg

SEQ ID NO: 18605 - DNA, 201 bp, Homo sapiens
gaagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacat

SEQ ID NO: 18606 - DNA, 201 bp, Homo sapiens
ggtgcccatcaatggtgggctggctaaaaaacaaatatatggtcatatatatatatatatatatatatatatatatatatatatatatatatatatacatmccatggaatactacccagccatagaaaagaatgaaatcatgtcctttgcagcaagatgggcacaactgaaggccattatcctaagtgaattaatacagaa

SEQ ID NO: 18607 - DNA, 201 bp, Homo sapiens
aagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatc

SEQ ID NO: 18608 - DNA, 201 bp, Homo sapiens
tattgtgttaattatcttatttaatcctttcaaagcttagtgaatttgcatatattttctgtattagtccattctcacattgctataaagaaatacctaaractgggtaatttataagaaaagaggtttaattggttcacagttctgcaggctgtacaggaagcatggcggcatctgcttctgggaaggcttcacagagca

SEQ ID NO: 18609 - DNA, 201 bp, Homo sapiens
agtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatca

SEQ ID NO: 18610 - DNA, 201 bp, Homo sapiens
tcagacaacattcaagagcctactgaaatggcaccttccctgagaagcctctcttaattacacacccatatacaatgtttctctcttcagaacttccatakgtctcttttttatgctttccataaaatttgtcacaaatcccataccttatttatgtgcatataggagcatctaatgggaactcaaaattgctttaaagaa

SEQ ID NO: 18611 - DNA, 201 bp, Homo sapiens
tctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcaca

SEQ ID NO: 18612 - DNA, 201 bp, Homo sapiens
ttatttatgtgcatataggagcatctaatgggaactcaaaattgctttaaagaacataaatgaatgaatgaacatgaatgagctaatgaatgaaagaaaarttatgccttctgcaccagcagaagctaatgactaaaataaaatggttaaactggactagaaatttaagattgttatgggtttctagtctaggaaacaccc

SEQ ID NO: 18613 - DNA, 201 bp, Homo sapiens
ctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaa

SEQ ID NO: 18614 - DNA, 201 bp, Homo sapiens
aaagaattatggtgaattgtgttttttaaaaatagacttctagggcagagtaggggaaaaacatagggaaccgttaattaaggtatcagggcttgagaacktttttgtctgcccaagacccttcctttggaaacagcacctctcccaacatttgtgctcctagtggactggtaacttgcactcctaagaactggaatcttg

SEQ ID NO: 18615 - DNA, 201 bp, Homo sapiens
tcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaat

SEQ ID NO: 18616 - DNA, 201 bp, Homo sapiens
cacaggtttttaacatttttactgatggttcccaaggctccacctgtcccttcattctattctatactgcctctttattggatttctcccccactgcaacktgtgtgtgtgtgtgtgtgtgtgtgtgtgtgtgtgtctgtgtgtgtgaggagagagagacgagagagagaggagagagggagaagagagagagaagagaga

SEQ ID NO: 18617 - DNA, 201 bp, Homo sapiens
cacagtttcctctgaaacttcccctttaggagggatggaaaccacaggatgggcattctggtaaatgctcaacatagatacctatggactgggtagcaggygacccctaggaaaacctcaaatatcctataaggtcctaataagggccagttattctaagcaaaggagcttctgtgagtcatagtgcaatccatagatatg

SEQ ID NO: 18618 - DNA, 201 bp, Homo sapiens
agatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaatta

SEQ ID NO: 18619 - DNA, 201 bp, Homo sapiens
taacctacacagtacatgactagaagcactttgcctgattttcttgttggaagaatgggatctgcctgcaatatggaaaccctcacaaacaagatgactcrattctgttttcatttgcaagatatattgtgaatgttcttttctcctttttgcaggagagggaaagggtttagggttgtgggtgtggcagggcatagaagg

SEQ ID NO: 18620 - DNA, 201 bp, Homo sapiens
taatattttagcgatccacgtgctttttacccaccagaaggttcccctgggtaagtaaagaggtggagcaggagagagcaggtttgcaccgaaagtagttmcaaaacaaaacaaaacatataagacatcaaccacaagaagcccttgctccaaaatgcaaatgacttatttgctacttcaaaaatgcacctcatcaatgaa

SEQ ID NO: 18621 - DNA, 201 bp, Homo sapiens
gcccagaagcagcatcgttcataaggtaagggcacaggctgtagtatcggccagacctttggtcgagttctggctgtgcagcttgactgtgtgatgtcaartaagttctcagagcctccctttccccatctgtaaagtgatgataacggtgcccacccattagctggtgctgtgaggatcggatgagctaccgcatgcaaa

SEQ ID NO: 18622 - DNA, 201 bp, Homo sapiens
aaaataaaatttctgttttaatagagcacaatgaatactagtaggccaggttgtccacggaaaccttaagcttttgttcaaggtataatctgatgatttcyaaaactgggataatagtcctcaccttgtatttgtttacccatctgtatccctccactctttctaaattataagctcctcactcccagagattctgattta

SEQ ID NO: 18623 - DNA, 201 bp, Homo sapiens
ctccacctcctggccttaagcaatcttcctgtctcagcctcccgagtagctgggattatgagtgtgcaccaccatgcctggctaacttttgtattttttayagagacagagtttcgccatgttgcccaggctggtctccaactcctgggctcaagtgatctgcctgccttggcttcccaaaatgctgggattataggcatg

SEQ ID NO: 18624 - DNA, 201 bp, Homo sapiens
atcctgaacctacttctcttcttcctgacttccagacccttgacccttccccacccttcactggccctgctccatcccattcctgcttctagccataatcmatttcaagggtgttcttaatagctacggtgcactttcattctccatgctctgctagtttcccacattggcaatgatctccactgttggtctatgccatac

SEQ ID NO: 18625 - DNA, 201 bp, Homo sapiens
atccatttcaagggtgttcttaatagctacggtgcactttcattctccatgctctgctagtttcccacattggcaatgatctccactgttggtctatgccrtacaactcagaattgcttcattcatctcaggcaaaccccctttcagattctctatagtgctgtgttctgaacccttaacatgctcttgagaccacagttc

SEQ ID NO: 18626 - DNA, 201 bp, Homo sapiens
cctgagctcagtgttaaaaaccaaactggagttttaggcatcatttaggttttctgattctcttggtgaggtaccagtgttttcctcaatgcctacctcaraaaccttagctttgactcccttcctttcccttctatcaagtcatttatcttcttctgaaatagctcccagatttacttcttccttactcatattagctgt

SEQ ID NO: 18627 - DNA, 201 bp, Homo sapiens
atgctttttatccattcagcttgattatatcttttaagtgaagactttaatctgtttacattcaaggttattattgataaatgaggaaatattcctgtcaytttgtaatatgatttttggttgttttatatatcatttgtctctttcttccttttttattttttatcattgtggtttagtggttttctttagcggtaatgt

SEQ ID NO: 18628 - DNA, 201 bp, Homo sapiens
aatcctgctacaatgagttttaaaaaaataaccaacaacacttcacttcagtcatctgtgtaattttcctttagtttggggcattttctaggtaaagtttyagctaaacaatacagaaaaattaaaaagttcagagatcttttaatgatatgaaaaactgtttctaataataataaatgttaaaatcatttcactattcaa

SEQ ID NO: 18629 - DNA, 201 bp, Homo sapiens
ttttatcattgtggtttagtggttttctttagcggtaatgtttcacttctttttctttctcatttgtgtatcttacttttatactttcatgtgtttttatkatggtagagattatccatttgctttcagatgtaggattccgttaagtatttcctgcagggctgatctagtggtgatgaattccctgtttttgattgtctg

SEQ ID NO: 18630 - DNA, 201 bp, Homo sapiens
tgagagaagggaaaaaaatcaacccaaaagaaggcaagaaagaaagaaaaaaaagaaacctagaaaacataataaacagatagaagcaaaaaaattcaacyctaaactattcataagagaaactcctaaaagtatgagatagagaaaggctgccagtaaaacgatgggaaaggacataccagggtaatactctgcaaaaag

SEQ ID NO: 18631 - DNA, 201 bp, Homo sapiens
acctagaaaacataataaacagatagaagcaaaaaaattcaactctaaactattcataagagaaactcctaaaagtatgagatagagaaaggctgccagtraaacgatgggaaaggacataccagggtaatactctgcaaaaagaactaggtgtgcctatcttaattattaggaaaaactggacttccagaacaaaaagca

SEQ ID NO: 18632 - DNA, 201 bp, Homo sapiens
taaggtgttaagtctttctgggaaagaaattacatctaagctgagacctgaagactgagtggaagtaagctaaggaaaatggagagggagggaggaggtgrgtactgcaccttggcagagggacctgtgtgtgcaaaggcaggagatgagacagaggaaagcacaccagagaaatggaaaggaattcagagtggctgctgc

SEQ ID NO: 18633 - DNA, 201 bp, Homo sapiens
catgaagcagtgggtcagtagggaaattataaggaagaccaaagagaatgaaatggttaccaaagtgtactaatgtgagagatacaaagatggatggatadatggatggatggatggatggatggatggcagagagagagagagagaggatgaaaatgtcatgctcatctgaacctcattcttatcaccccagggaaactg

SEQ ID NO: 18634 - DNA, 201 bp, Homo sapiens
caaaaataaaagttggatagaaaaaagaaagaggtgtgagaaaagaccccactgtgacacataagtggcatagataacagtggagattcactcacatttgwtgagtattacctagacagtggagattcactcacatttgatgcgtattacctagacaaggaggacaatggcccctcttcctttctgtattctttgtaaagg

SEQ ID NO: 18635 - DNA, 201 bp, Homo sapiens
aaaccaccaatcagaatttgaaatctttaaagtaatcaatttatccgctattcatttgccttctactttaaatctaaagttttgtcacagccaatatttakagtctctgacatcactgggatcagaatggaaatactagaatctgttttgtggtatcctaaattcactgaattagtatttattgtaggactcccatagggt

SEQ ID NO: 18636 - DNA, 201 bp, Homo sapiens
aacaaacaaacaaaaaagaattaataagagttaaaatgtgttgaactcctaatgtgtaggaagtacctaggctttttgcagacactgttttatccatacarccatcctatgaaggaggtacaattatcataatccctattttgcagatgaagaaacagactcataagggttaaatgacttgcccaagactatactgccctt

SEQ ID NO: 18637 - DNA, 201 bp, Homo sapiens
caccaatcagaatttgaaatctttaaagtaatcaatttatccgctattcatttgccttctactttaaatctaaagttttgtcacagccaatatttatagtstctgacatcactgggatcagaatggaaatactagaatctgttttgtggtatcctaaattcactgaattagtatttattgtaggactcccatagggtgtga

SEQ ID NO: 18638 - DNA, 201 bp, Homo sapiens
ttaaaatgtgttgaactcctaatgtgtaggaagtacctaggctttttgcagacactgttttatccatacagccatcctatgaaggaggtacaattatcatratccctattttgcagatgaagaaacagactcataagggttaaatgacttgcccaagactatactgcccttagggcaggagtcaccctgagaacaggccat

SEQ ID NO: 18639 - DNA, 201 bp, Homo sapiens
atttatccgctattcatttgccttctactttaaatctaaagttttgtcacagccaatatttatagtctctgacatcactgggatcagaatggaaatactaraatctgttttgtggtatcctaaattcactgaattagtatttattgtaggactcccatagggtgtgagtctttacaaataaaggtagggaatgccctttat

SEQ ID NO: 18640 - DNA, 201 bp, Homo sapiens
ttatcataatccctattttgcagatgaagaaacagactcataagggttaaatgacttgcccaagactatactgcccttagggcaggagtcaccctgagaasaggccattttggcttcaaggctggtggcccttttctcacaatatgcaacaacactgaggggtctggaatgctgagaagcctccaaatctccggcagtgtc

SEQ ID NO: 18641 - DNA, 201 bp, Homo sapiens
gccttctactttaaatctaaagttttgtcacagccaatatttatagtctctgacatcactgggatcagaatggaaatactagaatctgttttgtggtatcytaaattcactgaattagtatttattgtaggactcccatagggtgtgagtctttacaaataaaggtagggaatgccctttatttgtaagggcaaataagtt

SEQ ID NO: 18642 - DNA, 201 bp, Homo sapiens
cattctttgttctactcccttctttaactctgaaagatcagaaaggtttacataaagtcagtagctcatttagatgactctaaatgtttccttgaatgctrttttatttcctttagagcattagaagacagaaccaaattactgctgtcttccttttattacttttgagttatcctttgatatttcaaatttgggctattc

SEQ ID NO: 18643 - DNA, 201 bp, Homo sapiens
aggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacac

SEQ ID NO: 18644 - DNA, 201 bp, Homo sapiens
aatttcaggtacctcactgtgtgcagtggcttacccctgtaatcccagcactttgggaggctgcaaggtgggagaattgcttgaggccaggagtttaagaycagcctgggcaacacagcaagacccccatctgtctctaaaaaaaaaaaaaaaagaaaaggatgaagaaccatatttgggttcttcatcttttttctaaaa

SEQ ID NO: 18645 - DNA, 201 bp, Homo sapiens
aactcttttctgacaactcttataaaacacttttgtgtttgattctccaacgactaagatttggacacacaattctccattcatttctcaagtgtcaagaragaattgagtttaaaggctccaattcccttgcaggttacactgtctatctagatgaattagtattcagcacagctttgggaaaatctcaaatgatttgca

SEQ ID NO: 18646 - DNA, 201 bp, Homo sapiens
cctatccccatgtcctcccctgctcagcaaaccagcccactctccatccattttcattctttattttctgttcctatagcatgtgttcctcttcttatccmgggctatgttctgagtccggtccccctctatgccctcaagcaactcaaactggcaattatttatatcctattgcttcaattctctctcttctctaaactt

SEQ ID NO: 18647 - DNA, 201 bp, Homo sapiens
gatgtactactaatgaataaatgtttctaggcaatggaaaactgaaaatagaatcctacctcacacccaacacaaaaatcatttcctattctggatgggtrgagaacttaaaaatgaaaataaaatatttttaaaatttagaatagaatttcagagaatatctttgtaatattagggtaaggaaggacttcttaagacata

SEQ ID NO: 18648 - DNA, 201 bp, Homo sapiens
cagtttttggcatttatgagtagagctactatgtacgtacttatacaagtgtgcaagttttattttctttcttggaaaaatatctaggagtgggattgccrggtcacaggttaaatatatgtttaactttctaagaagctgtcaaactattttccaaagtggtttttaccccttttcattcttcacatcccaccagcagtg

SEQ ID NO: 18649 - DNA, 201 bp, Homo sapiens
actttgatcttcttataccagtttgccagatgtagcagaaagagcatgtatgtgacctttcctgtgccaattcaacccagctgatgggaaactgtaagttwatcttgcatgacttttatttctaggcattacagcagaagttctggtggtgacctctttcgatgaactgcagagaagggcctcagaagcaagagggaagat

SEQ ID NO: 18650 - DNA, 201 bp, Homo sapiens
actcaaactggcaattatttatatcctattgcttcaattctctctcttctctaaacttttcccatcagaatataaatatttcaagtattcgccattaaaawatatatatatatacagctttacccaactttatgaacctccagctctttcttttctttgcagccaagctttttgtcctctcactcattcctccttccagtg

SEQ ID NO: 18651 - DNA, 201 bp, Homo sapiens
tgtttgatttttctgaagcattgacatagttgaccaccacttacatcttgaaactctgtatgtccttagcttctcttaactcctcttttcattcctttttygcttcccttccttgtgccagtcccttacgtgttagtatatgctaggatctcatccttggactctatttattcaggtcactgttcctggaagataactcta

SEQ ID NO: 18652 - DNA, 201 bp, Homo sapiens
ttaccacaacccatctctaggaatagaaattatcgtccaagtcgctcaaacctgaaaacttggcattgacttagacttattttcctcattcactctccctyattcagtcaatccttaagataatgccatttctaccctttaaatgtagcctctcctttattcattgtactgctgccttagttaaggcactcaaaattcctc

SEQ ID NO: 18653 - DNA, 201 bp, Homo sapiens
aaacagctcttctttgaactttatctcctagaaagggaaataagatatgaacctccctaaataactaggcaaaatattataaatgctaaaacgtacaactrctataaaaatggaaagagagaaagtttaaactggttgaggaaaactcaggaaagtcatcttggagaaggcggcatttgatatgtgcctgaacagttgagt

SEQ ID NO: 18654 - DNA, 201 bp, Homo sapiens
tcatagagctttctccctgcagagaggggaagagtatagtccctcatgactcagaatctcttggttgctgccatgcaggcatctatggaatcacaaaagcraggcccaggaaactttaaactaacctatgcttcccgcccagaattcagtctatttccatattagtgggtgccttctgtccatacctatttctgtgtgcaa

SEQ ID NO: 18655 - DNA, 201 bp, Homo sapiens
tctatggaatcacaaaagcgaggcccaggaaactttaaactaacctatgcttcccgcccagaattcagtctatttccatattagtgggtgccttctgtccrtacctatttctgtgtgcaatgtgttgagtcttttgagtggtggcttaacagcccaggagagaattgagctatactgaggcttcatatatgaacacagtat

SEQ ID NO: 18656 - DNA, 201 bp, Homo sapiens
gatacataaagaatgcagtcttcccaactttacactactctctttttcctggatcatggctttctgcagctgcttctcatttagttcagtccaaaaacatkaattgaaatcccaccatgaaccaagcactgttgtaggatctggggagtcaatgatgcacaagacagtctctgccctcaagatgctgagtctagtggggtc

SEQ ID NO: 18657 - DNA, 201 bp, Homo sapiens
gcaacccggtatttttttcaccaagtttttaaagcattcaagatgctaaattttccaagatgagttttctggaagaagtcccaaaactcccttctctctcttttttttttttttttttttttttttttgtgatgaagtctcactccgttgcccactaccaggctggagtgcagtggcacgatctcagctcactgcaacatc

SEQ ID NO: 18658 - DNA, 201 bp, Homo sapiens
tctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagcca

SEQ ID NO: 18659 - DNA, 201 bp, Homo sapiens
ctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaa

SEQ ID NO: 18660 - DNA, 201 bp, Homo sapiens
tttaatggtactttaagggttcttatgtttaaatctttaatctgtctcagatttattttggtgtaaggtgtgttatatatatctagcttaatttttcttcrattagttatcaatatttttttgtttttatatcactttttgaagttcattttttccgatgggattcaaatatacttatcacattaaaattttctaactata

SEQ ID NO: 18661 - DNA, 201 bp, Homo sapiens
aacatcaagtgtaattgatttccattttctgtatatatccttttttctataatcattaaaaaattttacttttgctataatcctttttaacttggttattyacattttattctgatcactttttaaatttgtgtccttcataattcttactttgttttcagcagcatttactctgtttggattgtctccaatatgaccttc

SEQ ID NO: 18662 - DNA, 201 bp, Homo sapiens
ttggattgtctccaatatgaccttcatttctctgatggttttatttttctctcctgtttatgagctctgccagtccaatcatcatctccttgtattgcctygccttattttacttgggctcttgtatacttagtttgcatttttaatttatagaggtatgtgcttatttttttgtttatatcattatatttggtcacaatt

SEQ ID NO: 18663 - DNA, 201 bp, Homo sapiens
ttcactttttatgtttattaatttctttttttctattttcctgtttttcattttattctaacttcttgaatgcttatattatctctttcattctttcttgkttattaatatttcagctatatcacctagataattgtatattgttctttcttcgattgttatttcccagatatcctataatttcagttttgattttatatt

SEQ ID NO: 18664 - DNA, 201 bp, Homo sapiens
tctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaat

SEQ ID NO: 18665 - DNA, 201 bp, Homo sapiens
attaccagatattagtttttcctgtgcttgaacttcatataaatggactcacacacgggtatgtatcatatttagcactgcatactgtttctgagattcayccacgctgttgcatttatcaataattcattctttttgattgctgagtactattccattatataaatacaccacagtttgtttatccattttcctgttaaa

SEQ ID NO: 18666 - DNA, 201 bp, Homo sapiens
ggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagata

SEQ ID NO: 18667 - DNA, 201 bp, Homo sapiens
aggagaatcacttgaacccaggaggcagaggttacagtgagctgagatggtgccactgcactccagcctggacgacagagtgagactccatctcaaaaaaaaaaaaaaaaaaaaaaagatagtccaagatccaggattcttttaggttctgtgtcactatgtgatctcaggttaatgatttattgtttctgattctgtttc

SEQ ID NO: 18668 - DNA, 201 bp, Homo sapiens
atagtctcctttaaaaacaatgccctcatttcatttcctctctctggctggactcttctcctccctcctgctttcctaaaatccatcttgtttccctgtaytgtttgctgaatgggcagtttaatgaatacagcatttccattttgaaatgtacagagcacaaggcagaaactgaatttcctcctggacagtttccatcca

SEQ ID NO: 18669 - DNA, 201 bp, Homo sapiens
agagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatt

SEQ ID NO: 18670 - DNA, 201 bp, Homo sapiens
ctggccacatgccatttttctaattcattatttcactttttatgtttattaatttctttttttctattttcctgtttttcattttattctaacttcttgartgcttatattatctctttcattctttcttgtttattaatatttcagctatatcacctagataattgtatattgttctttcttcgattgttatttcccaga

SEQ ID NO: 18671 - DNA, 201 bp, Homo sapiens
gttcagactccacgttgaagtaccaaatacacagattactcagaatttcacgtattttccatcttgcttatttctgcccaatacctcatatggcattaagmagaactaaattaaaactttccatttctacatttgcaaaggcctttcctctaaaatgttctaagaaaggagacctcaggacacaagtagaaatggtactgt

SEQ ID NO: 18672 - DNA, 201 bp, Homo sapiens
tggagtgcctggtaagaccaaaagatgaagttgtgttccttatatattgccaacaatttaaaataaaatttctgttttaatagagcacaatgaatactagyaggccaggttgtccacggaaaccttaagcttttgttcaaggtataatctgatgatttccaaaactgggataatagtcctcaccttgtatttgtttaccca

SEQ ID NO: 18673 - DNA, 201 bp, Homo sapiens
gcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttc

SEQ ID NO: 18674 - DNA, 201 bp, Homo sapiens
aacactgtacagtgatgtttgaagggattgatgctccatggtaagcagacttcgccctactgggaacatgaaaaggaacctctctgatttgtggctgtaaycctcaagccctcgtttaaatagccagggcagtttcatttaatcaacaagcatgtgttgagtgcctgctgtaaaccaaacgctgagacactgaggagagag

SEQ ID NO: 18675 - DNA, 201 bp, Homo sapiens
ttaatcaacaagcatgtgttgagtgcctgctgtaaaccaaacgctgagacactgaggagagaggatgaaaaagactcaacaggtctctgatcttgtggagyttacattgtgatggaggggtgggacactgggaagatacagactataactaagaaatagattaagaatagagaaaaacagtagacattgataaaggctata

SEQ ID NO: 18676 - DNA, 201 bp, Homo sapiens
tagtgctaatgaatagatgtcttatgaaccttttttttgcaccaacaacacattggaaaaatgtactttcaagaataaattgcaatctggtgaaatttttytattagttaacaaaatttagcttttaaaaacaagtatcagtatagtggctttagtggctttagaaaccaggaccctatgcatataaatagttgtaataaa

SEQ ID NO: 18677 - DNA, 201 bp, Homo sapiens
gagggattaatcaaagcagtgttttagaatgtaaatccctaaagcttgtgcatgcctagagcatccaggtcacactcaagtagaaggctcaaagtaagaasacttaaagggaacgaggagcttgaggaagtagcaaagggttgaaaacaattgctttagaaaatcagataatgacattatgatgttgctccattgtatgta

SEQ ID NO: 18678 - DNA, 201 bp, Homo sapiens
cacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtac

SEQ ID NO: 18679 - DNA, 201 bp, Homo sapiens
atctaatcaggaaattgatttaaacaaagcactccatgccatacaagatttgattgagctgttttttcttttttcccaagatgaaagagtgcctaggagcrtggttatttttgcccctatatccaatttagcacctctttcaagttaggtttgaagttggaagaattacaacatatttctataaaataatctgtttaatga

SEQ ID NO: 18680 - DNA, 201 bp, Homo sapiens
catgtcctgccctagatctgaaatcagctatctcttcaaagaatccaatttattttcctaggtcatagtatttagaggccacagtctgaacagtaagtgtrtgtgttgctactggattgttcattgtttctaggtcttttcagcagacaggactaggaaacactttttttctccaacatgaaattatattactaattatat

SEQ ID NO: 18681 - DNA, 201 bp, Homo sapiens
gtttatcttctcaaatttcttcataagaactgagaaacaaatgtctgctcatgactcattggacagaattgaatcacatgttcatgctaaaaccagccaaygttaagagaaatagatttcccaagactagcttatgctaatcacaaatcattctgtggagctggggagaacctcctagttctacaatacagaagcagaaaa

SEQ ID NO: 18682 - DNA, 201 bp, Homo sapiens
agaaaaggataaatttgtgtaggtctccagtggtgtctgctacctctgtctctataaaatgaagaaatcagcagaaatatactgccaccaattttcttgcycccttgctgtgtcaagttttgttaattacacattgttacatgtcaaggcttctaacctattcattctatcctgtaaccataatgtatttgttttggtctt

SEQ ID NO: 18683 - DNA, 201 bp, Homo sapiens
tatttccttgaggacttttctctagatgggaaaaattatgtattgaaacctgttccttccattgttttgattacactttttggggacactagttgtacatrtgcttgatttccattttctctctcttcctggccttttggctaacatcaagtgtaattgatttccattttctgtatatatccttttttctataatcattaa

SEQ ID NO: 18684 - DNA, 201 bp, Homo sapiens
tagtcttagttattgctgccacacagttttaccaccttacagagatgactcattatcacacagttcagatactgtgggacctgcaagtccaccagaggtgwtggtgttgacctaaactatttggtcaaaattatgcccatagccaagccaaggtttccaaagagatagaaggtacatgggcttagtggcgcacctaaaact

SEQ ID NO: 18685 - DNA, 201 bp, Homo sapiens
aggaggctccgaagagatctgaggtaggacttctgccagcctcaaaatgtgccacacacatttaactgggaagatgctctgaataacatactcttggccaygtgaatgcgttccttggcagccctggccctgcaaagtttggcaggaggggattttcgggttgccagctaaagccctgacactcagagcaggcctcagtgt

SEQ ID NO: 18686 - DNA, 201 bp, Homo sapiens
cgagcgcagcgctggtgggctggcacttttgggggaccaagtacaccctccgcagccactggcctgggtgctaagttcctcattgcccagggctggcaggrctggccggctgctccaagtgcgggcccgccaagcccacgcccacccggaactccagctgttccgcaagcaccgcacgcagtcccggttgccactcgcgcc

SEQ ID NO: 18687 - DNA, 201 bp, Homo sapiens
ctgacttcttttggaagcagaagtcctccttctactactttcaattctcatctgcacctagtacaggtgataagcattctatcagaattaggacaataatyttctaacaggtcttctgatctccttactttcagcctccatactacctccagagtgaactttttgaaacacaaaaacacaaatctcctgtcattctcctgt

SEQ ID NO: 18688 - DNA, 201 bp, Homo sapiens
aactaaccttaaaatcttagtggcttaacacaacacagatttatttctctctcatgcaaatttctttgatgcttggacaattttccagtgtactcctctcygtatagtgacttagagatccaggcagcttccattttgtgttccatcaaatcatctattttcttgatttccctggcgcaggaagaggaagctagagggcct

SEQ ID NO: 18689 - DNA, 201 bp, Homo sapiens
aagggttcttatgtttaaatctttaatctgtctcagatttattttggtgtaaggtgtgttatatatatctagcttaatttttcttcaattagttatcaatrtttttttgtttttatatcactttttgaagttcattttttccgatgggattcaaatatacttatcacattaaaattttctaactatatttgtgtctatttc

SEQ ID NO: 18690 - DNA, 201 bp, Homo sapiens
atatctagcttaatttttcttcaattagttatcaatatttttttgtttttatatcactttttgaagttcattttttccgatgggattcaaatatacttatsacattaaaattttctaactatatttgtgtctatttctgggttctctgttctgtttcattgatctatttttctgtttacaaaccagcaactcaccatttta

SEQ ID NO: 18691 - DNA, 201 bp, Homo sapiens
tcacatatttcttgttatacatttttctagttactctataattttggttgctacttttaatgcaatctattcttactttggatctcctatttgcattgttygtatgtatgaaaagtagtggtgtcacaatattatttttgtattcattcacttaactgaattctgtcattatttatagttttccagttgattctcttgtgc

SEQ ID NO: 18692 - DNA, 201 bp, Homo sapiens
ttccaatcctaccaaagataagacactgatgacatctcatctcctgcctaacttgtgactattctcagtattggtgaagaggtgaaatttgtagatgaggkattttaatccttcactttgtatttgatacatgactttatgtattatggtgctgatttttcagcacatctttattttcccttttccagttttaacaatgaa

SEQ ID NO: 18693 - DNA, 201 bp, Homo sapiens
agattgtcccccacatagctgtctgtctagtgtccccggcctctgccaactagttaccagtagaatctccataccatggtgacaagtaaaagtgctccccycacatattcaaaatggcccctaggggcagcatcatccatattaaaaacaactggcttagattaatgggactggacactttgtactccaaacaaaatggag

SEQ ID NO: 18694 - DNA, 201 bp, Homo sapiens
catgagaatgtttgagtatatatatattattacagttatttgcctcttagactgcatttgggtattcctctttgagtttctatttcgtgtaaatgcatatrgtttcctataaaaaacacaatttataatcctccaggaagtctgtgtaagtcagtcagtcaaattacctggttgattatagtttcaggtttatctgctgcc

SEQ ID NO: 18695 - DNA, 201 bp, Homo sapiens
attacactctagtgaacacccaacttgctaagtcgtcccccatacacaccttactgtttctctctttgttatcatttccttatgctgagcacttgcctggrgtagctccctcccccagccttccctggggctctcatttcctccctcactcatttggttaactcttatttaccattgaagattcagtttggaattcacctt

SEQ ID NO: 18696 - DNA, 201 bp, Homo sapiens
actctggatggatggaggctccacaagagcttcattccaaattaagatgttcaggctacattgaagaaagcaatctatttgccttggaaaaatttattagygctaagagctaatatatgaaatatacaatctgtatctggatgtttgcatttctctaaatcttgccctcaacatatatatcattttcaataaatggttttg

SEQ ID NO: 18697 - DNA, 201 bp, Homo sapiens
cctttgggtagggctagactatttcctgttcagaggtgaagacttctgaaatcagaatcaattttctaaaacataccacattaaaataagaccatagacaygtttttctgtctataagtctttttattttgatggtagaaaatgttgtaagattatttcattatcttcttattgttaactgttttggggaagaatcaaatc

SEQ ID NO: 18698 - DNA, 201 bp, Homo sapiens
gcttatatgctggtggtggaaatgtaaattggttcagccactgtggaaagcagtttggaaatttcccaagaaacttaaaacagaactgccattcaacccarcaatcccattatttggtatatacccaaaagaaaataaatcattttaccaaaaaagacacatgcactcatatgtttaccatagcactattcacaatagcaa

SEQ ID NO: 18699 - DNA, 201 bp, Homo sapiens
tttctggatcagctacctgtaaaaggtttgtgtgagaggggcaccccattgtgttctaggctaataacaattgtccttatgatttaatgagtatttttttwaatttagcttttactctcttccccattgccttgccttcagacagatttctgaaaatatagcttatacatgtgatttgttattcagtctcagttacttgct

SEQ ID NO: 18700 - DNA, 201 bp, Homo sapiens
gttgacaagatgttgtcttagtctattttgtgctgctataacggaataccatggactggatagtttataactaacagaaattaattggtttacaattctasagcctagaaagtccaagattgaggggccacatctggtgagggccttttagctgcatcaaaactttgcaaaaggcatcacatagtggaagggcaagagagg

SEQ ID NO: 18701 - DNA, 201 bp, Homo sapiens
gactggtatggcccacaaacccatgctttgagtagcactgtttaaagcatggactctagagctagaaagcctttgtgtatctttggcaaactgcttaatckcttggtgcctcagtttcctcatttgtaaaataaaggtaataataaactaccttatagagttgttgtgaggattaaatgcattaatgagtgtagcatactt

SEQ ID NO: 18702 - DNA, 201 bp, Homo sapiens
ttttccaaacctaaaagagtgcctcaatcaatgtttgttgagttttaaataaatatctttatttcagtaatatttaaaaatgtatcctaaatctacttgtygtctgtattttcaaacatagggaaataagcaccaatagctaattggaggaataggatgggggatggggcacagcatgaggagaggagtgagagtatgtct

SEQ ID NO: 18703 - DNA, 201 bp, Homo sapiens
aattctgtcattatttatagttttccagttgattctcttgtgctgtccaggtaaataatcatatagtttccaaataatgatattttagttttatcttttawaattttacctgcattttactgtctagttatgttattcaggacctccaaaaaattaatggtggtcatagtagacactcttgtcttcaacttattgttaata

SEQ ID NO: 18704 - DNA, 201 bp, Homo sapiens
tttccaaacctaaaagagtgcctcaatcaatgtttgttgagttttaaataaatatctttatttcagtaatatttaaaaatgtatcctaaatctacttgttrtctgtattttcaaacatagggaaataagcaccaatagctaattggaggaataggatgggggatggggcacagcatgaggagaggagtgagagtatgtctc

SEQ ID NO: 18705 - DNA, 201 bp, Homo sapiens
ggtgtttcttaaaaatttgtcagtattccgctagtgaaaccaactatgtgttgaactattttgttgggagtaaattgacaatttgtcctccttttaaaacmgatagtgatatgttagattttcaaatttatctgggatgtgatttcttagaaaagcatcttaattctcaaatttactcacactgaattgatcaaactggtg

SEQ ID NO: 18706 - DNA, 201 bp, Homo sapiens
gttagaaagttatacgactagttacattgatgtcatagtgctaaaaataatgttctttgcggggtctttagaggtttcaagactagtgaaataatgattgsaccatattcttttggatgattaagcttcccaggagggaagtcctaaaatggctagcttacttcccataatacctccatcaccccttggaataacatattc

SEQ ID NO: 18707 - DNA, 201 bp, Homo sapiens
cttgtagcccaggtgagttacctcttttttggtatttccacatacatcgttctgtgcatgctctgtatcataatgtcttggaagtattgatagttttggtkcgtgctttggtagagtagactaactgttgtaacaaacagcttcaaatctcagtcacttcacacaataggagtcttttgcatgttcacataatggtttcaa

SEQ ID NO: 18708 - DNA, 201 bp, Homo sapiens
tttatatttagtgctaagtgaatgattgggggaaagggataaagaaaggaaattactatttattaagcaccaactttgtactattctaaagggttaaagastttgtctcaattaattctttatgtaacccaatagaagtagatactgtattggtatctcttttactgaaggagagacaggttcagaatgattaatggctta

SEQ ID NO: 18709 - DNA, 201 bp, Homo sapiens
ggttaaagagtttgtctcaattaattctttatgtaacccaatagaagtagatactgtattggtatctcttttactgaaggagagacaggttcagaatgatwaatggcttatcatgctacacatctaatgaaagaactaggattcaaactcagtctctggctctaacttccatgctgttagattgtaccaagcaacctggag

SEQ ID NO: 18710 - DNA, 201 bp, Homo sapiens
ttgtattcaaagggggaaggagtaggggtccaagttgataggcaaggattaaaatctatgggatgaatctgtatttagttcagcccaaaatttaaaaatcwtaagtttcaaataacaataaggatttgtggttttagagaaaaaccagatttggtgatatatcttgtatgttccattgggcaaacttcagctgagcagatt

SEQ ID NO: 18711 - DNA, 201 bp, Homo sapiens
cactttactgtgaaaattgcatcaccacactgggtatgaactcattgaggtgggaatgagttgttgatagggcttggctttggaaatactactggctgatrttttatatcacttggcctttgtgtactgtattgacagagtatagtgaagaggaggaggaagaggagcaatttagtttgaagatgactaagagctgattaa

SEQ ID NO: 18712 - DNA, 201 bp, Homo sapiens
gagaaaagtgaagactttatgaagacagtggagttgagcagagccatagagctatagacttccaataggtggaggagagaggagcgggcaaaccaggcaargagagatgagagaagtaacacaggaggtaatgagcatgttgcagtgggaaagtgggcttggctctggtcagaggaatcatgcaatggattaatagaatcc

SEQ ID NO: 18713 - DNA, 201 bp, Homo sapiens
attaatgttgcattcttcacctttagacaatctcagatttttgatgtcctggtggtttggttcttaagcatgaccttaagataattagctatcaagcttcrtttaaattgttttgaaatatcattgcaatttggggagcatatgtgcctgctggtgaaaaataaggaaaataccactgggactcaaaaactgtacaagtga

SEQ ID NO: 18714 - DNA, 201 bp, Homo sapiens
cttttgattgtggttttcttagtgggaaaatagctcatataatggcccccgaatgtatgcctgggaagaaatatgttaaaaaatgaaatctagtgattgaytgtttattggataatttcaaaatagtacaagggaaaaaattattttagtactcctaagtattagaaataattttacagttcaatttgtgtgattaaatta

SEQ ID NO: 18715 - DNA, 201 bp, Homo sapiens
atctgaccagttgggatggtatttctcctttagtgccaaaagtataatagtttttttttctcttgtggcagtaaaattaaaggcctggatttattcagcawcttttctttatgagaataggaatatattcccagacattgttctacacttttcctgcgtggtgttctaccaccaatgtggagttatagatttagacctctg

SEQ ID NO: 18716 - DNA, 201 bp, Homo sapiens
ctgagaactgatctttcataggccagggaaggagttcagttccaaagtctagcagactttcctaaaatcattcatttttaagttatcagtaatgctaacaktaacttaaaagttggtttttataatttaggttgactaacttctgcctgacacaaccttgctactttgctccatagcatactaaagaatagtggtgctaaa

SEQ ID NO: 18717 - DNA, 201 bp, Homo sapiens
atccctgagggtgaagtctacaggactaattggattcttgtgcccttgtgaagcaggtgtgggaagtgtttctaaaatatttctgccgatccacatgtaakgaatacttttaatttcactgagagtcttttcctaacattcactggcctacataacaaactaccaatttcatcaacagaaaatctgtttctgactttcagt

SEQ ID NO: 18718 - DNA, 201 bp, Homo sapiens
gatttagtacaaactctatgactttcagattaggaaaattgaccaaggagaacttgtccaaggggacacagcaaatatgtggtacaaacacatctggaacrtaactctagatttctggactcccatttcttttaacctctaagagattccattatgcctgggcatgccttagttgaatggtgtataaatttgagggctata

SEQ ID NO: 18719 - DNA, 201 bp, Homo sapiens
tgttaacacatttttattgagcacctactatgtgtcaggcactctgccaggtgcttaggatacctcagtgaggaaacagtgctccctgctcttgcggcackgcgtctagagctgctccttgggagccactggccacatgtggctaataaaatatgtttaagtttaggaaaattaggtaaaatttaaaattaaattcttcag

SEQ ID NO: 18720 - DNA, 201 bp, Homo sapiens
gcaagtgagtgagcatagagaagagaagagccctggcagttccatcattaagagcttggggataaagagagagaatcagcaaagagccgagaaagagaggscagtataggaagaaaacgaaagagagtggaatactagaagccagtgaaaaagcgtattgggatagagggagtgattctcgtgtcacatgctgcaggaata

SEQ ID NO: 18721 - DNA, 201 bp, Homo sapiens
atgcactgtttttaagtatataaagtactaatattccatgttgtatagctctttcactggcatagtttctccatgaggaaactgaggcacagagagacaawcatttgtcaagggacacataacaactctgctgccattttctcctgacttatgatataacaggcagctcctactggccttttgaatgtttttcttgattta

SEQ ID NO: 18722 - DNA, 201 bp, Homo sapiens
ctcctttcttctcataaattttatttttaagtgtcaaaacacgcaatttcttttcagatactgaaacctgtgatattatgtgccctttgcctactgcaatygctttctgaatagtcaagtgattcagcgattacctctgtgcacccaaatcctacctgattggaaggaagtcaccggggaggggatggtgagatgacgcac

SEQ ID NO: 18723 - DNA, 201 bp, Homo sapiens
tgccactttagactaaggactgtcatatatatacatatatatacacacatatatatacacacatacatatatatgcacatatatatatatagtttctttargtcttaccaaagtattaaatactttttgaacaaataacgtattttggggggcattattctgtccacttacctaaatcaaggatgatataaacaataaata

SEQ ID NO: 18724 - DNA, 201 bp, Homo sapiens
gagtttattttgatgcaaaaaagttgaaatctatttttttataatacacatttttcatgaacttcttgaagacccctcctatttgccagacactgttcttycattgactaataaataaattctctctcctttcttttttcatttttcagctcttgggttttacagttttaaaaattaatttttaattagacaagtaaaaat

SEQ ID NO: 18725 - DNA, 201 bp, Homo sapiens
cctagtctacccaaatgagaaggaaccagaaaaacatctgggtaatatgagaaaacaagtttcttttacatcccccaaaagatgataccagttcaccagcratggatccaaaccaagatgaaatctccaaattgccagaaatagaattcagaaagttgattattaagttaatcaaggaggcaccagagaaaggtgaagtcc

SEQ ID NO: 18726 - DNA, 201 bp, Homo sapiens
ggtgttataggagtcttttaattttttttgtttctgggatcttcctcattgtttcttgttctttgtatttgtattttctatccttataattaaaaatgttytggcgagttaaaggttttgtttcgtgttatttctcctcctccacccatgaaacatctgttgggtttacttattctttcacattccatttttcttttcttt

SEQ ID NO: 18727 - DNA, 201 bp, Homo sapiens
agtcttccctgatcacctaatacaaagaagttttctgtccccctcattcttcagttagctaaaaataatagaaaacccaaaacaatagttgcttacacacmatagaagtttctttctctgtcatatgaaattatagataactatgcaccagagtgttagcaacccagattccactgtccagatgttcctttccaagcctac

SEQ ID NO: 18728 - DNA, 201 bp, Homo sapiens
ttggagactcacatagtgaacttttgctctaagaactacctcaagaacatatcaggaaagccaagagaatccacagaccctttgaaggaactggatcaccrctgcaggcttcctgagatgccaaaaaaaactatgagtctgtttgctttctcaaaggagaggctcttggtctggggcaagttctcagccctagttacctgt

SEQ ID NO: 18729 - DNA, 201 bp, Homo sapiens
gtagccatatgtagtttcttttgacatcttcttgcaactccgtttgagctgtgatacaaagtttacatgcccagtgcaggggaaatgatgtgtgtctgccrcttttgagtgctatgattgttcacttctttagattctcatagtctgtcctgataattgcaggaattagaaaaggctggcctagagtcctttcctcaccta

SEQ ID NO: 18730 - DNA, 201 bp, Homo sapiens
attattgtgattcccatttcacaggataaaaaaaagttaagtagcttattcaggatcaaaaggctggtgagctttatagccagcattcaagccagggtatrtagtgataggcatttcttgttattgacaaagaaatcctctgctttaagcatatatcgaataatgcataatgtaataaataccctgttttttcaaaaaaaa

SEQ ID NO: 18731 - DNA, 201 bp, Homo sapiens
agacatttaattcaaaaattgcaatgaaattgtggtaagttctctgaatgtaggatgtacaaattactttgggcacctggtaaagaaacagaccaacatgscttggctgggtcagagcaacttcactaagatgttatttgaactttctttcataaagataaatagaaattcctgagatgaacagtgcagaatgaagtattc

SEQ ID NO: 18732 - DNA, 201 bp, Homo sapiens
aagtttcttctttataggaaacttcctagatttcttcctttagtcagaattaatgctgatttatgttctctcatgaaattgtactttgtactttcatttastgctgtgactgttctttttaaagttattgtttacttatttttttctcctccagattatacaatccttaaggatagtactggaatttcctcatcttcctat

SEQ ID NO: 18733 - DNA, 201 bp, Homo sapiens
cgtgttaacttgaagagctggtccagtggggatctctgatatttggaaatatttttctaagattcatccttctggtatcttcttctttgtcttcccctctyaccactcttatagattcacttttttgctcaagccttcagcttaaattatattcaattaatctaacagaagagttatttgtgctttgtaaatataatcagt

SEQ ID NO: 18734 - DNA, 201 bp, Homo sapiens
cagaggtgaagacttctgaaatcagaatcaattttctaaaacataccacattaaaataagaccatagacacgtttttctgtctataagtctttttattttratggtagaaaatgttgtaagattatttcattatcttcttattgttaactgttttggggaagaatcaaatcaggagagactgagattggagtctttttatc

SEQ ID NO: 18735 - DNA, 201 bp, Homo sapiens
attcttacagattaaggaaaagaattgctgacaacttaggctgacttttatatacctatttgttttccttcctaattcctcttaaaatgaaaatgccaagmttttcttttgatatttgttacatttgtgaaataatataacaatgcagttaatgggaagagcatgacccctggattcagatatccaatagttacaaatctc

SEQ ID NO: 18736 - DNA, 201 bp, Homo sapiens
aatatagctattactgttattatcatcatcaattattctacctatagaaatatgcaagttccttggaagtatacatttctggagagtgatcagggatgggrtattatacttttattttttcggtttctcttcattcattcagtgggttatgggtatgtgtgtgtgtgtgtgtgtgtttcacacattatgtgctaggcacta

SEQ ID NO: 18737 - DNA, 201 bp, Homo sapiens
ttcggtttctcttcattcattcagtgggttatgggtatgtgtgtgtgtgtgtgtgtgtttcacacattatgtgctaggcactatttcaggcacttggaacktacattattgtaggggtacaactggaaactgataaatgctgtaaaaaaaattaaacaagctaagaggtacaggaggttgggagagagttgcaattattaa

SEQ ID NO: 18738 - DNA, 201 bp, Homo sapiens
tcgtgctgataggcttataataaaaactagcagcccctttctctcactccttgtgcacctttacctgttccccaagaacaacactttcaactcttttagcygttcacatcaatttgtctaaaatctaaataatgtactttacagcttgagatatcaattttaaacattatacattgatttcctattattgtaggtaaggat

SEQ ID NO: 18739 - DNA, 201 bp, Homo sapiens
actagtgatttgcattggcaactgtggtgtctagattaggttttggcactttaggactccactctcttgtttgttaaaaacaaaacaaaacaaaacaaaamaaaacttgaatggaagcatagaccataatgaagtaccaccctcgtgtgactttaatttcacagtggcctatgaaaatttatagaaatttggcttcatttc

SEQ ID NO: 18740 - DNA, 201 bp, Homo sapiens
tatgttttaaatttatccaggggataatgcatagctaaagatgacaattcgtgctgataggcttataataaaaactagcagcccctttctctcactccttstgcacctttacctgttccccaagaacaacactttcaactcttttagctgttcacatcaatttgtctaaaatctaaataatgtactttacagcttgagata

SEQ ID NO: 18741 - DNA, 201 bp, Homo sapiens
agtgttcatcagggttctctttcttttttttcctccttttacacattgcactctttggaaggaaatcactacactgtgtgtagcccacactaaagagttgkaaggtgagagacagacaggtacaaagaaagaggcagttattaattccaggatttaaaaaaacaagatggcattatactccacctctttaagggtgtagtt

SEQ ID NO: 18742 - DNA, 201 bp, Homo sapiens
gctgaagtatttaggcagaggagttcttgagagccagagggctgagatagtgctggctctgacagcttcatgagggacattaacatcttctggctaggagrgcttgggcctatttgtcagctcagcctgactcattcttttattttttaaaatcagctgaattgaggtataacttatataaaataaatcaaccaatctaat

SEQ ID NO: 18743 - DNA, 201 bp, Homo sapiens
acagtaggatgaggcatgagttttgctgggtagattatgttttagtgttttttattatattctttttaaattgctcttacattaattcagcatctatttayttattgggtattggtatgtgtgaggcactaaggttatagcaatagcatggggtgggcagtatgctctgagcataacctgtaaaatttgcatcctgtctct

SEQ ID NO: 18744 - DNA, 201 bp, Homo sapiens
acatgtgtggcaagcatgagacatttcattgtttatttttcaaatttctgaaatgtgctcatagctgtgcatgcctctgggctcataaagacagcaaatgsaaatagctgaagccagacagactgttttagatagatagccacccaggtaggcaaggaaaaccttgtaggttactctttcctccaatcaagtcatattaat

SEQ ID NO: 18745 - DNA, 201 bp, Homo sapiens
tgaccccccagaaccagatgaatgattcatttgtgatgtttttctcttattaggaagctttagctggacaaaggtcattcaggattattttaacatatgaratgcatttgttttattgaaagagattagaaatgttattttgaaagttttataccttactttagaagtcaagtcttataacattagtaggttttcacttca

SEQ ID NO: 18746 - DNA, 201 bp, Homo sapiens
ttgttatatatatcatgacagttaatacaatgctgagcgaatatttgatgattgtctgaaataacttgaaaaagtttagtgaaaaaattgggggatggagkggttgggaactgggcacagacaattcagccatctaaggaagcagtggcactttcttcactgagccctattaaattgaaagattgtgttctagcaccaggg

SEQ ID NO: 18747 - DNA, 201 bp, Homo sapiens
gaggccattggcggaaataaatatgttatttggtaatggacttgttttcttaacaattataatatattctttccaaatgctgtaatttaattctgccattstgctaattagtcagccgatcagccttcagcattgtttcaatatcccacccaccacatttttatattaaagctcatttaattggtgttgtgggttgaattc

SEQ ID NO: 18748 - DNA, 201 bp, Homo sapiens
aatgtgacttatcagaagaagaaatttggacacacaaagggacactaggggcatgcagagggggaccaccttgtgaagagacagagaacaggcggccatckgcaagccacagaaagagacctcagaagaaatcagccctgccaacagtttgatcttcaacttgaagcctccaaactgtgagaaatacatttctgttgttta

SEQ ID NO: 18749 - DNA, 201 bp, Homo sapiens
tcaaaacacaaaatacttaacagattagttactatggtatgttcaaagatcctcttgaggtcagttgattcccagaaaagaaacaacttatgctcttaaaraaatttttattcatgtgtacgccagacatctaaagtgtcaaatgttattatcagccactggggaaaatgaacaagcaaataaaactgaagcaaatgtaac

SEQ ID NO: 18750 - DNA, 201 bp, Homo sapiens
cttggaggaggattgagattttgtgtagaggagagtttggtaagagtccaagaaagtggcgttcgctctagactgggcgctgttgggaagtggggaccatsctatgactgtgtatcttaataaactgtgtctacagggacagaagcccagaaggagactaaagctttaattagtaaagatgcagccatcacttatatttct

SEQ ID NO: 18751 - DNA, 201 bp, Homo sapiens
gtctagattaggttttggcactttaggactccactctcttgtttgttaaaaacaaaacaaaacaaaacaaaaaaaaacttgaatggaagcatagaccatartgaagtaccaccctcgtgtgactttaatttcacagtggcctatgaaaatttatagaaatttggcttcatttctagtggctccaatccggatgccaaaatt

SEQ ID NO: 18752 - DNA, 201 bp, Homo sapiens
agaagaggggatgtctgatattttgtggtttgccagtgactttgttttttctgggcttaaatgaaattatgaactggctagttttgactgacttcagtacrgtcacagagtgaccttgtctgttgctggcgttccatgagattagttatttgttcatgaggagaacagatggcatggtttctttaacagcactgataccta

SEQ ID NO: 18753 - DNA, 201 bp, Homo sapiens
cagaagcaagagggaagattgttgtttataaccaaccttacatcaactactcaaggacggtgcaataccgaacgcagggggcggtggaagctgccaaggtkggggctttggcatctctcattcgatccgtggcctccttctccatctacaggtttgtcacaatgttcatttgaattcctttcaaaaacaagggttttccgt

SEQ ID NO: 18754 - DNA, 201 bp, Homo sapiens
agaagacctcacagttgtctgactgtgtcctccatcacagtcctcccagtattcaggacagatcttaggattcctctcttgagggtcacgtatccctgctktgtaattcacctcctctgtcctctatttcaggatgctcggctctaaatacactgcttgcctcaaccttccctttggattgtaagttccttaaaggaactt

SEQ ID NO: 18755 - DNA, 201 bp, Homo sapiens
gtgtcagttctctttatccatgacaggagacatgatgcttcttatgaagcctatgtttggattaaatgagagggaacaagtaaatcctagccattgtgtgkccggtctgtggggtttttttccccttctttccattcacatttatgatagatgaagagatattggtccagagaggttaaatgccttgcccaatatgataca

SEQ ID NO: 18756 - DNA, 201 bp, Homo sapiens
agcttcctagttgctcagaaatttccgagtactaggattactaaggtgaattccatgtgttttttgtcctcaagaaatatttttatgtagccaaaagagamgggggtaagaacatgtaagtgattagtgttatttattttatatttagtgctaagtgaatgattgggggaaagggataaagaaaggaaattactatttatt

SEQ ID NO: 18757 - DNA, 201 bp, Homo sapiens
gacatgagtcatgtcatcccccagaggagagctgggagtggacatctaagaaactctggtagccagcctgcctgtctgtgaatatatgggaacatttatasagggaggtgatataaaagctgaagacatgtttaacccagattacttaggcttttatttttcattaagtggaaaaactaatcaaatttcagactcatgaaa

SEQ ID NO: 18758 - DNA, 201 bp, Homo sapiens
gtgcctactttcattgtgatggggttatagaactgtgatagtcttaaactaggtcaggtacccaccactgaaaccaagactcaaggtcagtctcacccaawccatggatgactgtggggaagaggaggttcccaagaggttaccaggtttctgtttccaaaagagagggaaatagatgttaagctagtatgtgttcactca

SEQ ID NO: 18759 - DNA, 201 bp, Homo sapiens
ttcatataaacatagaatggattcaggatttgaggtgatgcattccttttccaataggtacttctgcataactacccagtagagaaggatcctttcacaaraggtgtgggaaaactatactacaagcctgcagtaaccaaaatggcatgttacgggtacaaaaacagacacataggccaatggaacaggttagagaagcca

SEQ ID NO: 18760 - DNA, 201 bp, Homo sapiens
tattttggagcccgcattctggagactccatgcctgtgtctttgttcagccacttgccagatgtgcctcattggtgcctcagtttcatctgtaaaatgggkgaaatatcttctttgtttttcttcctggagttttgagggttttctttttttgtttcattttgtttttgtttttctgaggcagagttttgctcttgttgcc

SEQ ID NO: 18761 - DNA, 201 bp, Homo sapiens
ctgccccatcacccaagtgtgatttttgtgattcttgtgtttctctagtgtctcaccaactgtatttctaaagcttggtcagtgttccatcttggatttcwtgttttgccacttgtgatggcaatttataataaaaccaagatatgacctgttttgtatccagcaatgaaacaagttggaatctgcctgtgatgtgcaatg

SEQ ID NO: 18762 - DNA, 201 bp, Homo sapiens
taaacaaccagtgtgagcctgttttctcatctgtaacatgtggagaacaatgtttacctcatagagttgttgagagaattaaatgaaatcaagcccttgayacagactgaaacatgggaagtgattgatgaaatataactgacgtcttatcttggccatggtcattattatcactgtcatcattagatagtgatgggacta

SEQ ID NO: 18763 - DNA, 201 bp, Homo sapiens
tgttaataaatgtgctgttgataggaaaatgttggcagaagtgccaatatgaatagtcttctagttgcttttctgatggttgtgacataatgaatctcaartgtgacttttgtcatataattggaggctctgaacattaagaacattttcttaaggatcatccaggcagaaaatgagttcacaggtttttaacatttttac

SEQ ID NO: 18764 - DNA, 201 bp, Homo sapiens
taagaaattgcctaactttttatttttatttttattttttgagacggagtttcactcttgttgcctaggcaggagtaaatggcgcgatctcggctcactgyaacctccgcctcctggattcaagcgattctcctgctttagcctcctgagtagctgggattacagtcatgcaccaccacacctggctattttgtattttta

SEQ ID NO: 18765 - DNA, 201 bp, Homo sapiens
tttatggcttcactaattggccagagctactactgtgctgtggagtatcagtgtttcctttgatgtgttgttcctagcctctctatgggcttatatctagyatcccaggtaaacctgagagttatcctgggcaatgtggatgctggtattccattttctcaattttagggttctcctcctgtatcctgtacaggtcatgag

SEQ ID NO: 18766 - DNA, 201 bp, Homo sapiens
cctcattgcatcacataaggaaacaaataatgtcacttttccttattggtgagaccaaatttgatcacttgtctaaggcattatctctggatttctttatygaaaggtagcattccacctttgtagaggaaatacattgcaattattgtgggatgctcttgagactttgtgaatcttaagttctttaacaaaatttcaccc

SEQ ID NO: 18767 - DNA, 201 bp, Homo sapiens
atggaaagacagggaactttgttccagaatacatcctgtgttccttggaaattatattaactcctctcagccttagttttccctcatgtaatgtggataakgatacttaccctttccaaaatcagaggtcttagaaaagtattttaaaaaataaactggataaaagaggtaatgctagttacttagaataggaatttatgt

SEQ ID NO: 18768 - DNA, 201 bp, Homo sapiens
gatgctcttgagactttgtgaatcttaagttctttaacaaaatttcacccagtgagattttaacatccgttgatgacccctgcctgaatcaatcattgtaytggaagttgcaaatgtttttctaattcaattatttctattacaattatttgctgtgtgcttttgtaataaagagcatctgcctccttttccttctttttg

SEQ ID NO: 18769 - DNA, 201 bp, Homo sapiens
ctttgccttctaggaggaaatactctttcctaggtgccacactgttgatacttctcaagaccaaaataccacaggcctccagctccttgataaagctttamtgtgttgaattggcataaatcaattccctaagtctgcctagcagaaccaaactctgaatatggtgacctcacagggtcacctagctcaaggcagccagca

SEQ ID NO: 18770 - DNA, 201 bp, Homo sapiens
gccacttcaggacttggatgagatactaagccatggggcacgcaatgtggccccacatgtgttggaagaagccagatgatacaccctggacatgaaggagmgttaactccttgtagggtgaaatttgaccagaggagggcaatggacaggagggaagtggctaaattccctcatcttgcactgtccaatcgacttctctga

SEQ ID NO: 18771 - DNA, 201 bp, Homo sapiens
ttccccctcaaaagcagagtgtgaaacaaggacttacatgtgagtagtttatttgaggaaattatcccaaggaacagaagtgggagactggaaatgattgktcacaataatctctgtcatttcatagccatagtttttcatcaacactttcctaatgagctcatctttgggatgccaagtgacattgctgtgtgctttctt

SEQ ID NO: 18772 - DNA, 201 bp, Homo sapiens
agatttgttataacatggtcattattatctgctgtggtctgaatgtgtctcccaagtttcctatgttggaaatgttggaaatcctcaatgcaacagtgtgrggaggtgaagtctctgggagctgtttaggtcatgagggatctgcccacatgaatggattgatgccattataaaagggctggaaggagggagttcacccca

SEQ ID NO: 18773 - DNA, 201 bp, Homo sapiens
accaccaaagtcttccccatttcaaagtgtttattatttcatgattctctgcttaataagtaccaaggttcagcttttattttcacaggttgttacctgtraagagggtacaaaatctgttttatcctaacaaatttaagttagaatttagtttgatcttacgagtctttagggaaatatattttaggagtcaaaatgtgt

SEQ ID NO: 18774 - DNA, 201 bp, Homo sapiens
tgcatgtgacattggtctcttaaagacagcataccaataggtcttggttctttatccatcttgtcactctgtgtcttctatttggggcatttaacccattyacatttaaggttagtatttatatctatggatttgatcctgtcatcatgttagctgattattttgcagacttgtttatgtggttgctttatagtgtcactg

SEQ ID NO: 18775 - DNA, 201 bp, Homo sapiens
tgtagccttctaaatatttgacctatatgaaaaattccagctttgatttcttagtccaaattgcaaatcagccaaacgtagctgattctgtcctatatgarttggttattactgtctttccctttcttagaacccctgggaacaaacaagaaaaagtaaggaaaacaaaatacttattaaaatgtaaatacagtggctggt

SEQ ID NO: 18776 - DNA, 201 bp, Homo sapiens
tggagaagtggcttcaaatttcattctaatcaagacactaagctttgcatttatttattccttcattaccatttattgggcacctaatgtgtgtcaaacartctaggaattggcgacattacaatgaataaaaagcatagatccctgtcttccagaagtttacttctggttattggaggttttgagccaagaaatgacatg

SEQ ID NO: 18777 - DNA, 201 bp, Homo sapiens
gtaactgagggctggaagaacgtacagcatccacctgccctcactgccatagctggcagtgttttttcccctccaaagctctggaaaatactttattatamctcacagagccaaatgagaggcaatcaaactgttttgtcatttgaattaggaaaggtcaaagggaaaggaacataatagtagacagacagaaaagtgctt

SEQ ID NO: 18778 - DNA, 201 bp, Homo sapiens
tttaaaagatggcattataatctcttgcatctatgtgatcatttataaattacgctttcgtggacatcaagtcattgatgatagtaatgaccctggtggtygccagaccatgtactgttttccttatttcacacatgaagaaacagaggctcaaagaagtgaagaatgtacccaagtttgcatagcacagcccataaggtg

SEQ ID NO: 18779 - DNA, 201 bp, Homo sapiens
caagaataagtacaaaacctgaataagccaataaccatgaaagaaattgaatcattagttaaaattgttatcataaagaaaacatcagactttgatggctytgttaaaagttctacaaaataaccaggaaataaataattctaatcttacacaaactatcccagaatgtataaaaaaaagaaggaaaaccatgttatgcat

SEQ ID NO: 18780 - DNA, 201 bp, Homo sapiens
aaactatgcagctctgatgttgaggagtatgaaaagagcttttttttttttttttttttgcaagagaaataaggatctcaatataggtttgcagaggccarcagggatgtatctttaggatgggtttacctcatatctgtgtaatacagagaactataaattatccacccactccaacctccccatgtcatcagtggttgt

SEQ ID NO: 18781 - DNA, 201 bp, Homo sapiens
aggctggcctaagaatacagtttcctggtctagtttgagttattagagatagtttgggaaagagagaacgtgaaaccacctagatggtcctcatagattcrttgaaggcagaagctttatatatattttttctcatcaaaattttaccatgtttaccatctcacaccagtcagaatgggtattactaaaaagtcaaagaat

SEQ ID NO: 18782 - DNA, 201 bp, Homo sapiens
aaactgtagttttgtatggcttttgtctgggaatgccatactttgtcagaataagatgtggtgtatattttaacatgtaatccaatatgttaacacaaatraaactgtgacttcatacatagatgcatttgctctttgagctctacaatcacaggaattctgataaattctattttgcatgacttccttaaaaatataaaa

SEQ ID NO: 18783 - DNA, 201 bp, Homo sapiens
tataatgcactgatttatcattttggtcatggcaaacattgggatatatttgtctgcaaataaaagaaaactcgactaatggtggttgtattagtcaggaytatccagagaaacaaaaccaataggatgtgcaagtaagcagaaattttaacatacggtagaattaaattggaaaggaaacaaggaaactcatatattttg

SEQ ID NO: 18784 - DNA, 201 bp, Homo sapiens
gaaatacgttatttaagcaaatatactgataatgatgcacagatgctgtttgtatacattactttcctcctttgaattcactaagtactgatttcttattkgtgccagcgatcttcagaattagttctgtccccttctgtatcattgtgtgagacaaatatctcatatacaacttttctaaagattagaagactaaaatat

SEQ ID NO: 18785 - DNA, 201 bp, Homo sapiens
gctgcccacttcttccagacagccagtctcatatgtcaacctctgccacatctgaaatttctctcccactgctctaatgcgtgggtggacttacagcctgraagctggaggagggaggaggtacagaggacacagagaacatctctttccttcctgaaggatggagggagaagaactttccccctgtctgctccaggcctg

SEQ ID NO: 18786 - DNA, 201 bp, Homo sapiens
cccagagcacttgacccattcagggatcctgtgtttgtcatttctcttcagaaatgattatattggcacctatctcagaattgatatacagattaaatacrgtcatggatgaaattatttagcccactatgtatcatcaatattcattagatagtaatcatttttattgctactaatagtaatcatcatcatcattagagg

SEQ ID NO: 18787 - DNA, 201 bp, Homo sapiens
atagtgtctatacagaagacataaatgtgcgtaaatgggtataaaataaatacaatgctgagtgatacttcgatatagaagaatatacaaaatatgggtgrtgatgatcataactaccatttataaaccacatgttgtctgtcaggcacagtacagtgctttatatatatatttttttggtatgattatcagaaggaatat

SEQ ID NO: 18788 - DNA, 201 bp, Homo sapiens
actttcaaaccatagaataaagaaaacgaaagggggaaaactgcaaacaaatgtgctatgagattagatggatttgaaggggactcgacagtcttgggccytttgttttggaagatggattttgaaagttatcttttattgtattcctgtgaggcccatttgtttcctacccttttctcttgtccccctcttccttctctt

SEQ ID NO: 18789 - DNA, 201 bp, Homo sapiens
atcctttagttggtctttagtgtgtttttatggtgtccagtttcagtattcatgttgatctcctttcaccctttgtcttcactgagtcactcttggctcastatggtaatcattagcactggtttctagatatttctggctcttcacctgcacataaaacagggctgtacatctcagtcccttggagtttgggtgaggaca

SEQ ID NO: 18790 - DNA, 201 bp, Homo sapiens
atacaatcatagtggaaggcaaacagcgagcaggcatcttacatggcaggaacaggagcaagagggcgaggggtaggtgctacacactcttaaatgacccrtgagaactcactcactatcttaaggacagtgccaagagggatagtgctaaaccattcacgagaaatccacctccataatccaatcacctcccaccaggcc

SEQ ID NO: 18791 - DNA, 201 bp, Homo sapiens
agatggcacggctggagaaattcttatcgggctcccagctcacgttccaggcggcctctctgtctctctcctctattcttatttgttcatggttgacccaratggaaacttgaaatgcaaatgtatttcttcttggaagtttccaagtaaaaaaggtgatagtgactcagcataagatgcttacatgcccccaaaagaata

SEQ ID NO: 18792 - DNA, 201 bp, Homo sapiens
tgactgattttgttggccctcactttccagaaagggaaccgtggacataaatgtcatgggaaggtatttagtagaaggtgtgatttttgggggcgcatatraaacattctaaaattcaaggccagggcgctgtgacaggctctaatctatgaatcattatattcttaacatattctgagaacaggaagagaaagctcaacc

SEQ ID NO: 18793 - DNA, 201 bp, Homo sapiens
gctatggttgttctagatcatcctatcacctagcctttacaatcaccacagagtagcacgttggtttctgacttttggaacaatgttaacctgctttttcrcagagttacgtatctcaataaatggaattactacctacatagttgtctcggcaaaatcttgggaattcttctttatcacccaccattcaccactgttgaa

SEQ ID NO: 18794 - DNA, 201 bp, Homo sapiens
ggagctctgtcccagggagagatcagagctctgttcataaaacagttgctggaggggcttaaggaggtcctctctagcgaggaggaatgacttggggtccygcttacagaagcagtctggctgctttttggtagggcaggtgtgctgcattgtagcagagggaacccttcctagtttagaccgtctgtattctccacatcc

SEQ ID NO: 18795 - DNA, 201 bp, Homo sapiens
aagacaagaaagacgtggaagagaggagcttgagctggacattgaaagatatgtagtataagaatggacaggccaggcacggtggcccacgcctgtaatcycaggactttgggaggctaaggcaggcagatcacctgaggtcaggagttcaagaccagcctgaccaacatggtgaaaccccctctctactaaaaatacaaa

SEQ ID NO: 18796 - DNA, 201 bp, Homo sapiens
aacatggtgaaaccccctctctactaaaaatacaaaattagccagatgtagtagcgggtgcctgtaatcctagctacccgggaggctgaggcaggagaatygcttgaatccgggaggcagaggttgcagtgagccaagattgtgccactgcactacagcctgggtgacaagagtgagactctgtctcaaaaaaaagaatgg

SEQ ID NO: 18797 - DNA, 201 bp, Homo sapiens
ttttttgttttcttttcttcaacttttaagttcaggggtacccattactgggtatatacccaaaagaatataaaccattctattataaagatacatgcacrcatatgttcattgcagcagtattcacaatagcaaagacatggaatcaacccaaatgtccatcaatgatagaccagataaagaatatgtggtacatataca

SEQ ID NO: 18798 - DNA, 201 bp, Homo sapiens
gagtctgttttccttctctgttgtctttacattctcaggattatgttgaaaacagcaaagagtgccatcttattagctcatataggctttacagtcagtgyagcctgattcaccaaagctacacacccaccctcacacacagaaaaccacttgggggctgacttacctggatttgtgtctaaattatcccatatatcaaat

SEQ ID NO: 18799 - DNA, 201 bp, Homo sapiens
gtgaagtagaaatcacagtgatgaaagcagtgtcatacatttcatgaaagtacagttaattttcaccaaatgagttgccaagctggtagtgggtaaaaatktaaatgttcatctttgatcaattgaattttaatgttgtgaatagctgtatgccttgatttatacatctgtagcacattttaaacatctgtgttcaagatg

SEQ ID NO: 18800 - DNA, 201 bp, Homo sapiens
atattttggatcttgctttagcatacacaggaaaccaatctccaggcagttcttccttataatttctttacaagtttccccttaaagaattcctaatgtaytttcctcaatagtaacatagatttttctagagttagaaaattatgagaaaatagagtgagcggctatctcaagtgtgtttacttgtctagtcccctgata

SEQ ID NO: 18801 - DNA, 201 bp, Homo sapiens
agactgcataggatggcctacctctagtgagaaacactgagtgccacactggttgtaaatggggtactagaaaggcctctctgaacttcaaggatgatagyactcagcttgcagggattttctgagaattagggattttctgagaatcacatgctaaagcacctactagtatgcatggcacataataatcgctcaacaagt

SEQ ID NO: 18802 - DNA, 201 bp, Homo sapiens
atttttctgaacatgatacatattattcattagcatttaagcttatatctaatgcacatttttagataggattttttagtagtaagacttttttatatgtytacctattattatccatggtagagtttcttgtgaccttgaccctgtgatatctggaaatgaaaaaagcccattttgtttcagactcttggtccctctagc

SEQ ID NO: 18803 - DNA, 201 bp, Homo sapiens
ttcaactggtagatagtgctatgaaaaagaaaaagaagcagcagcatgaaggtaagggagataatgagtgaccacatggaggggtggactttagactgaaygatcagggagtcccaggaggactggcaggcctgcagagtgtggcccggccacagcgatgggcttggtgtcaggtagggctgccattcatcttctgcccac

SEQ ID NO: 18804 - DNA, 201 bp, Homo sapiens; identical to SEQ ID NO: 3293

SEQ ID NO: 18805 - DNA, 201 bp, Homo sapiens; identical to SEQ ID NO: 3294

SEQ ID NO: 18806 - DNA, 201 bp, Homo sapiens; identical to SEQ ID NO: 3295

SEQ ID NO: 18807 - DNA, 201 bp, Homo sapiens; identical to SEQ ID NO: 3296

SEQ ID NO: 18808 - DNA, 201 bp, Homo sapiens; identical to SEQ ID NO: 3297

SEQ ID NO: 18809 - DNA, 201 bp, Homo sapiens; identical to SEQ ID NO: 3298

SEQ ID NO: 18810 - DNA, 201 bp, Homo sapiens; identical to SEQ ID NO: 3299

SEQ ID NO: 18811 - DNA, 201 bp, Homo sapiens; identical to SEQ ID NO: 3300

SEQ ID NO: 18812 - DNA, 201 bp, Homo sapiens; identical to SEQ ID NO: 3301

SEQ ID NO: 18813 - DNA, 201 bp, Homo sapiens
ctgcatgtgggcgtatttgtatgttcaggtgagtgtacttacagcagcgaggatgccatgcacctgtgtttgtattgtgagtctgtgtagagtctggcgtragcgtgtgtgacagtgagcttgggaggtgatctgtgggtgtgtgtttgcctagtgggaggatttgtgagggtggatatgggaggctccccgttcttactc

SEQ ID NO: 18814 - DNA, 201 bp, Homo sapiens
tgtggcttagttggggtaatgatcgtgctgctgtacgtcttggatttatcttaagggatagggcaccaaactttttttcttttttttaaaaatttatttgwgacagggtcctgctctgttgcccaagctggaatgcagtggtgcaatcatagctcacagcagtcttgaactcctgggctcaggggatcctctgaccttggc

SEQ ID NO: 18815 - DNA, 201 bp, Homo sapiens
tttgcaagcgtaagtgtctttgttgagtgctgaggttgacagtctatggatggggtagtgtgtgctgcatcgtgctggccttgggactggactcaggaccrgactggtgtccatagtgccatggccatgctgtaggcctcgggcaggctgtcgcttttctccgggctccagcttctgctggttccccagggttctgccagt

SEQ ID NO: 18816 - DNA, 201 bp, Homo sapiens
ccttgtgtctgtgtgtgtgcctgtgttggtctgggcatgagtgcatatgagtctatggttttatatgtgtacatctcagaatgtgtgtgtatgtacatttygtttttttttcttccaggttgaagcgattctcttgcctcagtctccccagtagctgggattacaagcacctgccaacacgcctggctaattttttaattt

SEQ ID NO: 18817 - DNA, 201 bp, Homo sapiens
gtgagtgtctgtggtatgcatatgtgtccttgtgtgtggatgcacacgtgctgcttgtgtctctacaagcagatacaaggatgcccttgtacacaacacaygtgctgcttgtatagacatgagtgttgtctacgagggcatccttgtgtctgtgtgtgtgcctgtgttggtctgggcatgagtgcatatgagtctatggtt

SEQ ID NO: 18818 - DNA, 201 bp, Homo sapiens
ccatcacagccgggctggtatgtcagctgccttcctgagctgcaaaaatgtgagcgccccgaggtacctcagacaggcccccgcccctagcagacagctcygtttgacctgcatcattcactaacctgtctcggggagcctgtctacatgcacacatctgtgtatgttggccaatgtaaatgctgcttcttgtgagtgtct

SEQ ID NO: 18819 - DNA, 201 bp, Homo sapiens
gacatagtctgatccactgtctggatgactccagctgctgtgcagcgaatggattgaatggtgggagggactgtgatgcttagcgacctctggctgtgacrcctgccccggccctgctgtgaggatgctccactctgtctgcttaggccttacttgccttccacactctccccagccctcttctgggccagcagctccagg

SEQ ID NO: 18820 - DNA, 201 bp, Homo sapiens
tgccaagttccaccgcaagtcacttccagcctccttcttcaaaggatttgttaataagtcaatgacggaacatctaaaggggaaaaatatttctctttatrgttgaagataattgtcccaggaaaaaaagaaaacaacaaacctttaattacaactcacatggagaaagcttgatttgtgggcagagcccaaatgctgagg

SEQ ID NO: 18821 - DNA, 201 bp, Homo sapiens
taggggctgcgatatgatgaggaaacaaggtcattcaggttctggctttctaaagctcatcgtacagtgggggcaacagatagtaaaaaaatcaacaaggrgggttgaaacagcaaaatgttctatgaagacaaaaaaaccaaaacccaaaccctggtgatgtaaaagagggtgagggggagaagggctccttcagatagg

SEQ ID NO: 18822 - DNA, 201 bp, Homo sapiens
aacacctgcacagtgtcaggccccatcctaggggctgcgatatgatgaggaaacaaggtcattcaggttctggctttctaaagctcatcgtacagtggggkcaacagatagtaaaaaaatcaacaaggagggttgaaacagcaaaatgttctatgaagacaaaaaaaccaaaacccaaaccctggtgatgtaaaagagggt

SEQ ID NO: 18823 - DNA, 201 bp, Homo sapiens
gtctaggatccctggcctgcagtcccatcctcacagcaaagcccctaggacttagaaatgactccaagtcccacgtggctctgggcttccaaaagcaagcrccaatcagagaaggtggagaggagatgggagaatggtttggaacctgtgtgggacggtcgtcccgtggagaggggcaggcagagaggtgggggccctgga

SEQ ID NO: 18824 - DNA, 201 bp, Homo sapiens
tgatagaggaacttgaaaagaagagagtgaaatggacacagagagacaaggctagataatcagacacagagaggtgaaagaatcatagagacagagagagrgggagagggagagacaaagagcaaacccacagaaacagagagagagagagagagagagatgggggtggtgtggggaagaggctgtgttccaggagaaaga

SEQ ID NO: 18825 - DNA, 201 bp, Homo sapiens
aatggattgaatggtgggagggactgtgatgcttagcgacctctggctgtgacgcctgccccggccctgctgtgaggatgctccactctgtctgcttaggmcttacttgccttccacactctccccagccctcttctgggccagcagctccaggctgtgccagagttcccagaaagcaccaagaatcttgaggcagaggac

SEQ ID NO: 18826 - DNA, 201 bp, Homo sapiens
ttaatatggaagtggactatgaaggtgagggtggaggagctgttttgttgttgctgttcaattgtatcatttgaggcttctttccacgtggcaggagaggygggctggtgggaggctcgggaggcctggacgccagcctctaagaggtcacgggatggtggacatgatcccatgatgggcctcagtctccggatctgggat

SEQ ID NO: 18827 - DNA, 201 bp, Homo sapiens
tgatccactgtctggatgactccagctgctgtgcagcgaatggattgaatggtgggagggactgtgatgcttagcgacctctggctgtgacgcctgccccrgccctgctgtgaggatgctccactctgtctgcttaggccttacttgccttccacactctccccagccctcttctgggccagcagctccaggctgtgccag

SEQ ID NO: 18828 - DNA, 201 bp, Homo sapiens
ggcacctggtaggtgagtgggtgtgggagggtgccttaaggtggggttgaggactctaccctgtgtttgggaagtgagccaaccagctgtgtctcaggtgstctctccacctgcccggcaagcccacctcgactctcctgcttcctgggggaagaggtggcctgggaggcatgtgggaggctttccatgactgctgagccc

SEQ ID NO: 18829 - DNA, 201 bp, Homo sapiens
gtgaactttgttctgagagcaataggaagcctttgaaaggtttgaagcagggcgtgacatagtctgatccactgtctggatgactccagctgctgtgcagmgaatggattgaatggtgggagggactgtgatgcttagcgacctctggctgtgacgcctgccccggccctgctgtgaggatgctccactctgtctgcttag

SEQ ID NO: 18830 - DNA, 201 bp, Homo sapiens
ttgctgtcttggaggcaggaaggccagggtgtggaggccgtctgtcccatcacaagccccctttcatgatgctcaacaaggctccttcagaggccggactyggctgtgcaaacacgcacatctgggctgctggctggggcggggtggcggaactcccccacagctggccagctgctcctgaccttctggacaaagggagct

SEQ ID NO: 18831 - DNA, 201 bp, Homo sapiens
caagctctaggtggaagcccagaaggcactggagcatttgctagtcattggctttccggggaaagaaataatccttgtttggggtccaattccttggggayacattactccctttctaggaaggacaggtccctagtttcctttgtctcttcccaaagaggcaccaagaactctggcagaggggtcagaattaccagaatt

SEQ ID NO: 18832 - DNA, 201 bp, Homo sapiens
tggatttttttttttttttttttttcctgagacgaagttaaactcagtcacccaggctggagtgcagtggcacaatcttggctcactgcaacctccgccayctgggttcgagcaattctcctgcctcagcctccagagtagctgggattataggcatgctccaccataccaggctaattttttgtatttttccttgcagtg

SEQ ID NO: 18833 - DNA, 201 bp, Homo sapiens
ccaggactaccccatgaggcagcagttatcatcttcatttacagatggaaaaactgaggttcacaaagatgaaagttctttcctggtctttctgactccaragctcttacctgtagtgaggtctgcctatttccacactgcacgtgggtctccctgagtggagggagaggcaggggcctcccagcatcttacagaagagga

SEQ ID NO: 18834 - DNA, 201 bp, Homo sapiens
aggctgtgatagaggagaccaaagagtgtgcccttcctcaccatggcccaggggaaggagagcagatccagaagatctgtgggccatggaaggaatatccytggtcttgcacaggacacagcatctgtacttattccatacatgggtacggtccacaaggtatgggcatgctccacgcttgtgagcgatgtctgtctgcct

SEQ ID NO: 18835 - DNA, 201 bp, Homo sapiens
ggacagagactctcccatgtgggcatagacttgtgtgcctggcatacaggctgcccagctgcatgccacatgcctggtgtgagtgcctctggcagcagctyttattctgggacagtgggaggagggccccttgccctttgtggaggtactctcaggctcctttcccattttggcacctagtgaatagggaaggagaaagag

SEQ ID NO: 18836 - DNA, 201 bp, Homo sapiens
agagaagtcagcaaatatgtgcgtagtgaattccaagccttctgttcccagctcctgggaggggccgcagtgccttggggtgtcctgccgtgtctccatcrggtcccctgcctggctgctctaaccctgaggaatggcctccactgtgggcctgtggaaacagggagaagaatctcttatccagcaggtctgagggccaca

SEQ ID NO: 18837 - DNA, 201 bp, Homo sapiens
gactcttccccagggactgactgccttggggaccaactgagcccagaaacaactgtgcccagggactgactgctgactgtgccctgtgccctgggggaccratgatgcccaggaatcagctacatccagtcactaactgtgtccatggaatgactatgcccaggaacaactgttctcagagaccctttgagggctcactgt

SEQ ID NO: 18838 - DNA, 201 bp, Homo sapiens
gagaccaaagagtgtgcccttcctcaccatggcccaggggaaggagagcagatccagaagatctgtgggccatggaaggaatatccttggtcttgcacagracacagcatctgtacttattccatacatgggtacggtccacaaggtatgggcatgctccacgcttgtgagcgatgtctgtctgcctgccaaaagaagctg

SEQ ID NO: 18839 - DNA, 201 bp, Homo sapiens
gaatgtttcccaccctgagctcaggagagcttgtatcaagagagaggcgagtgatacaggactagtgaagtgtgtggtggatttgaggagtgtttggttasgggcctggcagcaaacagaatctactcctaatggtttctatgcagcgactgtgatgaatgggctacctacaaaggcctgggtgaagattttaggaagcag

SEQ ID NO: 18840 - DNA, 201 bp, Homo sapiens
ctagcgagggggagagtgtaagtaaattattaacctgacaggatccagcccttggacccttgggggtgtaacagctggaaggccccagcctgtgaaccctrgcttggctcactctgcaaagtccctcctactcaaattcccctccaaaggtccctgtggaatcccctcgctgcttgccttccccgcaccctgtccagcccc

SEQ ID NO: 18841 - DNA, 201 bp, Homo sapiens
actcatagctatgcatctagttccaggactattgagttcttgtttttcttcttttctaaaccataagctccgtgagggtagcggctacacctgcttgattygcccgtgtatttccaggatctagtatagtatacagcacataaaggtgatggataaattttttatcgagtgactggatggaataatgaatgaatgaatgta

SEQ ID NO: 18842 - DNA, 201 bp, Homo sapiens
cctcccaaagtgctgggattacaggcgaaaccctgtctctactaaaaatacaaaaattagctgggcgtagtggcaggtgcctgtaatcccagctacttagraggctgaggcaggagaatcgcttgaacccaggaggtggaggttgcagtaagctgacattgcaccattgcactccagcctgggtgacagagcaagactctg

SEQ ID NO: 18843 - DNA, 201 bp, Homo sapiens
gtttatcgtggtaaataaaaccgacagaaactttgtcctcttggacaaagcttatgttctggtaggggagacatctaataaacaagataaagaatgaaaasgtaaagcatttagggatatgtgctcaggggaaaaataaagcagggaagaggctagaaagtgtccagggagattttgatgggttggtcaggagcctgtcgg

SEQ ID NO: 18844 - DNA, 201 bp, Homo sapiens
tttgcttcagacactagcgagggggagagtgtaagtaaattattaacctgacaggatccagcccttggacccttgggggtgtaacagctggaaggccccakcctgtgaaccctggcttggctcactctgcaaagtccctcctactcaaattcccctccaaaggtccctgtggaatcccctcgctgcttgccttccccgcac

SEQ ID NO: 18845 - DNA, 201 bp, Homo sapiens
tgggaagctgaggtgggaggatcactggagctcaggagttcaagaccagcctgggaaacatagtcagatcccatctctacaaaataataaaaataaaaatrgaaacattgagaaaagttaagtgaattacccaagttcacaaagtaaggaagaggcagtgtagggatctgaattctgatcacctgactctagaggctgtgc

SEQ ID NO: 18846 - DNA, 201 bp, Homo sapiens
agcacactgcctggcacaaaattagcattgagtgtttgttattaatataataatggctgacatatattgagtactgtgtttgtcatattccatggtgctargtgctttatgcaggatatctaaatgctcaaaacaatccttgcagtaagtgttagtaccctcattttcagttggggagattgaggcttaagagaagttaag

SEQ ID NO: 18847 - DNA, 201 bp, Homo sapiens
accccatctctactaaaaatacaaaaattagccaggcgtggtggcgggcgcttataatctcagctactcaggaggctgaggcaggagaatcacttgaaccrggggggtggaggctgcagtgagccgagatcacaccacttcactccagcctgggcaaaagagcaaaactccgtcttgggaaaagaaaagaaaagaaaactg

SEQ ID NO: 18848 - DNA, 201 bp, Homo sapiens
aaaagattgataaatttgactatatgaaaattaaacatttaagtaccttaaagaacattataagaaaattttaaaagaggggtatatacatatgtatgtgkatatatatatatatatatatatatatatatatatgacaacagtttaattttatttctaatgtacaaagagctcttacaaatcattaagaaaaagataaat

SEQ ID NO: 18849 - DNA, 201 bp, Homo sapiens
aatgttttataaaggcacaatataattaaaattcttgtctaggaatagacagacagatcactgggacagactagagtctagaaatgggcccagatatttaagggaatttttgtttgtttttggaacagagtatcactttgttgcccaggctggagttcagtggtgtgatcttggctcactgcagccttggcttttcgggct

SEQ ID NO: 18850 - DNA, 201 bp, Homo sapiens
cctgtgtggacagcaccctacagcgaacaaactttcccacttgccaaaactcattcaggcctcctgatagccgggctgagatggggttggagatctccacrctgcaggatggggcggggagctggaattggaactgggactggctggagtgggtaacacagggtgggggtggtgagtggcttagagacagagcccccagct

SEQ ID NO: 18851 - DNA, 201 bp, Homo sapiens
cggagctatgcacttggaattgtccttactgggcccaggtctctcctgcccccccagactgggagctgcttgagctcagtatctgggtgtgattcttctgstgccttcagtacctggcccaggaatgagtgcagagagtacttgctgaatgagccgctagtgggggtaaccatgtggcacagcacctggcacctggcacac

SEQ ID NO: 18852 - DNA, 201 bp, Homo sapiens
cttgggactgttgtgaggactgattaatatccacagaatacttagcacactgcctggcacaaaattagcattgagtgtttgttattaatataataatggcygacatatattgagtactgtgtttgtcatattccatggtgctaggtgctttatgcaggatatctaaatgctcaaaacaatccttgcagtaagtgttagtac

SEQ ID NO: 18853 - DNA, 201 bp, Homo sapiens
atacgtgctgacaagacaggtcaggaagctgtgtgtcagctcagcaggaggtggtgatggtcccagtcagggtggcagagtggggacactgaggatagcasctgttcacaaggtatttgggaagtggaatagataggacttgttgattgattggctatggggagtggagaagagtgaagatacaaggactctcaggttctg

SEQ ID NO: 18854 - DNA, 201 bp, Homo sapiens
taaagggtatgccacgaggttgttgtgaaggttcagtaagagagtgagcgtggagggttaagcatagcgctgtcacataggcagtgagctggccactgctsttgccattattattataattatctttgccaatctaatcggtgaaaaatgatatctcatctttgtttttaaccaatgtgtctttttttcgactccacagga

SEQ ID NO: 18855 - DNA, 201 bp, Homo sapiens
tggagcttctagggtccctcccccctcagtagagcagctctgcgggggttggccccaagtctctaaagttggtttctagagcctcccccatccaagcccaygggaagggaccagggcctcctaaagggaaatcacatgggaggttggaacgtggggtctgggaagggccctgttactcaatccatctaggacaccaatggc

SEQ ID NO: 18856 - DNA, 201 bp, Homo sapiens
gtatggatataccagtatctggatatacctcactttacttactcagtccccagctgatggagatatatgtttttccaattgtcttgatccctgcaatgaayatctaggtgcatatatctttgcatgtttcattgattcattcatgctacagatgttttttgagtgtgttctgtgtaccagcccaatgccaggtacatagga

SEQ ID NO: 18857 - DNA, 201 bp, Homo sapiens
cagatgcagctccagagccacccagtctccgggggctctgtaaattaaagccattgcatgccccattgcattttaatcatcagcccccagcagtagctccragtgagaacccatgaccttttctccttcccttttgaggagccctctcccaccgctcctacactgctggtaaaaggcagccgcactgcctgctggaagacc

SEQ ID NO: 18858 - DNA, 201 bp, Homo sapiens
cccacattccaggacccaggtcctgtgtctcaggccagaagattttctatattggctggagcttctgtgggatgcaggcagtggatgagaagggaaacgayagcaaatagaggaagcacaagtctctggcctcagtgttgggtgcacacaaagcaaatgggagaaggaggagaggggctcccttcccctgccccaaggccc

SEQ ID NO: 18859 - DNA, 201 bp, Homo sapiens
gtcatccaggaagggtctcagccccaaggcagtcccagacggaggacttggcagatgcaagatcacgtagatgctctctggctcacggtcagatatcctgrgcccagccctgcagcactgtcctccagaggatgcacacctacccaggcctccttacccttcctcactggactttctctcaacacatgtgtttggcttgag

SEQ ID NO: 18860 - DNA, 201 bp, Homo sapiens
gcagaggaagggaaaggataagtgatgtgaacacagtgatattttgggaagatcaacgtaagagtgggatatatatatatatatatatatatatatatatggattggaaagagaaattgggggctgagactttaaaaattatcatttatggatgctacacatagttcatgtattatctcacttaatccttaaaagagcctc

SEQ ID NO: 18861 - DNA, 201 bp, Homo sapiens
gaactcctgggctcaagtgatcgatcctcctgcctcagccgtctaagtacctggtaccacaggcgtgcaccgccatgcccatctgctcacaaccctttacragctcctgtgacacaagataaaagccaattacttaccatggccttccagaccctttgaaggtgattcaccctcttgcttccttacagatcttccctcctg

SEQ ID NO: 18862 - DNA, 201 bp, Homo sapiens
tacccacctcaggacttgtgagggcagaggaaaactaccctaattaagaatttactatgtactaagcccggtgctgttcactttacatgcgttacgttgaytgattacagtgtctcttggaggaagagattatcatgggaaactgtttcaggaactgtgggttctacaccttccaggaagcagaaggctgttctgacttac

SEQ ID NO: 18863 - DNA, 201 bp, Homo sapiens
gtgagcagaggaagggaaaggataagtgatgtgaacacagtgatattttgggaagatcaacgtaagagtgggatatatatatatatatatatatatatatatatggattggaaagagaaattgggggctgagactttaaaaattatcatttatggatgctacacatagttcatgtattatctcacttaatccttaaaagag

SEQ ID NO: 18864 - DNA, 201 bp, Homo sapiens
agacatggcatcttctttgtgattctgggcaaatcccttggcctctctagtctcctttcctcctatgcaaagggaactggctggcttcagtgatctctggkactccttcacacgaattttcccactgactctcccgctctgagccctgaagcttctcttcagcctgtccctcccctcccccctccaacttctgggcagagg

SEQ ID NO: 18865 - DNA, 201 bp, Homo sapiens
cgtgttagccaggatggtcttgatctcctgacctcatgatctgcctgcctcggcctcccaaagtactgggattacaggggtgagccactggtgtccagccsctgcccccttttaatttatttgtttattatttctttttcaggacagtggatactttttttttttttttttaagatggagtctcattttgttgcccaggct

SEQ ID NO: 18866 - DNA, 201 bp, Homo sapiens
tgtgagcagaggaagggaaaggataagtgatgtgaacacagtgatattttgggaagatcaacgtaagagtgggatatatatatatatatatatatatatatatatggattggaaagagaaattgggggctgagactttaaaaattatcatttatggatgctacacatagttcatgtattatctcacttaatccttaaaaga

SEQ ID NO: 18867 - DNA, 201 bp, Homo sapiens
agattagacacccaagaaggccaaactctggcccctaacaacagaactggtggagagatgtgaacttggagcagttgtcacctctgagacaactcagaggyggtacagcttgagtgagcagagcctccctggccacagatgccatgtcccatcccctagccatggaccccaaggataggggagagaagaggcttaccctgt

SEQ ID NO: 18868 - DNA, 201 bp, Homo sapiens
catacatgggtacggtccacaaggtatgggcatgctccacgcttgtgagcgatgtctgtctgcctgccaaaagaagctgctggatgcatgcagggaacttytccctatcttcccagtgctgtgcagtgctaggcctgtgagagatcaaccaaagccccagctcagaactatggggaggagagataggcaaagggcaccttc

SEQ ID NO: 18869 - DNA, 201 bp, Homo sapiens
attttacagataaggaaggttgaggctcagatgacttaaggtcaaccctgcagggcatacagagctgggatttgaacctccatctgtctgacctctgatgbtgtttttggctatactttgctaccctgagcagttgtgtatcgagctgggggatgtaaagggaggagaagaaagaagatgaagagataccagccagcctta

SEQ ID NO: 18870 - DNA, 201 bp, Homo sapiens
gactaggcggtgagctgtgttggctggaagtgaaactgcagagggcccaaaggcaaaagacccaaatcagacggagatagagatgcagatagagcagaggratatggagattgagggggtgaggggggagtgggggagagagagagagagtctcagaaaggcaagacagagtcagtgagagagggaagattcaaaggactg

SEQ ID NO: 18871 - DNA, 201 bp, Homo sapiens
cacagccactttttcctgagaaagaaacagagctacagacagttttactcattaaatactttttttccccttaaatctgtttttgtaatttttttttttttgcgtgaacggaaaagtaaaacgggtgatattgaaataaacaaggcatttgtgatgggaaggttaaagcagattgttgggggtggggaagggggttggaaa

SEQ ID NO: 18872 - DNA, 201 bp, Homo sapiens
gttcccagctcctgggaggggccgcagtgccttggggtgtcctgccgtgtctccatcgggtcccctgcctggctgctctaaccctgaggaatggcctccaytgtgggcctgtggaaacagggagaagaatctcttatccagcaggtctgagggccacaggaacataagtaacactgaagagtgaggctgatccctggggtt

SEQ ID NO: 18873 - DNA, 201 bp, Homo sapiens
agaggaacttgaaaagaagagagtgaaatggacacagagagacaaggctagataatcagacacagagaggtgaaagaatcatagagacagagagagagggmgagggagagacaaagagcaaacccacagaaacagagagagagagagagagagagatgggggtggtgtggggaagaggctgtgttccaggagaaagaagtc

SEQ ID NO: 18874 - DNA, 201 bp, Homo sapiens
gaggagggaatccctgacctccctcttccccttccctccaacttctgccggtgcctcccaccagctgaacccaaccaggggcacccaggccaggcagttcyctggggtcagtctcctggggcacagctcagggctgagaagggcagggtgtgaatctgggccaggggatcaaatggagaataaacagcatggggagaaagc

SEQ ID NO: 18875 - DNA, 201 bp, Homo sapiens
atgtggagttatggggagctggtcatgcagtggaaagacctggatttttatttttatttatttatttatttatttatttatttatttatttatttatttttgagatggagtcttgctctgtcgcccaggctggggtgcagtgatgccatctcggcacaccacaacctctgcctcctgggttcaagtgattctcctgcctca

SEQ ID NO: 18876 - DNA, 201 bp, Homo sapiens
aggtgatgtggagttatggggagctggtcatgcagtggaaagacctggatttttatttttatttatttatttatttatttatttatttatttatttatttatttttgagatggagtcttgctctgtcgcccaggctggggtgcagtgatgccatctcggcacaccacaacctctgcctcctgggttcaagtgattctcctg

SEQ ID NO: 18877 - DNA, 201 bp, Homo sapiens
tctcgaggtatggggtactggggagaactgctcatgtttccaggtgatgtggagttatggggagctggtcatgcagtggaaagacctggatttttatttttatttatttatttatttatttatttatttatttatttatttatttttgagatggagtcttgctctgtcgcccaggctggggtgcagtgatgccatctcggc

SEQ ID NO: 18878 - DNA, 201 bp, Homo sapiens
tctgtcccatggagccccacagagtaatttctttttttttttttttttggtcccatgacagccttacaagaatctggaaaaaaaaaaaaaaaagaatctgraattagatatccaaggcctcctctcttccaggaaacatcatttcaactcttcacaacactaaatttcaagtcccatccctaacttggtctcttcttgtat

SEQ ID NO: 18879 - DNA, 201 bp, Homo sapiens
ggaggttggaacgtggggtctgggaagggccctgttactcaatccatctaggacaccaatggctcaagtcaccttggccctccccagaggcagaagtgccsatgtctagggcacatggggctcagagctgaggattcaggggtgtgtgtgtgtgtgcatgtatgcacgtgtgaatgtatgtgcgtgtgtgtgtgtgtgtgt

SEQ ID NO: 18880 - DNA, 201 bp, Homo sapiens
tggtcctcctctgtttcctctaccttcttcccatctcccagccacctcaggtacccagtatgtgccacccaggaagaccaggatctccacagtgggtgagstggggcagttctgagaacatgactgctgcagggtctttcccgtcctgactgggccctgcctaagcgcaggctgttagcctcctgggagccacccagtgac

SEQ ID NO: 18881 - DNA, 201 bp, Homo sapiens
tcacagcaccacattgagttggggaagtctggggagacagctggtcctcctctgtttcctctaccttcttcccatctcccagccacctcaggtacccagtrtgtgccacccaggaagaccaggatctccacagtgggtgaggtggggcagttctgagaacatgactgctgcagggtctttcccgtcctgactgggccctgc

SEQ ID NO: 18882 - DNA, 201 bp, Homo sapiens
gttctcgggtggcctgaaagtgacagccatgggtagtggctggcagccataggtagtggctggcagccatagagggcgtggtgagcagcctggagcctgtwattctagcgtgatttgggcagctggtgtgagtcggggatgtctgttagcatgtggcagggtccagccaagggactgggggcaggtcagggctccaggcac

SEQ ID NO: 18883 - DNA, 201 bp, Homo sapiens
ctctcgaggtatggggtactggggagaactgctcatgtttccaggtgatgtggagttatggggagctggtcatgcagtggaaagacctggatttttatttttatttatttatttatttatttatttatttatttatttatttatttttgagatggagtcttgctctgtcgcccaggctggggtgcagtgatgccatctcgg

SEQ ID NO: 18884 - DNA, 201 bp, Homo sapiens
ttaaattggaggatattaatcatagctcacatatattgggttcttataggtgccagcagtaagcacttctaagcactttacatgctatctcatttcatacytgtagtagctagtatgtaggagaatgcatgatgtgtggcaggcagtcagtaaatcgctgtttcttcaaacttggaagttctagaacttcaggtgatgaat

SEQ ID NO: 18885 - DNA, 201 bp, Homo sapiens
gtgtgtattaagcagttacacagatacttatccaattagcagttgatctgtagtacgaaggagaagtacacatagtacgaaggaaacgtacaggctatgasagaataaaacaagagaagctaacctgagcttgggagtcagggagggcttctctgaggaggtgacattcagcttgaaagatgagtgggcaaaaggcagagt

SEQ ID NO: 18886 - DNA, 201 bp, Homo sapiens
gtgaaggttaattctctagcactctgagcctgccttgggagggcagagcaggctcctggagaccagaagaagccctcaggcaaggatgcagctgcaggcartttgaagtcaggctagagtacactgaaatggtagggcctggaggaatgggggtggagcgccagcactgtctgctactcatggagagcttgtggcatagga

SEQ ID NO: 18887 - DNA, 201 bp, Homo sapiens
ggcccctgccatcaggaaagacagcagttttttgcaatgagcgtgtgtattaagcagttacacagatacttatccaattagcagttgatctgtagtacgarggagaagtacacatagtacgaaggaaacgtacaggctatgacagaataaaacaagagaagctaacctgagcttgggagtcagggagggcttctctgagga

SEQ ID NO: 18888 - DNA, 201 bp, Homo sapiens
gatcccaagataaggatttgaacacatgcaggaaagtgattccaggaaatgctggtagggagtgggcctgtgagactgggaggggaggaagcccacagagrgagcctcttggagcaagttgcaagttacactatgggtaactggaccactgaggatcactgggcgcctgtgttgaacacacttctgagagttaccccactt

SEQ ID NO: 18889 - DNA, 201 bp, Homo sapiens
gttggggtaatgatcgtgctgctgtacgtcttggatttatcttaagggatagggcaccaaactttttttcttttttttaaaaatttatttgtgacagggtyctgctctgttgcccaagctggaatgcagtggtgcaatcatagctcacagcagtcttgaactcctgggctcaggggatcctctgaccttggcctctcgagt

SEQ ID NO: 18890 - DNA, 201 bp, Homo sapiens
cagcccatgctcctttgaaatgcctgtggatatgtgctgcatagacagagggtagtgcagagagagaggctcctttctagtgtggggtacagccccccccmcccccccactgtggaaggcagactgctccagaggacacctggtgggggccaggcctagttctctcccttccagttctggagcagaatgcctgccccctct

SEQ ID NO: 18891 - DNA, 201 bp, Homo sapiens
gctggagtgcagtggtgtgatctcggctcactgcaacctccgcctcctgggttcaagcaattctcctacctcagcctcccaagtagctgggattacaggcrcccaccacaaggtccagctaatttttttatttttatttttagtagagatgggatttcaccatgttggccagtctggtctggaattcctgacctcaggtga

SEQ ID NO: 18892 - DNA, 201 bp, Homo sapiens
ccagcccatgctcctttgaaatgcctgtggatatgtgctgcatagacagagggtagtgcagagagagaggctcctttctagtgtggggtacagcccccccmacccccccactgtggaaggcagactgctccagaggacacctggtgggggccaggcctagttctctcccttccagttctggagcagaatgcctgccccctc

SEQ ID NO: 18893 - DNA, 201 bp, Homo sapiens
cacgatcccagctcaccacaacctccacctcctgggttcaagcaattctcctgcctcagcctcccaagtagctggcatcacaggcacccgccaccatgccmggccaattttttgtatttttagtagaggcagggtttcaccacattggccaggctggtctccaactccttgcctcaagtgatctgcccgcctcggcctccc

SEQ ID NO: 18894 - DNA, 201 bp, Homo sapiens
tgcctggctaatgtttatatttttagtggagacggggtttcaccatattggccaggctggtcttgaactcctgatctcaggtgattgatccacctgccttrgcctcccaaagtgctgggattacaggcatgagccgccgcacccagctaggttttatgtattttggaggaccctcatccagagtctcttcagatttgtctc

SEQ ID NO: 18895 - DNA, 201 bp, Homo sapiens
ctggagtgcagtggcgtcatctcggctcactgcaggctccgcctcccaggttcaagtgattctcctgcctcagcctcccgagtagctgggattacaggtgygtgccaccatgcccagctaatttttgtatttttttttttttgagatggagtctcgctcgctctgttgcccaggctggagtgcaatagcacgatcttggct

SEQ ID NO: 18896 - DNA, 201 bp, Homo sapiens; identical to SEQ ID NO: 3304

SEQ ID NO: 18897 - DNA, 201 bp, Homo sapiens
gaagcagagaagagagtcatccaggaagggtctcagccccaaggcagtcccagacggaggacttggcagatgcaagatcacgtagatgctctctggctcayggtcagatatcctgggcccagccctgcagcactgtcctccagaggatgcacacctacccaggcctccttacccttcctcactggactttctctcaacaca

SEQ ID NO: 18898 - DNA, 201 bp, Homo sapiens
gcagcgctaggcccaaggcttttcttttcatattttttcccactctccttttctgtggagtgcagctcccagccaggccgccgccagtttcagagtctccygggcctccctccccagtggggcctctgcccagcccgcccccaggcaggagctgcttgggctttcccagagcacagcagcctcctccaggctctggagtgt

SEQ ID NO: 18899 - DNA, 201 bp, Homo sapiens
cctcctccaggctctggagtgtgaccgagcgcctactcatttgacacaggtcaccgagcctccagcagatggggccctcgctgtggggggtctctgagccrggggctgtggggggctgggagtaggagggaggctctgcagggatggacaggctacacaagctccagctccttatactctttctgcaaagccccgggttac

SEQ ID NO: 18900 - DNA, 201 bp, Homo sapiens
atagaggaacttgaaaagaagagagtgaaatggacacagagagacaaggctagataatcagacacagagaggtgaaagaatcatagagacagagagagagsgagagggagagacaaagagcaaacccacagaaacagagagagagagagagagagagatgggggtggtgtggggaagaggctgtgttccaggagaaagaag

SEQ ID NO: 18901 - DNA, 201 bp, Homo sapiens
ggaaggcagccccgggtctcctttgacaaacacatcatgcttcccacctaaaccacctctgtgggtggggagctggggactggtctattagctttctcccrctgtcccccgagggtgcatttgtctgttttgcattttttccaggctgtagttagacaactcctggtcctggggggagcgctgcaaagagaaaatgtcagg

SEQ ID NO: 18902 - DNA, 201 bp, Homo sapiens
ataggtagtggctggcagccatagagggcgtggtgagcagcctggagcctgttattctagcgtgatttgggcagctggtgtgagtcggggatgtctgttarcatgtggcagggtccagccaagggactgggggcaggtcagggctccaggcactggggtgagtgactgtgggcccacagttggccatggtcttggaggagc

SEQ ID NO: 18903 - DNA, 201 bp, Homo sapiens
gggtggagtgcagtggcgcaatcttggctcacttcaacctccacctcctggattcaagcaattctcctgcctcagcctcccgagtagctgggattacaggygcctgccaccacaccggctaatttttgtgtttttagtagagataggattttaccacgttggccaggctagtctcgaacatgtgacctcaggtgatccgcc

SEQ ID NO: 18904 - DNA, 201 bp, Homo sapiens
tttttgctgatgataaaaacaatacaagctcatttgtaaacactagaaaagtagtatacaaaatagaaaatggaagtcctccatcagcctctctgcctcaytcctcataactactcctggtggctatatctttccagaccttttttttgtgtggacacacagtacttaataatagtagcttaggtttattgagggtttatg

SEQ ID NO: 18905 - DNA, 201 bp, Homo sapiens; identical to SEQ ID NO: 3303

SEQ ID NO: 18906 - DNA, 201 bp, Homo sapiens
cctttccttacgatgatcagctcacagggcctcagccagggcagacttttcagttcctaactgcccacctgtgcctgtgcacccagcttgtgcccatgacytgggctcctcaccctcttccggaggaaaaggggcagaaaagattaaatagaaaattgctcaaaattcagaggccgtggaacagatctgacagttccaata

SEQ ID NO: 18907 - DNA, 201 bp, Homo sapiens
taggactgtgagctctggggctccgggactggatctgcttcacctctatcccccagcacccagctcaattcccggtctatagtactcaccaataaagaatrcctgttgaatgaccataggttgtgcccctgtgatctcatttccttcttttttaaaaatgagggcttagagggatactgtagacactggtttgcagtctca

SEQ ID NO: 18908 - DNA, 201 bp, Homo sapiens
taattctttgtgtgtctgtctctcccataggactgtgagctctggggctccgggactggatctgcttcacctctatcccccagcacccagctcaattcccrgtctatagtactcaccaataaagaatgcctgttgaatgaccataggttgtgcccctgtgatctcatttccttcttttttaaaaatgagggcttagaggga

SEQ ID NO: 18909 - DNA, 201 bp, Homo sapiens
gcagtaaaagtgctcagcacccaccgtccccttggcatcatccatgtaacttctactggtttgggctctgtcccatggagccccacagagtaatttctttytttttttttttttggtcccatgacagccttacaagaatctggaaaaaaaaaaaaaaaagaatctgaaattagatatccaaggcctcctctcttccaggaa

SEQ ID NO: 18910 - DNA, 201 bp, Homo sapiens
ccagcactttgggaggcagaggtgggcggatcatgaggtcaggagtttgagatcagcttggccaacatagtgaaacactatctttactaaaaatacaaaarttagctgtgcatggtggcgcacacctgtaaccccagctactggggaggccgaggcaggagaatcacttgaacctgggaggtggaggttgcagtgagctga

SEQ ID NO: 18911 - DNA, 201 bp, Homo sapiens
tctgtctgagctcaggacatgtgtttgaacctggcacaacatctgtctgggcctggtacatcatcttcctggcctgggggcaatgtctgtttgagccctgratgtgtgtttaacttggggacgtctgctgggcctggaacaatacctgtctgagcctggggatggacttgtcattgcagataaaatcacccctgagcctca

SEQ ID NO: 18912 - DNA, 201 bp, Homo sapiens
ccaccatgtccgggactctgatgggtggggtgggtaggggcccgccccttcgatctggcccataggctggaggtggctgtaggggatagcaggtgccagcygtgcatctctttccaacttcttgttcagtgatgtcacattggttgtttgaaattggtcatggtgggaggatttacattacaaaaatcagcaaatgctaca

SEQ ID NO: 18913 - DNA, 201 bp, Homo sapiens
cccgcataggatgagctcacccttctgagccctcaaagcccctacgtctctccctctaagctcagccccttcaggtgtccagttcttctgtccttcctgtratctttagagcccaaggcagaagagaggagtagtagtagggccgtcgctgcctttggcagaagagaaaggagcgatctaacttatttaatctcaggtctt

SEQ ID NO: 18914 - DNA, 201 bp, Homo sapiens
ggcaggaggtgtggtggttagggtgctggagccagactgcctggttcacatgccagctctgcctgtcagaagctgggtgaccttgggtaataaggacaaaatgggttaatctatatcaaagtacttagaacacaaaatggcctgtgttagctattatcattattattatttttttagttgtaagataacacctgatcctcc

SEQ ID NO: 18915 - DNA, 201 bp, Homo sapiens
tttcccactctccttttctgtggagtgcagctcccagccaggccgccgccagtttcagagtctcccgggcctccctccccagtggggcctctgcccagccygcccccaggcaggagctgcttgggctttcccagagcacagcagcctcctccaggctctggagtgtgaccgagcgcctactcatttgacacaggtcaccga

SEQ ID NO: 18916 - DNA, 201 bp, Homo sapiens
ccatccataatccatcctgcctgcctgcctgcctgcctgccttccttccttccttccttccttccttccttccttccttccttccttccttccttccttctctccatccatccatccatccacccacccacccacccactgactgcttgcctgatgcagccaccagctcagttatgcttgtggagtaagtgtgctgggagc

SEQ ID NO: 18917 - DNA, 201 bp, Homo sapiens
accatccataatccatcctgcctgcctgcctgcctgcctgccttccttccttccttccttccttccttccttccttccttccttccttccttccttccttctctccatccatccatccatccacccacccacccacccactgactgcttgcctgatgcagccaccagctcagttatgcttgtggagtaagtgtgctgggag

SEQ ID NO: 18918 - DNA, 201 bp, Homo sapiens
gcttttcttttcatattttttcccactctccttttctgtggagtgcagctcccagccaggccgccgccagtttcagagtctcccgggcctccctccccagyggggcctctgcccagcccgcccccaggcaggagctgcttgggctttcccagagcacagcagcctcctccaggctctggagtgtgaccgagcgcctactca

SEQ ID NO: 18919 - DNA, 201 bp, Homo sapiens
aaccatccataatccatcctgcctgcctgcctgcctgcctgccttccttccttccttccttccttccttccttccttccttccttccttccttccttccttctctccatccatccatccatccacccacccacccacccactgactgcttgcctgatgcagccaccagctcagttatgcttgtggagtaagtgtgctggga

SEQ ID NO: 18920 - DNA, 201 bp, Homo sapiens
ccaaccatccataatccatcctgcctgcctgcctgcctgcctgccttccttccttccttccttccttccttccttccttccttccttccttccttccttccttctctccatccatccatccatccacccacccacccacccactgactgcttgcctgatgcagccaccagctcagttatgcttgtggagtaagtgtgctgg

SEQ ID NO: 18921 - DNA, 201 bp, Homo sapiens
gaaaccatggctccatctgtcattccattcatccgtctatccatctatccaaccatccataatccatcctgcctgcctgcctgcctgcctgccttccttccttccttccttccttccttccttccttccttccttccttccttccttccttctctccatccatccatccatccacccacccacccacccactgactgcttg

SEQ ID NO: 18922 - DNA, 201 bp, Homo sapiens
ggaaaccatggctccatctgtcattccattcatccgtctatccatctatccaaccatccataatccatcctgcctgcctgcctgcctgcctgccttccttccttccttccttccttccttccttccttccttccttccttccttccttccttctctccatccatccatccatccacccacccacccacccactgactgctt

SEQ ID NO: 18923 - DNA, 201 bp, Homo sapiens
ttgattggctatggggagtggagaagagtgaagatacaaggactctcaggttctggcttggtgatattcactgagatgggacacacaggaggagagagggrttttttgggaacaaagatagctgagttttagatctggtgagtttgaggtatcaatggaacagtgtgtaatgtctcattcattcattaattatttactgag

SEQ ID NO: 18924 - DNA, 201 bp, Homo sapiens
cagggaatggtcaccttgaggcagcccaggtctttcacctttcccaggcctgggaggtaggaggaagactgggaattccgcagtgaagtccatgctcgtgycagccctaaccaggcctgtgtgatattgaagcttgggctttcaacctggagctgccatcatctccctgggcaagagtaactctggtctagccttcctagc

SEQ ID NO: 18925 - DNA, 201 bp, Homo sapiens
gcggcagcggttctacagtcctacgcgagcccctggtacccggccgcgctccggggttccagaaggagaagatctcgaggtggagactgtggctccggggraaacgctgctggcaagggcgctagttgggggtggacgttgggcccaggggtatctgacctgcgccgctgcagccttctcgctccttctcccagcttgaac

SEQ ID NO: 18926 - DNA, 201 bp, Homo sapiens
tctctaacttttccaagtttcgtttggtgtggccaggagggcagggccccgcggggagcaggggccgcgctatgcggcggtcggtctgcagcagggcagargccccttcccgtctgggtgtgtgggagcgcagacccctccggcgtggccgggaaccaagccggggctcggatgaaacgaaacgaaaaatgaacactcgaa

SEQ ID NO: 18927 - DNA, 201 bp, Homo sapiens
tggaaaccatggctccatctgtcattccattcatccgtctatccatctatccaaccatccataatccatcctgcctgcctgcctgcctgcctgccttccttccttccttccttccttccttccttccttccttccttccttccttccttccttctctccatccatccatccatccacccacccacccacccactgactgct

SEQ ID NO: 18928 - DNA, 201 bp, Homo sapiens
ctggaaaccatggctccatctgtcattccattcatccgtctatccatctatccaaccatccataatccatcctgcctgcctgcctgcctgcctgccttccttccttccttccttccttccttccttccttccttccttccttccttccttccttctctccatccatccatccatccacccacccacccacccactgactgc

SEQ ID NO: 18929 - DNA, 201 bp, Homo sapiens
aacctggaaaccatggctccatctgtcattccattcatccgtctatccatctatccaaccatccataatccatcctgcctgcctgcctgcctgcctgcctkccttccttccttccttccttccttccttccttccttccttccttccttccttccttctctccatccatccatccatccacccacccacccacccactgac

SEQ ID NO: 18930 - DNA, 201 bp, Homo sapiens
cgctaacctggaaaccatggctccatctgtcattccattcatccgtctatccatctatccaaccatccataatccatcctgcctgcctgcctgcctgcctkccttccttccttccttccttccttccttccttccttccttccttccttccttccttccttctctccatccatccatccatccacccacccacccacccac

SEQ ID NO: 18931 - DNA, 201 bp, Homo sapiens
ggttcaagcaattctcctacctcagcctcccaagtagctgggattacaggcgcccaccacaaggtccagctaatttttttatttttatttttagtagagaygggatttcaccatgttggccagtctggtctggaattcctgacctcaggtgatccgcccgccttggcctcccaaagtgctgggattacaggcatgagccat

SEQ ID NO: 18932 - DNA, 201 bp, Homo sapiens
gcatgggccaccacaccagcctacaaatagtttgtccttacatttcaactaattttttttttttttgagacggagtctcgctctgttgcgcaggctggagkgcagtggtgtgatctcggctcactgcaacctccgcctcctgggttcaagcaattctcctacctcagcctcccaagtagctgggattacaggcgcccacca

SEQ ID NO: 18933 - DNA, 201 bp, Homo sapiens
aaataaatgattgattgaatggataacagcacaaggatccgtaggagctgaaggaggtttctcactcaccaggaggtagaggggttaaaaaagacttcctyggtgaggtgctgcacaagctgggtcctaaagaatgattaggaattagccaggggaagaggggagggagcagcacaaaggctggaggtggaggaggtgcga

SEQ ID NO: 18934 - DNA, 201 bp, Homo sapiens
tcccacccgggcctcccaaagtgttgggaatataggcatgggccaccacaccagcctacaaatagtttgtccttacatttcaactaattttttttttttttgagacggagtctcgctctgttgcgcaggctggagtgcagtggtgtgatctcggctcactgcaacctccgcctcctgggttcaagcaattctcctacctca

SEQ ID NO: 18935 - DNA, 201 bp, Homo sapiens
actaagacacaatttggacatgtcactttgcacttggctcctgagaacccttctatttatttatttatttatttatttatttatttatttatttattttttgagacagagtctcacgctgttgcccaggctggagtgcagtggtgcaatcttggctcactgcaacctccgcctcccgggttcaagctattctcctgcctca

SEQ ID NO: 18936 - DNA, 201 bp, Homo sapiens
gtcacagtgttcccactaagacacaatttggacatgtcactttgcacttggctcctgagaacccttctatttatttatttatttatttatttatttatttatttatttattttttgagacagagtctcacgctgttgcccaggctggagtgcagtggtgcaatcttggctcactgcaacctccgcctcccgggttcaagct

SEQ ID NO: 18937 - DNA, 201 bp, Homo sapiens
caggcatgtgtctaaatggggagatacacagaacccacacataggctgaaataggctgaagtaggcactgctttgctgacacagagatacatgaaacctaacaggctcttggggccacaaacatggagactctcagctggtgtgccgagtcacacacataggcataccatcatactcacacacaagagcacgtggagccag

SEQ ID NO: 18938 - DNA, 201 bp, Homo sapiens
ggaagccaggttctaaggggttgtcatcatagatttctgtggttccatgagtcctggaagaggggctccttggctgccccatagtggtactcctccctcaraacctgtggcctagcttgtattgctgtgtacggcagccaggcggacttggaatgcttgaaatgagcagtctgcgaaggtaagatgtgaacacacgaatat

SEQ ID NO: 18939 - DNA, 201 bp, Homo sapiens
atgacaaatagctaattagggtcaaaagaagcactctgaaccaattagttgtagggtctatccctttctcctgggagaagactgggccttcctgctccctwcccagcactgactcccaaatgcccacacactctggcatcctgtctggctggggccctgactgtgaagagcactgaaacagacgtcagtgcatgggcctca

SEQ ID NO: 18940 - DNA, 201 bp, Homo sapiens
ctgtgggggatcttggggaaggaagcttattcttccagccaggatcaagctgataaatgggaccatctccccattctctgttcacactggatcagcctccktattcctctccttctccctagcttaatgcagcccagctttggagtagtaattaccttcacatgacccagtaatcatattccctgggtgttgagcagagca

SEQ ID NO: 18941 - DNA, 201 bp, Homo sapiens
caccatctggctgtccagagaaagcatcgtcagcactctgttgtctggaacactgagcatggaggggtctgcctgtgggttccaactgcagtgcccgagarcagaacaaggagttgtggctcagtagtggcttgttgggaagacttttaaggaatatactcagtgtgattcggctgctgggcctctaatggtgttttgatt

SEQ ID NO: 18942 - DNA, 201 bp, Homo sapiens
gcagtatggctgcctcttagaaggggagggctggggtgggcttttccccaaggacagagctagggatgaaatctcagagggagagagtgcatcggcaggtkcaggagaaagctggaaactgagcctggaacacagccatggtgacaagacgggtgaagaaacaggatgcgtggtcaggaaggcgcggggctacaggagcat

SEQ ID NO: 18943 - DNA, 201 bp, Homo sapiens
ctcgggcgacgcagcctaccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtc

SEQ ID NO: 18944 - DNA, 201 bp, Homo sapiens
ttttaattgagttgggaaaatatgggctattttataaatggcgttgggataatgggccagccatagcaacactccttattggggtaagaactctctgactyggtctaataagctcaagccatgaagaccacatggcataaatatgagtgaatattttgatcatcttaaggtggggaagattcttctaagtatgacgtgata

SEQ ID NO: 18945 - DNA, 201 bp, Homo sapiens
tctgtgcatttctgcctgtatctgcaaatgtctgcttgtgcactgtccatgcaggtaggtccacactggtgtgtgtctgatgacctctgtcagtatctgcrgacatgagtctgtgctttctgttagcatctgtgcaagtgtcatctacgtctatgagcatgtttgttctttccagtgcctctatgtgtcttgtacctgtat

SEQ ID NO: 18946 - DNA, 201 bp, Homo sapiens
atctccaggaatcatctacttaaactatcttcctttacatcctacaggatgagtaggagttatcaggcaaaggaaagcaaaagatggaagagggaaaagarggcattccaggcaggagacatagtgtgaacaaaggcatgggtggaggcacggtgcagtgaacattaagcaggttgacattgaagattaaagaccaatgtg

SEQ ID NO: 18947 - DNA, 201 bp, Homo sapiens
gaaaacctttcctcttcttgcacatgtccattgtcaaggggtccctggttttctaatctgtaaaatggagctgatgatctgggccgttgccacacagttgmacaattgtgaagtagattaatgctgggtcctggtaatgtgtccctgccctcaaggagcttactgtccagtgtagaagcaagcacagaaacagacactaca

SEQ ID NO: 18948 - DNA, 201 bp, Homo sapiens
ttggcctcttggggccttcagggatgaaggtacagcagctcacgccaccccattccacactggcctctgaggtcaacatggaaattctcaggcaatgatgstttcctgcaattcatggcctgggacccaccaatacatcttctcccgctctgctctcccgtttgtcaaggcccacccagatcctgctccaagctctaggtg

SEQ ID NO: 18949 - DNA, 201 bp, Homo sapiens
tgggcaaatgtaagaatgttgcaaagaggcaaattttggctcagttcaaggaagaactttgaaagcaattgcagatgtttaacccatgaaggaggtggtaraggaatttgagttcccagaggcctcaagcagaatgtggacttagcaggaatcctgcagaaggaagccaggttctaaggggttgtcatcatagatttctgt

SEQ ID NO: 18950 - DNA, 201 bp, Homo sapiens
ttaaggctgacaaaacccaggcttgatgagggtctggactaatgtgtgggcacggttgatgagaattttgctgttgtaagctttctgaaggacagagtggyaaaatagaaatagcatacccttaattgcagccatctcatttattggattttattctaaggcaattgttgcaaaaatgagcaaagagaatatgcacaagga

SEQ ID NO: 18951 - DNA, 201 bp, Homo sapiens
cctctcccagcccagaggagtcaatttctccaagtgtcctgggcttcagtgagaaaggcagtggagaagggagctctcgtttattaagggcccaccaagtrctacgcctgtaatatgggtgagctcattcagtccttatggcaaccctgggtggtaggagctattttacagataaggaaggttgaggctcagatgacttaa

SEQ ID NO: 18952 - DNA, 201 bp, Homo sapiens
ctagagacctttgcagggtcctaaggagaaagaaggtgactataatatccagaggaccttgaatatcaagacttggcattagaatcatgaaatgttaggaytaaaaagatctccaggaatcatctacttaaactatcttcctttacatcctacaggatgagtaggagttatcaggcaaaggaaagcaaaagatggaagagg

SEQ ID NO: 18953 - DNA, 201 bp, Homo sapiens
ggtgtgtttctccaaggcttgaatgagccgggcttggggtgtgcgtgtgtgtttggtgagcatttgcgtgtttatgctgggtatgtttgtgtgcatgttcrtgtgtcgatgtgttgtaggtgtttgtgcatgtgtttttgcctgcatgtgggcgtatttgtatgttcaggtgagtgtacttacagcagcgaggatgccatg

SEQ ID NO: 18954 - DNA, 201 bp, Homo sapiens
atgaggctgcccctctcccagcccagaggagtcaatttctccaagtgtcctgggcttcagtgagaaaggcagtggagaagggagctctcgtttattaaggkcccaccaagtgctacgcctgtaatatgggtgagctcattcagtccttatggcaaccctgggtggtaggagctattttacagataaggaaggttgaggctc

SEQ ID NO: 18955 - DNA, 201 bp, Homo sapiens
cctgccctcaaggagcttactgtccagtgtagaagcaagcacagaaacagacactacaatgtggtagatgctgtgatgtggccagcacatagtaggtgctyaataaatatttgttaaataaatgattgattgaatggataacagcacaaggatccgtaggagctgaaggaggtttctcactcaccaggaggtagaggggtt

SEQ ID NO: 18956 - DNA, 201 bp, Homo sapiens
tctggagtgtgaccgagcgcctactcatttgacacaggtcaccgagcctccagcagatggggccctcgctgtggggggtctctgagccgggggctgtgggrggctgggagtaggagggaggctctgcagggatggacaggctacacaagctccagctccttatactctttctgcaaagccccgggttacagacgtgggacc

SEQ ID NO: 18957 - DNA, 201 bp, Homo sapiens
aaagattgataaatttgactatatgaaaattaaacatttaagtaccttaaagaacattataagaaaattttaaaagaggggtatatacatatgtatgtgtrtatatatatatatatatatatatatatatatatgacaacagtttaattttatttctaatgtacaaagagctcttacaaatcattaagaaaaagataaata

SEQ ID NO: 18958 - DNA, 201 bp, Homo sapiens
tttatgcccaattaccctaagtcaagggagaagaaagtgctggtctctgaatgttctggaacggggagagctcctggttccctagttcctactggccaggygtatccattccttttccagctgtctccttcccttcttagagccctttttctggtggtcagtggcttgccagggcctggccaggctggttctcctatgctg

SEQ ID NO: 18959 - DNA, 201 bp, Homo sapiens
gggggccctggaggcagagtcccatgccattaggagtgcttggagatcccaggtgctcctgaatgatattaatgcatctatatgaatattaatagcatggycattaatattaatgacaataataaacaagtgtgaggattatttttaaagagggctgctgctccagctgttgcctcccttcattaataagctgctgagatt

SEQ ID NO: 18960 - DNA, 201 bp, Homo sapiens
tgaaggtcatgtgctattttctgtttttccagttctctccctttcttttcaagttattaggggaggcagagtccttctggagtttgacccttggattccayccagagcagcctccaaaatgacacctttgaaggtgggaaagacactgcatattctctgggtttttgtttgaggtctgtcttggatttgttctttatgccc

SEQ ID NO: 18961 - DNA, 201 bp, Homo sapiens
tggagtcttgctctgtcgcccaggctggggtgcagtgatgccatctcggcacaccacaacctctgcctcctgggttcaagtgattctcctgcctcagcctyctgagtacctgggattacaggtgtgcaccatcatgcctggctaatttttgtatttttagtagagatggggtttcgccatgttggccaggctggtctcaaa

SEQ ID NO: 18962 - DNA, 201 bp, Homo sapiens
agggagggcttctctgaggaggtgacattcagcttgaaagatgagtgggcaaaaggcagagtcaggatgaagaggaaagcactggtgagcatgggaggggracagcaagagggtttcactcagaaggaacagtgtttttaattattaacacacgggaaattcctcaaaatgaaattgctgggtcggagggtaagcagattt

SEQ ID NO: 18963 - DNA, 201 bp, Homo sapiens
gtggagaggaatctgtgatttattgagcaccaactgtgtgctggatacttcacacgcatggttttatttaatcctcacaagcttgtggattaaacaagacrtgacaatctccattttactgatgagaaactgagtctccgggaagtgacttgcccaaggtgggtggagctgggattcaaacctgggtctgtctgacccttt

SEQ ID NO: 18964 - DNA, 201 bp, Homo sapiens
gtaagcgcagacacagagctatgactcccgttctccctgtgtcagcccctgcgcagtgcgagtgggaggtgagccactgttgcgtgccctctgccagacayaggcctgcaggtcagactcacaggggccaagcagagcatctgggaggattttgtttctggctccaaaaatgaaataccaaggaaagtaggcaagctcatg

SEQ ID NO: 18965 - DNA, 201 bp, Homo sapiens
ctagaggtgcttgagtggttggtgcaagggggcttgtggggaaccagagcgtcctggtgtttagagcagcaaggaagaggctgggtaaggacaaaggacaytgggacagacagaaagcctgactctagaaagaaggggccaaggtcactggagaggagagagaggaaggattaaggacgattgagtgggtcataggggttg

SEQ ID NO: 18966 - DNA, 201 bp, Homo sapiens
cgtcacacggcttataagtaaggcagccaggatgtgaacccagtaggactatctggctgcaaagtccccaccctccctcgccatctgtatcctccaatcaycttcagtgctttgctgatagaaggtacggaaatacgatgccacagactgtccaggaagacagaaactaggcagatgggctggccatggtctccaagccag

SEQ ID NO: 18967 - DNA, 201 bp, Homo sapiens
tctccacccccactacccctctgcctcggcctggggtatgaggtcttggttttgacaatcagacaatgttagcacactgctgtgtcttccacctgcaatgragcactgtaggacgattttaaaaagcaaagtggcaggccaggtgcggtgactcaagcctgtaatcccagcactttgggaggctgaggcgggcggattacc

SEQ ID NO: 18968 - DNA, 201 bp, Homo sapiens
gaatgaggacatcatgaccaccatgcaaaggccattgctcttaaggtttgatgtaagctccccactctccacccccactacccctctgcctcggcctgggktatgaggtcttggttttgacaatcagacaatgttagcacactgctgtgtcttccacctgcaatggagcactgtaggacgattttaaaaagcaaagtggca

SEQ ID NO: 18969 - DNA, 201 bp, Homo sapiens
tgcatgcctctcaggatggggagttcactgcatccccctctttaaagacattacggttgtacaaaggtctccagaatcatctattacatcccctcattctyccaatgaggaaattaaagctcagagatgccgaggcatttacccaagggcacacctggtcctgggcctacgacccttagacaatattccttccacctcttt

SEQ ID NO: 18970 - DNA, 201 bp, Homo sapiens
tctgaaataagagtccttagcttttagagaagaatagtgaaatatttacagatgaaatgacagacatgcaggatttactgcaaatattacaggaggggtarggtaggtttgggcatagagaaaaagattggctgcgagttggtaattactgaagctgggtgaagtatgtggagtttcattatgctagtctatctacttgtg

SEQ ID NO: 18971 - DNA, 201 bp, Homo sapiens
tatgagagggatgcaactgaggctacctggagtgcgtggacacagccatggcctcaggtcatcatctcccccacgaagcctcccacacctcctgtccccawcttgggcacacttcccaccacctgggagacccctgagggcaggcaccatctgtccttcaccactatatccccctataaagagagataatgcagtgaggtg

SEQ ID NO: 18972 - DNA, 201 bp, Homo sapiens
tctaccctggcccccagttctttgatgggttttgctgatgctcctgtgtctctgaacagcaggcgcctcacctatagaaaggtaggatagcaggagttaaygccccctcccccattccatggcccctgcctgggattctaccatctctgcttcatatgctttataggagttcggtctgagcccacaacccaaacaggctca

SEQ ID NO: 18973 - DNA, 201 bp, Homo sapiens
ccagtagactgtcagctcctagccattgtatccctagcaccgctgtgtgggagcacttcacaaacgtccattgagtcagggactcagcagtctccatttcycctccctgctggagaatgcgtgtattttgcaatccccagcccctgtgccatctaaccatcttttcttctctgttcagcccaggtgtggcctcactcacat

SEQ ID NO: 18974 - DNA, 201 bp, Homo sapiens
ccaggttgcaagacccctcctaccaactgagctacaaatcacagttcctggagggtgggcctttatataacagggaacagaactcttctgtacctcccacytccccgcaagaagtaggccaggcatggtagctcatgcctgtaaatgaagcattttggtagaccaaggtaggagggtcacttgaggccaggagttcgagac

SEQ ID NO: 18975 - DNA, 201 bp, Homo sapiens
gtgagttagctcatgaaagatgacagactctccaagccaggggtatgcaggaaatgggttttctgtagctacagaaatggggttgagggttggaccaaggsgactacccaggggaagtcttaccttcagaggactctggaaaggaggctgcaagttttcatgggtcaagaattcagagcccagtagagacagcttatctct

SEQ ID NO: 18976 - DNA, 201 bp, Homo sapiens
cacaaacgtccattgagtcagggactcagcagtctccatttctcctccctgctggagaatgcgtgtattttgcaatccccagcccctgtgccatctaaccrtcttttcttctctgttcagcccaggtgtggcctcactcacatcccactctgagtccaaatgttctctccctggaagatatcaatgtttctgtctgttcgt

SEQ ID NO: 18977 - DNA, 201 bp, Homo sapiens
gttgttaaccatttaccagcaccccactacctctgtctcctctgtcagcccagggaagcgcacccttgtccagaagtccccaagggcatagggcagagcarcaggagcccaagtaccaggtcccagcccccacccctcccctgagagttgtgtggtcctgggcaagtcagaggaaatgccgggggtatttattttaaaaag

SEQ ID NO: 18978 - DNA, 201 bp, Homo sapiens
tggtttgagtcccagtccctcatctctccagcctccaagccctcacctatgcaatggtgccttgcccggctcacaggttatgaaaaggggtgagacgagayagtgtcccctaaatacatctgacagcacttttgaatggaaaagagaaaaagaaaatactataagcatccagattgactggaggttggggagttggtgggg

SEQ ID NO: 18979 - DNA, 201 bp, Homo sapiens
catgtcccctcactccctgccctccagtccccgccagtcctcatgttttccatgaggatgagtacagccgcagggactttccctgcaagtggtctgggccrtatcttccgggagtctgtttggactgtggtgtctgtggctgagggggtggaggtgagggcacccaggcccatcacttgacagaacaatctgtggatttgg

SEQ ID NO: 18980 - DNA, 201 bp, Homo sapiens
atctagtgtcactttccagaacataccaacagcttccccagttctgtgcctctgctcaggctgttccccctgcctggtccacttgtcctccttcttgtccsgtcaaaatgcttcttatccttcaagacccagctctagagtcacctccaaccccttacccaccagccccctctccaagtctgtgtcccacaacccccctgc

SEQ ID NO: 18981 - DNA, 201 bp, Homo sapiens
ctttctatgagcccaggagggcctctcagagaggaaagctcctaggtcttcctttccctctgcaaactccctgccttgaaggatcagaaggactgtgctgstcgttgcatcctttgcaagttccaaaccctgatcccagctgtgcttaggggttcctgcaaaccttttccaggtgttaattacctcccacttcatttcctg

SEQ ID NO: 18982 - DNA, 201 bp, Homo sapiens
aaagacaaccagcgccagtaataatttggtattttgccttctcaacttttgaactttgttgtatgtacaatttggttacccagctttttgttcccctaacrtgttatcagaaacattctctcatttttggtgaactcttagaagcatccttttttcatgtctgcttgacatttgttgaatggatataagatcatgtattta

SEQ ID NO: 18983 - DNA, 201 bp, Homo sapiens
gccccctctccaagtctgtgtcccacaacccccctgctccctccagggcaccctccaccctctgggccacagttgtcaggagtcaggcagggcaggggccrggtggtgtcttctttgtgttcttgcactcagggcagagctcagcacagagcagacgctcaaaaaacatttaaaggatagaagcattgatttgtgggtccc

SEQ ID NO: 18984 - DNA, 201 bp, Homo sapiens
caggcttttctgcagcagcgaatgcatcagagctgccaggggggcagctgtagacctaagagagttcctttaagcacaaattggctgattatcttttttasgtaaataaacccataattcattccaaacacttggcttatttaaatatttttattgccaaaggaatatatgttcttcacagaaaacttggataccatgaca

SEQ ID NO: 18985 - DNA, 201 bp, Homo sapiens
gatcccattgcctctgcttgcatgcctctcaggatggggagttcactgcatccccctctttaaagacattacggttgtacaaaggtctccagaatcatctrttacatcccctcattctcccaatgaggaaattaaagctcagagatgccgaggcatttacccaagggcacacctggtcctgggcctacgacccttagacaa

SEQ ID NO: 18986 - DNA, 201 bp, Homo sapiens
acaagcggggacctgggctctgacaggaggccacacacttacagtccctcccttagtgaccggcagagctgggatttgaacacccctggtgagactccctygtccagaccccttcgttgtacagcaggtttgcctcacatgccagagtcggggtggcctcagggcacagccaggagatgtccccaaatcccgaaatgtggt

SEQ ID NO: 18987 - DNA, 201 bp, Homo sapiens
atcatctattacatcccctcattctcccaatgaggaaattaaagctcagagatgccgaggcatttacccaagggcacacctggtcctgggcctacgacccrtagacaatattccttccacctctttgctatagagtctcagactagggatcttggctggctgagaaatcagggaaggcttcttagaggaggtgagattgga

SEQ ID NO: 18988 - DNA, 201 bp, Homo sapiens; identical to SEQ ID NO: 3315

SEQ ID NO: 18989 - DNA, 201 bp, Homo sapiens
aaaggactgtcgtgcaaacccaccatggcatgagctgtcgagtgcagtgcccgctgccactaaggaatgagtgccactctgggattgtggaaagtgcagasgggcagggttgagatgctcgtgcatgactttggacaggtcacctccctctcagaggtttagtttccttacttgttaagcttggactaaaaatatctaaat

SEQ ID NO: 18990 - DNA, 201 bp, Homo sapiens
atgttgcaacagccatgaaaaaagaaatgcaaagcgattcaggatgagagcaataccctactccaaagaaggcaaaatagaagctcagagaggtcaagcawtttgcccaagaccacacagctaggagtggaactcatggctgtccaagccccacgcctctgctgaaggtagagatgaattacagcaacaagtctagaaagg

SEQ ID NO: 18991 - DNA, 201 bp, Homo sapiens
aatgtcaagggagttaggagctccgtgtcaggaactggtgtcaaagaccaaatatgtatttcctaatatatcacgatatcacaggttgtgagaagaatgcmatcaatggtcaaactccagagctgcacactctccaatatggcagtgaccagccacatgcagtcaccaagcacttgaaaggtggctgcttcaaactggtat

SEQ ID NO: 18992 - DNA, 201 bp, Homo sapiens
gggaggctctctggggttctcccggagcctcggagattgcaccttgtgcatgcgctgctgcacctggggtacatcacccccactctggagcccactggccrgttagcaaagtgagaggtgagagaaggacctcttggtcttctttgaacagaaagatccagaaagcaatggctagaacacaagaacaggtcaggggaggca

SEQ ID NO: 18993 - DNA, 201 bp, Homo sapiens
gaagcatgcaagcaagtgggtgctggggccggggcaagcgcttttgggctctggccctacagtaccgtctagggttgtgttacaattaatgctcttttagmagttgccattcactgatggctaagtgttaaccaactcagtggagagtgagggtgacagccttttacaccttgccctcttggtacctgggtccttgtctgg

SEQ ID NO: 18994 - DNA, 201 bp, Homo sapiens
gacagaaaccctccccgatccaagttattagcaaactgcccatctccacaaaaatttaaatggacagattgttaaatgcacacagctcacagccagctccyttcaaggtagatttgggcccaaacatttcgggaagcatcaggctgtgccccgccatccctaccaaacaggaatcctctcgagggaaaagactgggccttt

SEQ ID NO: 18995 - DNA, 201 bp, Homo sapiens
gccactgtcgcccttgggagccgtacgtggcatacaaagaaatcccaggactccgcctgcccacctggccaccctctgtttacaccttccgcgtaaacgcscactgtttacatccaaaactcagacacaaaataaccacctcaagaagataaataatgataagaaataaatgttacgcgaggcaaatttattcacatgggg

SEQ ID NO: 18996 - DNA, 201 bp, Homo sapiens
gctcaatctgttaacaggcttctggcatgtagatcagtggtctccaagcttttgtgattgtatattcctataggaaaaaaagaattgattatgcatacccrgtatgtatacttattaatctgtatgaagatgtacattctaaaatataatcaaccagtagaaatttaagaaagaagatgtaaaaaaaaaaaatattaacag

SEQ ID NO: 18997 - DNA, 201 bp, Homo sapiens
atacccacacatgcacacacacacacacacctgcactcacacacttgcacatgcatagaccacagctttccacacccttcctagacaggggtcacttggtrtcctggagagagtgtgaagtctggaagggaaagaggggggattaagccccacctctagccatgggactgagacaagtcacccccacccatctgcgccttg

SEQ ID NO: 18998 - DNA, 201 bp, Homo sapiens
tccctcactcaacctcttgctacttcccacctctcctgtccaacatctagtgtcactttccagaacataccaacagcttccccagttctgtgcctctgctmaggctgttccccctgcctggtccacttgtcctccttcttgtcccgtcaaaatgcttcttatccttcaagacccagctctagagtcacctccaacccctta

SEQ ID NO: 18999 - DNA, 201 bp, Homo sapiens
ccctcagtgttctcatcaataatccactcgccctcacaggcgcgtttgggaccccatgttctatgctctcacaggaccttttgcttgatttttcactgtaytcaggtcagtttgcagttattaagtgactgagcaatgtctggcttctccagtagactgtcagctcctagccattgtatccctagcaccgctgtgtgggag

SEQ ID NO: 19000 - DNA, 201 bp, Homo sapiens
ccacccatctgcgccttgtttcctcctctgtgaggcaagcacagagcccatgcctccctccctggatgggagtgatgtgaaacttgaagaggggtagagayaagggtcgtcaatggaagccccttgggcaaaaaggccctttcaactaggggcacagaggaggccctgggctgagaacttgacagcaccttgtattggtaa

SEQ ID NO: 19001 - DNA, 201 bp, Homo sapiens
gcttcggtgctgtctctgggggcaccaccagctcagcacctccctgcgttcaccaactcggaagctctcccaatcctgtcttttagggattttgatggagrcttcatcatataggcatgatggataataaattcaatctccagcccctcttcccttcctggaggatgtggggtgaaagttccaagctttgtatcatggtct

SEQ ID NO: 19002 - DNA, 201 bp, Homo sapiens
catgcatgtcagaatcctcaatctcagctcaggaagtaggaattttccacctttgttagcagcagagatgacaaaccccagggccccacatatagcctgtrccttagtcactgcctcgggccaggttgcaagacccctcctaccaactgagctacaaatcacagttcctggagggtgggcctttatataacagggaacaga

SEQ ID NO: 19003 - DNA, 201 bp, Homo sapiens
tcccgttctccctgtgtcagcccctgcgcagtgcgagtgggaggtgagccactgttgcgtgccctctgccagacacaggcctgcaggtcagactcacaggrgccaagcagagcatctgggaggattttgtttctggctccaaaaatgaaataccaaggaaagtaggcaagctcatgcatgtcagaatcctcaatctcagct

SEQ ID NO: 19004 - DNA, 201 bp, Homo sapiens
ggttctgaaggatgagtaggagttggaaggagttggaagagctcctgccctttgtggagcaggagagggaggtggtccagggacctttctggccgaccaascctagagccaattgcagtgagccattgtgacattggacttgaaactggtcactgcgagagtatttataccatagaaatttgcaaatgctacggttagggc

SEQ ID NO: 19005 - DNA, 201 bp, Homo sapiens
ggaagcccaaggacatgagagctttctgagctgcatcccaggccctgctctgccactgactcgctgaggctgggtttccccatctgcaaaataaggacatraaaacccatctagagctgggcatggtggctcatgcctgtaatcccagcactttgggagtccagggcaggcagatcacttgaggtcaagagttcgagacca

SEQ ID NO: 19006 - DNA, 201 bp, Homo sapiens
tcccagaccttgttgtcacctcctcactctcccagtagcgccagccagagcacctgtcttgggagccccgaggcagggacaggctatgcatccaggaagcycccaggctctaaggaggcggccctataactgctggatgaccaaaaatcaggcagcgatccctaagtcccttctgagccccaggctccaggctcctccaac

SEQ ID NO: 19007 - DNA, 201 bp, Homo sapiens
cgggccaggttgcaagacccctcctaccaactgagctacaaatcacagttcctggagggtgggcctttatataacagggaacagaactcttctgtacctcscacctccccgcaagaagtaggccaggcatggtagctcatgcctgtaaatgaagcattttggtagaccaaggtaggagggtcacttgaggccaggagttcg

SEQ ID NO: 19008 - DNA, 201 bp, Homo sapiens
gtccttgtctggcatccaggaagaatcaggtcacacggacttgaaggatggtgaatgcagaggttttattgagtgatggaggtggctcttagtcgggtggrgagctggaaaggggatggagtgggaaggtactcttccagatggctgaactcttctccaactgtccagctgcctcttccacattcagacacttcttctctt

SEQ ID NO: 19009 - DNA, 201 bp, Homo sapiens
gggtgcctcagggctggtacggcaaagcctcagcaccctccctacctccttcccccctcgcgatcaggcccctgataaaagcagtgaactctgctccaggyctggccagcataaaggcccccaagagaggagccaacaacaccccatcctccctctcaccctccctcaggctcctgctggggctcccactggccaaaccca

SEQ ID NO: 19010 - DNA, 201 bp, Homo sapiens
gagactcccttgtccagaccccttcgttgtacagcaggtttgcctcacatgccagagtcggggtggcctcagggcacagccaggagatgtccccaaatccmgaaatgtggtttgagtcccagtccctcatctctccagcctccaagccctcacctatgcaatggtgccttgcccggctcacaggttatgaaaaggggtgag

SEQ ID NO: 19011 - DNA, 201 bp, Homo sapiens
tgacagttgaggaaatggtccctagaggggagacagagctagctagagactgggctggccctggagcctggcctgggtcttcccatcgcatcctgcctccstacataagcaaaggtcgagaggtgggaactcccaaagatgctcaggcagggccaggggagaccagtggggcagggaggggacaggaggggaaggaggagc

SEQ ID NO: 19012 - DNA, 201 bp, Homo sapiens; identical to SEQ ID NO: 3310

SEQ ID NO: 19013 - DNA, 201 bp, Homo sapiens
ggctattgaaaagcaaggtgggtcgacagattgttaaatgcaaagaggtgaggacacagccggcggtgcatttagggtgcttctgcaggcgtccttatacrtggatatgtgcacatctgctcctgaaagctcagaagatgtctggaaagcaacaggagacaccagtgagcctggctgtctcttgaggcaacaggcagggac

SEQ ID NO: 19014 - DNA, 201 bp, Homo sapiens
ggaggctgatgacatcactacccagcccttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaaggtgggtgccgggcaggggctgctcca

SEQ ID NO: 19015 - DNA, 201 bp, Homo sapiens
gcaggagagggtctgcacacctgctacaggtgtgctcacacgtgggccagggcctgcagatgagggatctgtgctgatcatttgtgatagccaaaagtagwgaaaacctggggggactcctcaaatgaactgtagcacattggggagatggactctgtgaagatgattcctctctccacccacttcccttctccctcctcc

SEQ ID NO: 19016 - DNA, 201 bp, Homo sapiens
gggtaatttatcaaaaaacagacatttattgctctcggtgctggaggctgggaagcccgagatcaaggcactggcagattgggtgtctggtgaggacctaktcgtcatagatggcaccttctatgcatcctcatatggtggaagggtgaacacgctctcccaggcctcctttaaagaccaccaatcccattcacaaggagg

SEQ ID NO: 19017 - DNA, 201 bp, Homo sapiens
gcggagagcgaaggtggccgcagccttcccggccccacagccagcctggctccagctgggcaggagtgcagagctcagctggaggcggagggggaagtgcycaggaggctgatgacatcactacccagcccttgaaagatgagctgttcccgccgccactccagctctggcttctgggctccgaggaggggtggggacggt

SEQ ID NO: 19018 - DNA, 201 bp, Homo sapiens
cgctggctccatgccagcccctgggctaggcgtctggtggcactacctcatttcactgccataacaactgggtcccccatcttgcagatgaggaagcccargttcagagaggtgaagtggggggctgggggtctatcccagaccttgttgtcacctcctcactctcccagtagcgccagccagagcacctgtcttgggagc

SEQ ID NO: 19019 - DNA, 201 bp, Homo sapiens; identical to SEQ ID NO: 3317

SEQ ID NO: 19020 - DNA, 201 bp, Homo sapiens; identical to SEQ ID NO: 3319

SEQ ID NO: 19021 - DNA, 201 bp, Homo sapiens; identical to SEQ ID NO: 3320

SEQ ID NO: 19022 - DNA, 201 bp, Homo sapiens; identical to SEQ ID NO: 3321

SEQ ID NO: 19023 - DNA, 201 bp, Homo sapiens
caaactccctgccttgaaggatcagaaggactgtgctgctcgttgcatcctttgcaagttccaaaccctgatcccagctgtgcttaggggttcctgcaaaycttttccaggtgttaattacctcccacttcatttcctgtttaccaactcagctttttgttttagtgtgtttgaattccctgaactgaccgttgtctgatc

SEQ ID NO: 19024 - DNA, 201 bp, Homo sapiens
ccaacaaacggtggtgttggagtttaccactggttattttaatgggtttgcaagaattgttaattactaatgtttattgagcctagtgcagtgcttggggyattttgcacattgtctctgatccctatcacaaccctgagaggtagtttttttaactcccattttacaggtgaggtcattgtggttcaaggacgttaagta

SEQ ID NO: 19025 - DNA, 201 bp, Homo sapiens
tgcaacagccatgaaaaaagaaatgcaaagcgattcaggatgagagcaataccctactccaaagaaggcaaaatagaagctcagagaggtcaagcaatttkcccaagaccacacagctaggagtggaactcatggctgtccaagccccacgcctctgctgaaggtagagatgaattacagcaacaagtctagaaaggtgcc

SEQ ID NO: 19026 - DNA, 201 bp, Homo sapiens
tccaggaagcccccaggctctaaggaggcggccctataactgctggatgaccaaaaatcaggcagcgatccctaagtcccttctgagccccaggctccagrctcctccaaccaggtctgccttacgcttttgaccacaatcaacccggctctttctcggttcttttcatctctctggtggttttgtatgcagagtcaccca

SEQ ID NO: 19027 - DNA, 201 bp, Homo sapiens
cacctgcactcacacacttgcacatgcatagaccacagctttccacacccttcctagacaggggtcacttggtgtcctggagagagtgtgaagtctggaakggaaagaggggggattaagccccacctctagccatgggactgagacaagtcacccccacccatctgcgccttgtttcctcctctgtgaggcaagcacaga

SEQ ID NO: 19028 - DNA, 201 bp, Homo sapiens
ccatcttttcttctctgttcagcccaggtgtggcctcactcacatcccactctgagtccaaatgttctctccctggaagatatcaatgtttctgtctgttygtgaggactccgtgcccaccacggcctctttcaggtgagtcaaagggattcctcagttcactagttaggggaggtgggcagacaccctggagaactccct

SEQ ID NO: 19029 - DNA, 201 bp, Homo sapiens
tgcttgatttttcactgtactcaggtcagtttgcagttattaagtgactgagcaatgtctggcttctccagtagactgtcagctcctagccattgtatccytagcaccgctgtgtgggagcacttcacaaacgtccattgagtcagggactcagcagtctccatttctcctccctgctggagaatgcgtgtattttgcaat

SEQ ID NO: 19030 - DNA, 201 bp, Homo sapiens; identical to SEQ ID NO: 3307

SEQ ID NO: 19031 - DNA, 201 bp, Homo sapiens
atccaaggatcagagggggctctgtaagacccaggggagtcaggtgcactggagcgcgggctgcagaaaacagcctgagctccacctcggcttctccttgycctggctggttgtccttaacccctgtctccttctggaccagtttttgtccttcccttgtgaccctgaggggtaacagcctcttttccactttctttcagc

SEQ ID NO: 19032 - DNA, 201 bp, Homo sapiens
catttttctcttttaataaattaactcacccaccacacggctttgagaggctcaaaggtgaccaactcccttgggagggccccggttgataaggaaggaaygtgaatcctcccatcacggaagcttcaaggaggtcaagggtccaacacttgagattgttagtgctgttggtggatactggccaaggaaatatcccagtgg

SEQ ID NO: 19033 - DNA, 201 bp, Homo sapiens
tctctcacccacagcacagggcactgggaaaatgcccaatgagtcctgccctctgggttgtgctttggacttttcagtgtgtcttcgcatccactcttcarcttgaatgttgcaacagccatgaaaaaagaaatgcaaagcgattcaggatgagagcaataccctactccaaagaaggcaaaatagaagctcagagaggtc

SEQ ID NO: 19034 - DNA, 201 bp, Homo sapiens
tggtctccaagccagactggaatctccaggtctggaatgatatcatttttctcttttaataaattaactcacccaccacacggctttgagaggctcaaagktgaccaactcccttgggagggccccggttgataaggaaggaatgtgaatcctcccatcacggaagcttcaaggaggtcaagggtccaacacttgagattg

SEQ ID NO: 19035 - DNA, 201 bp, Homo sapiens
cactaagtgaatgaagctactctgaaaaggcatatgctgtatgatttcaactatatgtgacattctggaaaaaggcaaaactatgaagacagtaaaaaataaaaaaatcagtggttgccaggaattaggggagggaggagagaatgggaggagcccagagacttttagggcagtgaaacttctgtatgacactgtaatggt

SEQ ID NO: 19036 - DNA, 201 bp, Homo sapiens
cttatccttcaagacccagctctagagtcacctccaaccccttacccaccagccccctctccaagtctgtgtcccacaacccccctgctccctccagggcmccctccaccctctgggccacagttgtcaggagtcaggcagggcaggggccgggtggtgtcttctttgtgttcttgcactcagggcagagctcagcacaga

SEQ ID NO: 19037 - DNA, 201 bp, Homo sapiens
ggtaccagacggactgtctatggaggcaggagtgagggcctggggcggtcacagaggttgcatttgctttgcagtaaggccatggccgcttaagggtgtcyagaaaaaagccctgtccgacatgcacacactcctgtgtccaggcaatgagcctgtgggcactgacagcaagagtccttctcacgcttctcttcagggctc

SEQ ID NO: 19038 - DNA, 201 bp, Homo sapiens
tctagtgtcactttccagaacataccaacagcttccccagttctgtgcctctgctcaggctgttccccctgcctggtccacttgtcctccttcttgtcccktcaaaatgcttcttatccttcaagacccagctctagagtcacctccaaccccttacccaccagccccctctccaagtctgtgtcccacaacccccctgct

SEQ ID NO: 19039 - DNA, 201 bp, Homo sapiens
ggaggcagaggttgcagggagctgagatcacaccactgcactccaggctgggtgacagagcaagactctatctcaaaataataataataataataataatmataatcatcatcatcatcatagcatataggaagctgtcagctatgcactcgtctcaggtgagcagagggatgactttgggttctatcctttgttccatac

SEQ ID NO: 19040 - DNA, 201 bp, Homo sapiens
ggcagaggttgcagggagctgagatcacaccactgcactccaggctgggtgacagagcaagactctatctcaaaataataataataataataataataatmatcatcatcatcatcatagcatataggaagctgtcagctatgcactcgtctcaggtgagcagagggatgactttgggttctatcctttgttccatacctg

SEQ ID NO: 19041 - DNA, 201 bp, Homo sapiens
gggaatgttctgcggaactagaggaagaggggctcagggagaagaagggcacattcctggttgtcatatgtgatctatcccagatgaacttggaagtgaarggaagagagttaaacattaaagtaaatacccagtggatcagacagcaatgtgccagattgccttggagacaaaatatctccaacacatggctgacatttg

SEQ ID NO: 19042 - DNA, 201 bp, Homo sapiens
cagccttcccggccccacagccagcctggctccagctgggcaggagtgcagagctcagctggaggcggagggggaagtgcccaggaggctgatgacatcaytacccagcccttgaaagatgagctgttcccgccgccactccagctctggcttctgggctccgaggaggggtggggacggtggggacggtggggacatcag

SEQ ID NO: 19043 - DNA, 201 bp, Homo sapiens
tccctggaagatatcaatgtttctgtctgttcgtgaggactccgtgcccaccacggcctctttcaggtgagtcaaagggattcctcagttcactagttagrggaggtgggcagacaccctggagaactccctggaaagctcaactctcatgccccggacaacagttgaaggaaccagtgatgttaagcccaaagacaaaac

SEQ ID NO: 19044 - DNA, 201 bp, Homo sapiens
catttaggttgtttcctgtgacccttcttctgcatgatgaggaacatctctgtgcataaagcttttcctgtccttttgattattttcaaaaatgccaaacaaaaaaaaaaagggagggggttgaaggttctgggttttcttcactgaattatccaaatattaaatgatctagagacaggtttgggagccactaaaccctct

SEQ ID NO: 19045 - DNA, 201 bp, Homo sapiens; identical to SEQ ID NO: 3309

SEQ ID NO: 19046 - DNA, 201 bp, Homo sapiens; identical to SEQ ID NO: 3311

SEQ ID NO: 19047 - DNA, 201 bp, Homo sapiens
tttctcactttgatatttaaaagatgttcaatacactgtttgaatgtgctggtaactgctttgcttcttgagtagagccaccaccaccatagcccagccakatgagtgctctgtggacccacagcctcagctgagtgtgaccctaggaggcacaatgtgctctgtatccagaacacacttggcagatggaggaagcatctg

SEQ ID NO: 19048 - DNA, 201 bp, Homo sapiens
ggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcg

SEQ ID NO: 19049 - DNA, 201 bp, Homo sapiens
caaacacacacatgtgtgcacaaacacatgcatgcacacacaaacacatgcatgcacacacaaacacacacacatatatacacacaccaacacaaacacamatgtgcacaaacacacgtgtgcacacaaacacacacatgcacacacacacacaaatgcacacacatgcgtgcacactgtggctactcctctgtagcctgc

SEQ ID NO: 19050 - DNA, 201 bp, Homo sapiens; identical to SEQ ID NO: 3313

SEQ ID NO: 19051 - DNA, 201 bp, Homo sapiens; identical to SEQ ID NO: 3314

SEQ ID NO: 19052 - DNA, 201 bp, Homo sapiens; identical to SEQ ID NO: 3316

SEQ ID NO: 19053 - DNA, 201 bp, Homo sapiens
tcacggaagcttcaaggaggtcaagggtccaacacttgagattgttagtgctgttggtggatactggccaaggaaatatcccagtggagcctcgagatgargaacatgaggcccccgtttagatccaaggatcagagggggctctgtaagacccaggggagtcaggtgcactggagcgcgggctgcagaaaacagcctgag

SEQ ID NO: 19054 - DNA, 201 bp, Homo sapiens
ctggctgcaaagtccccaccctccctcgccatctgtatcctccaatcatcttcagtgctttgctgatagaaggtacggaaatacgatgccacagactgtcsaggaagacagaaactaggcagatgggctggccatggtctccaagccagactggaatctccaggtctggaatgatatcatttttctcttttaataaattaa

SEQ ID NO: 19055 - DNA, 201 bp, Homo sapiens
gggcgagttattttgtcctgtctcctgagctataaagaagacctggaagttcctctttatgcaaagatagaggtaggctcttgcctgtgaagcaccacgtrtgtcataggcactaaataaatggcagccgtgattcgagttgctgagagtaggtcgtttccgcagcctgggtggaggtgaacagcaggtgttgctgttcca

SEQ ID NO: 19056 - DNA, 201 bp, Homo sapiens
cagataaggaaactgagactcagagaggttaagggcactgcagtaagcgcagacacagagctatgactcccgttctccctgtgtcagcccctgcgcagtgygagtgggaggtgagccactgttgcgtgccctctgccagacacaggcctgcaggtcagactcacaggggccaagcagagcatctgggaggattttgtttct

SEQ ID NO: 19057 - DNA, 201 bp, Homo sapiens; identical to SEQ ID NO: 3305

SEQ ID NO: 19058 - DNA, 201 bp, Homo sapiens
ccctaacattgattcggcatctactaataatcaatcccttcttacagataaggaaactgagtagcaataatctatcccatcttacagataaggaaactgasactcagagaggttaagggcactgcagtaagcgcagacacagagctatgactcccgttctccctgtgtcagcccctgcgcagtgcgagtgggaggtgagcc

SEQ ID NO: 19059 - DNA, 201 bp, Homo sapiens
tcttgtcccgtcaaaatgcttcttatccttcaagacccagctctagagtcacctccaaccccttacccaccagccccctctccaagtctgtgtcccacaasccccctgctccctccagggcaccctccaccctctgggccacagttgtcaggagtcaggcagggcaggggccgggtggtgtcttctttgtgttcttgcact

SEQ ID NO: 19060 - DNA, 201 bp, Homo sapiens
ccctgcctggtccacttgtcctccttcttgtcccgtcaaaatgcttcttatccttcaagacccagctctagagtcacctccaaccccttacccaccagccycctctccaagtctgtgtcccacaacccccctgctccctccagggcaccctccaccctctgggccacagttgtcaggagtcaggcagggcaggggccgggt

SEQ ID NO: 19061 - DNA, 201 bp, Homo sapiens
tagccattgtatccctagcaccgctgtgtgggagcacttcacaaacgtccattgagtcagggactcagcagtctccatttctcctccctgctggagaatgmgtgtattttgcaatccccagcccctgtgccatctaaccatcttttcttctctgttcagcccaggtgtggcctcactcacatcccactctgagtccaaatg

SEQ ID NO: 19062 - DNA, 201 bp, Homo sapiens
attccgcactcagcaggcatctttctgatgatccgatggcttctcagagccagggatgggccaggatccatccccttggctactgtcttgctgagaaattwataagcagcatctggtgctatactttggtctctagtgagttagctcatgaaagatgacagactctccaagccaggggtatgcaggaaatgggttttctgt

SEQ ID NO: 19063 - DNA, 201 bp, Homo sapiens
atgcatgcacacacaaacacatgcatgcacacacaaacacacacacatatatacacacaccaacacaaacacaaatgtgcacaaacacacgtgtgcacacaaacacacacatgcacacacacacacaaatgcacacacatgcgtgcacactgtggctactcctctgtagcctgctggccacactcggctcaagccccaaat

SEQ ID NO: 19064 - DNA, 201 bp, Homo sapiens
gcagagatcagtgggtggcggctcgcttgggtggtaaagagtagcctgcagccaaagttgggcacagcagtgcagtcttcactgggggaatgcctgggaarcaagatttgcctgggtaggagtttccatcagcacccccagaaaggtctcctttctaccctggcccccagttctttgatgggttttgctgatgctcctgtg

SEQ ID NO: 19065 - DNA, 201 bp, Homo sapiens
ccagctgcctcttccacattcagacacttcttctcttctctccttctctgccatgctgctctgctcctctgccagtggagtttggggtttttatgggtatrggatggggggcatggtgggccagggtggttttggcaaaagcaacactcaggtgggaaaacaggaatgtgaagttctcatttagggccgtgggcccaggct

SEQ ID NO: 19066 - DNA, 201 bp, Homo sapiens
catgcacacacaaacacatgcatgcacacacaaacacacacacatatatacacacaccaacacaaacacaaatgtgcacaaacacacgtgtgcacacaaacacacacatgcacacacacacacaaatgcacacacatgcgtgcacactgtggctactcctctgtagcctgctggccacactcggctcaagccccaaatcaa

SEQ ID NO: 19067 - DNA, 201 bp, Homo sapiens
gtagttccttaagactcaggggcaaagcctcacttccttagcacccagtgaagaccacgcttactccctcactcaacctcttgctacttcccacctctccygtccaacatctagtgtcactttccagaacataccaacagcttccccagttctgtgcctctgctcaggctgttccccctgcctggtccacttgtcctcctt

SEQ ID NO: 19068 - DNA, 201 bp, Homo sapiens
tacaaagcgcttttgcacttgagacccctaagtgctaattctaccacatccccatccacttcatagtgggatgaccttagccaaggctcttcacctaaacytccataagcccctcgctggaatttgagcctgttttgcttttttaaagtgagggcaatgctactggccccacccatcttacaggacaagggaagcccaagg

SEQ ID NO: 19069 - DNA, 201 bp, Homo sapiens
agggttgtgttacaattaatgctcttttagcagttgccattcactgatggctaagtgttaaccaactcagtggagagtgagggtgacagccttttacaccytgccctcttggtacctgggtccttgtctggcatccaggaagaatcaggtcacacggacttgaaggatggtgaatgcagaggttttattgagtgatggagg

SEQ ID NO: 19070 - DNA, 201 bp, Homo sapiens
ctggccacactcggctcaagccccaaatcaaaggtgactagcaagattgcgagacagatttctggagatgggaaactgcgtcatcaaattgtctcagggayggaacacccatcagagccctgggggagagaagagacacggggtggctgccaattttgctgacctatgctgctgactttccagcagcccccgactcctgtg

SEQ ID NO: 19071 - DNA, 201 bp, Homo sapiens; identical to SEQ ID NO: 3308

SEQ ID NO: 19072 - DNA, 201 bp, Homo sapiens
gcaatgcaaaaggccaagaaagatgctgcaaagcatgttatgacctagcctcagaaatcacacaccatccctgccaccattagtaagaagtccagcccacrtccaggagaagaggaagcagattcctccttttgaaatgaagaatatcaagtaattcggggggcatatgaaagccaccacacaccacagggatctttttag

SEQ ID NO: 19073 - DNA, 201 bp, Homo sapiens
tctgtagcatgagggattctgatgaaataatttccaagagcccttcccacactaatactccaggattctgtaaggttaatttggcaagaattccaacggcrgaagaaagatggagggaggaatatgtccagtctaataaccctatgctcaagtcagaaagcccctcgggcagtgtccgagagggctacagccctggcccca

SEQ ID NO: 19074 - DNA, 201 bp, Homo sapiens
gcttatctctgttccaagatgtctggggccttggttggaagattcaaaggctaggaaaccaggagccaccaaaagcgtaactggggccagaggatccactytcaaggtggcaagttggttccccccatgtggctgcttgagtatcctcacatggcggctcacatccttccaagtaagcaatgcaaaaggccaagaaagatg

SEQ ID NO: 19075 - DNA, 201 bp, Homo sapiens
tgtctctgatccctatcacaaccctgagaggtagtttttttaactcccattttacaggtgaggtcattgtggttcaaggacgttaagtaacttccccagcrtcacacggcttataagtaaggcagccaggatgtgaacccagtaggactatctggctgcaaagtccccaccctccctcgccatctgtatcctccaatcatc

SEQ ID NO: 19076 - DNA, 201 bp, Homo sapiens
cctccagcatcaggagccatgtggcaggatctccactcttcttcttcctgggcctctgtctggaccgacccaaacacacacacacacacacacacacacaygtgtacacacacaagttgcttctttgctgcctgcatgtcctcacaccagcttatgacacacctacaatgtttgatgtgtcattgtgggcaggtttcaagt

SEQ ID NO: 19077 - DNA, 201 bp, Homo sapiens
ctcagtgttctcatcaataatccactcgccctcacaggcgcgtttgggaccccatgttctatgctctcacaggaccttttgcttgatttttcactgtactyaggtcagtttgcagttattaagtgactgagcaatgtctggcttctccagtagactgtcagctcctagccattgtatccctagcaccgctgtgtgggagca

SEQ ID NO: 19078 - DNA, 201 bp, Homo sapiens
ggccaggatccatccccttggctactgtcttgctgagaaattaataagcagcatctggtgctatactttggtctctagtgagttagctcatgaaagatgayagactctccaagccaggggtatgcaggaaatgggttttctgtagctacagaaatggggttgagggttggaccaaggggactacccaggggaagtcttacc

SEQ ID NO: 19079 - DNA, 201 bp, Homo sapiens
tactgtcttgctgagaaattaataagcagcatctggtgctatactttggtctctagtgagttagctcatgaaagatgacagactctccaagccaggggtaygcaggaaatgggttttctgtagctacagaaatggggttgagggttggaccaaggggactacccaggggaagtcttaccttcagaggactctggaaaggag

SEQ ID NO: 19080 - DNA, 201 bp, Homo sapiens
cctgggctgagaacttgacagcaccttgtattggtaaccagccggagggactggaaatactcagatgtgtctgtctcccttattaggttcaaagtccctcragaccctgtctccatcacagtgctccagtccagacccctcctctgagctccagaccctgctggacccaacagccatccccatccccacctgcctggaatt

SEQ ID NO: 19081 - DNA, 201 bp, Homo sapiens
ttcacagtatttacacatgtccttgaagtggagaaagcatgtaggaagaggaggttaggcagaaggaggcctgatctcatcttgcctttgtcttgcttttrtgctgtacctggggagatcagcaccatcagcgtgactctaacagacttgagtgtgaggagctaggcttggattgcagacctcaagttacaattgatgtgt

SEQ ID NO: 19082 - DNA, 201 bp, Homo sapiens
gcaaaatgtgagggaagtaaatagttatccatttagacacaaaacgggaggcgggttgcatgacccagctcccagctagacttttccctttggcttagtgmgtttggggtctggggattttaattttatttttctttcacagtatttacacatgtccttgaagtggagaaagcatgtaggaagaggaggttaggcagaagg

SEQ ID NO: 19083 - DNA, 201 bp, Homo sapiens
tgaacacgctctcccaggcctcctttaaagaccaccaatcccattcacaaggagggggacctcatgatctaatctccccccagaagtctcaccttttaatrtcaccagcttggagattaagtctcaacaggtgaattttggagggacacaggcatttggatcatagcaccgggggactctggttttcagaatgaaagtagg

SEQ ID NO: 19084 - DNA, 201 bp, Homo sapiens
gtgcctcactgagtcacaggccgcctgtggctccccagcctacaggaagtgggagccctggcctgggtgtggggtgatgggggcctccctggccaaccccrcccctaattccatttctgagttggagaagggcttaggtggtgggggaacaggtaagcaaccccagaggacattgcaaagaggccctgcccgaggttctct

SEQ ID NO: 19085 - DNA, 201 bp, Homo sapiens
ctctgctcaggctgttccccctgcctggtccacttgtcctccttcttgtcccgtcaaaatgcttcttatccttcaagacccagctctagagtcacctccarccccttacccaccagccccctctccaagtctgtgtcccacaacccccctgctccctccagggcaccctccaccctctgggccacagttgtcaggagtcag

SEQ ID NO: 19086 - DNA, 201 bp, Homo sapiens
tttttcctccatcctctcacctaggtacccaagatattgtatttggagaagtagatcggtgagcaggggagcagcgtttgatcccccctgcctatcagctycttctgtggagcctgttcctcactggaaattggcctctgtgtgtgtgtgtgtgtgtgtgtgtgtgtgtatgttcatgtacacttggctgtcaggctttct

SEQ ID NO: 19087 - DNA, 201 bp, Homo sapiens
aatacctgccctggtgcctatcacttcctggatcacccacccccttgtgactgccagacccacctcttgacccaccacttgcctgaccctggttctaagcmaacggggctgggactagaggagtcggacaaagggtgggagaccagaaggggcaggggcaagaggagctatcaccagagaactctactgcccctttccact

SEQ ID NO: 19088 - DNA, 201 bp, Homo sapiens
acccaaccttcttccttgaacagggagagtttggggtgtacctggtgtctgatggcagcagccgcccttatcgatgcaagatcaaggctcctggttttgcycatctggtaagaatcaatcccagtaactataactccaatgaattaaacctgaccttggttgaggtttttatgaactcttctttctcctcccaccttgcaa

SEQ ID NO: 19089 - DNA, 201 bp, Homo sapiens
tgttcttctcttgctctgtctcatcttcttgaggtacctgtgccgggtggaggagatgcgccagtccctgagaattatcgcacagtgtctaaacaagatgsctcctggggagatcaaggttgatgatgccaaagtgtctccacctaagcgagcagagatgaaggttggctgcagggagggggaaagtgtggggtgttggaa

SEQ ID NO: 19090 - DNA, 201 bp, Homo sapiens
ggagtgatgcttcggggctcaggcatccagtgggacctgcggaagacccagccctatgatgtttacgaccaggttgagtttgatgttcctgttggttctcraggggactgctatgataggtaaggccccaatcctttcttggctgatattccagctagtttcccctgcctcactcttctctttgccacttccttctttacc

SEQ ID NO: 19091 - DNA, 201 bp, Homo sapiens
caacaaagcaagagtccgtctcaaaaaaaaaaaaaaaaaaaaaaatctgaaccaggtggagtggaaaatggcagatgtagacagcctttcctgagcgtgaragtctcctcattctgtgggttaggagttggtcattgaagggctgacgcttaagagcccagatctcccaactcccttagttggcccttccgggagccgccc

SEQ ID NO: 19092 - DNA, 201 bp, Homo sapiens
taggtcaattcccaggccagaagtctggctttcccctctttctctgcagtgaagaattccaccatctctgcttcctggtctgtctgcctcaccctgctgcrctgctggtgggctgtgtccctgggatcctgtctaggggatatctggggaaggcctctttccaggctcagagttggagagttgtacaaactctacgggtgg

SEQ ID NO: 19093 - DNA, 201 bp, Homo sapiens
aagctgcagtgtcctaggcagcccctcaggagccccccaccccagtcccagctcaagctgcctccagggccaagcagcccaaagtctatcctgacttctcycaggctggatcaaggcaaataaatgcagtccttcccatcccccaccaccatggccacatttgctgtgtttcaacaatagaaagaaggcccagggaaagag

SEQ ID NO: 19094 - DNA, 201 bp, Homo sapiens
ggcgagggaggggagagggtctagagttcgttcgtgccgaggtgaaatcagcggagtgggagactctgctttttagcttcagtaatttgaatgcacctctyctgtcatacctgagtagagctcagccaaagagccagaatgctcgctgtctctctgtcgttgaccttgaacaaacacttttctcacgttcatattcacctg

SEQ ID NO: 19095 - DNA, 201 bp, Homo sapiens
cctctggctgcttgtttccccaggaaatccccaggaaggagagtgcagtcagcagtctctttcctttcccagaagtggaccacctcctcttgcctctattyccctattcactctgctttgtcacctcctgtcccccgcatatcatatccgtcagaatacttcctttccccctcccttcctgctcaggtcggtaatacctgc

SEQ ID NO: 19096 - DNA, 201 bp, Homo sapiens
cccttccgggagccgcccggtctcttgtgcaggaaggggaaggggccaaagcatgggggaaggcgtggcaggaagagggggactctgtggtcagggaactkctcgctgagcacagctgcacagtgctgtcagaacggccgatctccagcccaagatgattccagcagtggtcttgctcttactccttttggttgaacaagc

SEQ ID NO: 19097 - DNA, 201 bp, Homo sapiens
catcactaggacccagaatgtccaggaaggtagagggaggaatgatggtgaaagaacctgaatttcctgaaggagcctgactgcttgctgcaaccagaacsgtcccctccgcacaccatgcacttgtcaaacttcttcttggagccaatgatgcgatcacagccagcatggatgcatcggccctggacacagaccgaggag

SEQ ID NO: 19098 - DNA, 201 bp, Homo sapiens
aaagcagagggagcactgcgggtgtgtgtgaccatagacagggcctgggggtgtcctgaccctcacccgtggctccagcacatagtagtagcccagtgccygggcctggcaggtgagtttgcactggtcctggggggccacgcctgtgtagcgaggaacccagtccatgggccctgggaagctcttgaagaggtcggtgcg

SEQ ID NO: 19099 - DNA, 201 bp, Homo sapiens
tggttcttccagccctcatggttggcatcacatatgcctgcatgccattaacaccagctggccctacccctataatgatcctgtgtcctaaattaatatayaccagtggttcctcctccctgttaaagactaatgctcagatgctgtttacggatatttatattctagtctcactctcttgtcccacccttcttctcttcc

SEQ ID NO: 19100 - DNA, 201 bp, Homo sapiens
catctaagagtcctcttcctggttatagtggagattaggaaattaacaaagtatggaatggtgagttagaaaatctatagggagaggctaactccttgctrtcttttgggggatcccaagggaataaccatgtggctctgaactatttcttacttctcagatgtggaccctccaaaggacacaattgtgaagaacattacc

SEQ ID NO: 19101 - DNA, 201 bp, Homo sapiens; identical to SEQ ID NO: 3347

SEQ ID NO: 19102 - DNA, 201 bp, Homo sapiens
tgcactgtcagcccctcgacctgcacaccggagtcctgctccagctctagtagcagcgtctccccaaaggcctgcaagcggcacaacagcctggcaggggygcccgagccaggcaggacgctgccgttgagcttctctggaaacacgatctcctcctcccgggggagggggctggccagccgggctgagggcaggagagag

SEQ ID NO: 19103 - DNA, 201 bp, Homo sapiens
gtgccaggctctgctccacccagcagctcaggcgcctggcccaggtactgcactgtcagcccctcgacctgcacaccggagtcctgctccagctctagtarcagcgtctccccaaaggcctgcaagcggcacaacagcctggcaggggcgcccgagccaggcaggacgctgccgttgagcttctctggaaacacgatctcc

SEQ ID NO: 19104 - DNA, 201 bp, Homo sapiens
agacctttactgctggggactgtgtcagtaggagatgccatggccaggaaggggtggggtggggagagggagcagttattcccagcccagagtctgtgacycacctctgagaaccctcggtgggtctggctaggagaagggtgaaggggagaggcctgagccttaccaagaaaggaggctcatggagaaaggaaaggcagg

SEQ ID NO: 19105 - DNA, 201 bp, Homo sapiens
aaggcaccatgtcacacaactccaggaacatcatttgcatcatagtctatgtagtggcgcttcttagaattgtgcagtgcatggcctgcggtgctgactgsggcctcacctgacgggtaaacagaatggctgtgtcaaagtggtcagggtccgagtcctcaggggtgttgaggccccgctgccaggcacagaagctgcgca

SEQ ID NO: 19106 - DNA, 201 bp, Homo sapiens
gggggcctgggactttgacactaattcccagcacgttctatgaagatgtttgagttctacgagcgagtgtctggagcccgaatgcatgctgcttatatccrgccaggaggagtgcaccaggtgagcaggtccccggcttccccaaatgtccagcccaggcctattttccctgtggccactggagggcagtgctggatgatg

SEQ ID NO: 19107 - DNA, 201 bp, Homo sapiens
catgagccatcacaggggccatgacatggcgagaggtgctcaaaggcccattcaaactgatgcatggcttggagttgtcatggagcatgttgaagacatgrcctgtgggagcaaaggccctgataggatctgagggtcccttccccatgccctgagggactccataataaatctggctgcagctgtggatgatcagatcca

SEQ ID NO: 19108 - DNA, 201 bp, Homo sapiens
ggcctgggactttgacactaattcccagcacgttctatgaagatgtttgagttctacgagcgagtgtctggagcccgaatgcatgctgcttatatccggcmaggaggagtgcaccaggtgagcaggtccccggcttccccaaatgtccagcccaggcctattttccctgtggccactggagggcagtgctggatgatggaa

SEQ ID NO: 19109 - DNA, 201 bp, Homo sapiens
tgggacctgcggaagacccagccctatgatgtttacgaccaggttgagtttgatgttcctgttggttctcgaggggactgctatgataggtaaggccccartcctttcttggctgatattccagctagtttcccctgcctcactcttctctttgccacttccttctttaccctacttctcagtgtctgtgggagctcttgt

SEQ ID NO: 19110 - DNA, 201 bp, Homo sapiens
ctcctgacctcaggtgatccttggcctcccaaagtgctgggattacaaagcgtgagccaccacacccaacccagttttcttttaatagagaatttactgtrtagtaagagattcgggttttttttatttttttattttttttgagacggtgtcacgctctttcaccaggctggagtacagtggcatgatcttggctctctg

SEQ ID NO: 19111 - DNA, 201 bp, Homo sapiens
tgcttgaacctggcaggcagacattgcagtgagccgagatggtgctgctgcactccagcctgggtgcagagtgagactctgtctcaaaaaaaaaaaaaaaaggtaatcttcttgagggtaaaagttcatttagtgcgagtaagcattaggtataccatttcctgactggttggccattcattggatacatttggaggacag

SEQ ID NO: 19112 - DNA, 201 bp, Homo sapiens
cccagggaaagagcaaggaatgaggacaacagagggaccaaacctctgccctggctctgtggcagctgccttgtctagcccaggtcctggtcagttcccayagctaaggatctggccccaccctttggtacagttcccattaggtcaattcccaggccagaagtctggctttcccctctttctctgcagtgaagaattcca

SEQ ID NO: 19113 - DNA, 201 bp, Homo sapiens
tcagccctcagctgtctctttccctttttggtgggacagagccccaggagaggcagagagtgagggaaagggcctggccggcatgcacagataggatcackgtcctgggagaattcctgctcttatagtctaacctaccatggcttctcttttctcaaggctccctcatgctgccctttggccctagtggctggtttccag

SEQ ID NO: 19114 - DNA, 201 bp, Homo sapiens
  misc_feature (1)...(201): n = A,T,C or G, or insertion/deletion polymorphism (see Tables 1-2)
ggaggagaactggacaccacccccacaggtccgagagcagtcaccccatggtccccaaggaccccagccaccagcctgtggaatctgcaaaggcacagaanggaagtggggcataagtgaactctctcctgggcttaaggccagtccccacacccccgggccctttaccccacccctgccctaggatctcacattgaagtc

SEQ ID NO: 19115 - DNA, 201 bp, Homo sapiens
tgagccaccgcgcctgaccagtatgtcagttttttaaatttttattattttttgagatggagttttgctcttgttgcctaggctagaatgcagtggcatartcttgtctcactgcaacctctgcttcctgggttcaagtgattttcctgcctcagcctcccaagtagctgggattacaggcatgcaccaccacgccctgct

SEQ ID NO: 19116 - DNA, 201 bp, Homo sapiens
ttttcctccatcctctcacctaggtacccaagatattgtatttggagaagtagatcggtgagcaggggagcagcgtttgatcccccctgcctatcagcttyttctgtggagcctgttcctcactggaaattggcctctgtgtgtgtgtgtgtgtgtgtgtgtgtgtgtatgttcatgtacacttggctgtcaggctttctg

SEQ ID NO: 19117 - DNA, 201 bp, Homo sapiens
agttaggggtgcctccctccaggggctggaggtggagttcagccccccgatattgtaacacgcctaacagggctcccccatcccagtgcagagatgccacygactccggatctccattgatggtgccagtcaggtaggtgccaggctctgctccacccagcagctcaggcgcctggcccaggtactgcactgtcagcccct

SEQ ID NO: 19118 - DNA, 201 bp, Homo sapiens
gagaagggtgaaggggagaggcctgagccttaccaagaaaggaggctcatggagaaaggaaaggcaggcagaagggagggaagcagaacggccagaagtgkaagtgggtggagagagggtgaataggggtcagtaggacagacatggcgggaggacaccgcaggacacagactccagagatgcctaccttggctcttcggg

SEQ ID NO: 19119 - DNA, 201 bp, Homo sapiens
cttgatgagttggaggaggtaagctaggagtcaatgggaaaaatctctcccccacaagaagggctagagaaatacagagatatttgaagagtgtgaggaaragtattaacacaccagttttcttgatcaatagttgctgaccaacaataggatctggcgaaatcggacaattgacattggggttgtaacagcagaagaagc

SEQ ID NO: 19120 - DNA, 201 bp, Homo sapiens
agtaccacatctgtgggggagggcatcagcgtgtattcaccattgagggcataggagccatctggcagcttcagggccaagtagatgctccggtggccagsgtttccctgctgccggacaagaatgtgggtggcccccgcggggatagtgaccacattgttgtatccgtacctgtgtggaaggagtagatggggagctcag

SEQ ID NO: 19121 - DNA, 201 bp, Homo sapiens
ccactggagggcagtgctggatgatggaaactccaaacctgtatcgctgggggagggggtgctgagagggctctccttagtgaaggctatgccacattcartagcacttccgtttggcttctaggacctaccccttgggcttatggatgacatttatcagttttctaagaacttctctcttcggcttgatgagttggagga

SEQ ID NO: 19122 - DNA, 201 bp, Homo sapiens
gcacagtggatccgaggtatgtccccccaactttttctgtggcccactgtgagcatagcatagtgccttttccaccacttccccgttgaacccaagcttaktgttcagaccccaggctctgcccagacctctctgtccgcctcagtgcttggctcctatatcctgtcttctccttgtcttcacagtgctgtttggagaaat

SEQ ID NO: 19123 - DNA, 201 bp, Homo sapiens
tgtgtgaaggggattgaccagaaggaggtatgggataccctccctctcttgccactcctgccctagtttgcagtttgccacagtgattttaaaggcagcakcagaagccagacaccaagccctagggcctcaaacctgactcctatagctgggagtgggggatgaaaatcaaatttggagcagagaaaagagccaaggcca

SEQ ID NO: 19124 - DNA, 201 bp, Homo sapiens
attttaccacattttactatgctctgcctttgaggtatttgctttgaatgtgtctgtatggtggaaatactgtataatggtgtggtattcttcccaatgcygcattcagttacatgatattggtaacttaaaattggccattgtgggagtatttttaccatggaaattggcaaacatgacaaatcagagtcctccctcact

SEQ ID NO: 19125 - DNA, 201 bp, Homo sapiens
agtctcctcattctgtgggttaggagttggtcattgaagggctgacgcttaagagcccagatctcccaactcccttagttggcccttccgggagccgcccrgtctcttgtgcaggaaggggaaggggccaaagcatgggggaaggcgtggcaggaagagggggactctgtggtcagggaactgctcgctgagcacagctgc

SEQ ID NO: 19126 - DNA, 201 bp, Homo sapiens
tgcatacctcactgcgtgacaaggtaatcacctccttcatagccagcccattccagtggtggacagttctggccctcagaaagtcagttctaattctactragccaaaattcgcctcctctagctatgctatttattctgggaggaagtgagaactacacaaagacagcagcatttctcaccccttcccacactgcagagg

SEQ ID NO: 19127 - DNA, 201 bp, Homo sapiens
cctgctctactgtcccctcccaagggctcccatcccccctactcctcacctgagccagttgggcagtcctcagtgttgcaggagcggaagcgggtacggcrgccctcacagtacttgccaccattccgggggacaggcctcgtgcagtctcgggaggagaactggacaccacccccacaggtccgagagcagtcaccccat

SEQ ID NO: 19128 - DNA, 201 bp, Homo sapiens
ttaaatgaaaaataatgaaaatattcacttttaaaatctttcctttggggtatatttcctctgagataacctgggataccaaccttaatatgcaatctgcyggcaaataatccaagcagctaaattataacttgccccactgcttccttcaagagagcagctatatgtcttaaataggtcaaatactgctacagtgaaagt

SEQ ID NO: 19129 - DNA, 201 bp, Homo sapiens
atcacttgacattccaaacactgctgattctttgggagggctgtcctttgagccagggttggtcagaacctgtaataatcctgtttgtcctccaaatcacrtagtgtccctaacgaacaatctcattggtaggcgggttcccacagatcttcagatctaaacagcggttggcttttagacattatatatattatcagagaa

SEQ ID NO: 19130 - DNA, 201 bp, Homo sapiens
aagcagctaaattataacttgccccactgcttccttcaagagagcagctatatgtcttaaataggtcaaatactgctacagtgaaagtttccataatactrccaccataccagtgaacaatctattgcaagtaatatctataatgagattctggtaccataaggccgggcgcagtggctcacgcctgtaatcccagcactt

SEQ ID NO: 19131 - DNA, 201 bp, Homo sapiens
agaacatgaaaaccgggggtcacctcctaaaggtaacctcaagggccagttcagaaagggcacagtcagaacccttcctccttcacaaggagattctcaaycacttgacattccaaacactgctgattctttgggagggctgtcctttgagccagggttggtcagaacctgtaataatcctgtttgtcctccaaatcacgt

SEQ ID NO: 19132 - DNA, 201 bp, Homo sapiens
catctgcaaattcactgaagcgactcccttctgcccctgattataatctgttagtggaaaagcaaacacacactgcagtgtaccctagtttaaattcatcytctgtattccagccaaatcctgacaatcatagtgtaaatgatgagaaatgcattttggatgaacaggaaactgtactttctaatgagatttccacactta

SEQ ID NO: 19133 - DNA, 201 bp, Homo sapiens
gctggtctcgaactcctgacctcaggtgatccgcatcggcctcccaaagtgctgggattacaggtgtgagccactgtgctgggcttgaagttcattttaaygtaagaatttacaaaatttgggctgggcgcggtggcttactatgggaggccgaggcgggtggatcactcaaggttcaggagttcaagaccagcctggcca

SEQ ID NO: 19134 - DNA, 201 bp, Homo sapiens
aggggcgggcatacgcagcctccctcggctcagcctgctactggggatgcagagcgtcctggtcgccatgaaaacaggccacacctcggcgatcccggccsgtggtttgcaagtgcgcaggcgcgcgcccccttccgcgcatgagcagtgctgctcccaacccgccagtcgcggtctccggcgccagctacgccgctgccg

SEQ ID NO: 19135 - DNA, 201 bp, Homo sapiens
cacacctcggcgatcccggccggtggtttgcaagtgcgcaggcgcgcgcccccttccgcgcatgagcagtgctgctcccaacccgccagtcgcggtctccsgcgccagctacgccgctgccgctgtcactatggcccattacaaagtgaggggggcgcggcgtggctgggggcatgcgggcggtagcaagccgctggtcgg

SEQ ID NO: 19136 - DNA, 201 bp, Homo sapiens
ttctattccaggtgttgctatagatggagagaacaacatgaggcagtcaccccaaacagttttctccttgccagctaactgcgattggaaaccgcggtggyttagagctacatggggttcctctacagaacatgaaaaccgggggtcacctcctaaaggtaacctcaagggccagttcagaaagggcacagtcagaaccct

SEQ ID NO: 19137 - DNA, 201 bp, Homo sapiens
aaaccgcggtggcttagagctacatggggttcctctacagaacatgaaaaccgggggtcacctcctaaaggtaacctcaagggccagttcagaaagggcayagtcagaacccttcctccttcacaaggagattctcaatcacttgacattccaaacactgctgattctttgggagggctgtcctttgagccagggttggtc

SEQ ID NO: 19138 - DNA, 201 bp, Homo sapiens
aaagtgttgggattacaggtgtgagccaccccgcccagcctatattcttaatagagaatatatacactcctcctccaggtatcatgtttttttcattgtaytgtgatgtctaaatataagtgattttaaattcctgacatttaagtatattattggtaacagattcacactttggccaggtgtggtgacccacacctgtaa

SEQ ID NO: 19139 - DNA, 201 bp, Homo sapiens
ataaaatatttggaaaagaacttaatggtaaccagttaatggaaaaaagagaaactgaaggcaaagacagcaaaaggaactactactctagaggtcaccgytctattccaggtgttgctatagatggagagaacaacatgaggcagtcaccccaaacagttttctccttgccagctaactgcgattggaaaccgcggtggc

SEQ ID NO: 19140 - DNA, 201 bp, Homo sapiens
ccagtttttatgtcatttgctatgaaagctttaatttgtagctaaatactactgctccttctttcaggaaatactatgtgttgtcctttatgaaaaaaatmttttctttctttttatgattataaaagtaaaatgcttatagtaaaaaattaaaatacatgtaattacaatatattaagtatataatttgtaatcccaaca

SEQ ID NO: 19141 - DNA, 201 bp, Homo sapiens
cctctggtttcactgaatgccatatcttactgaattatcaaatgaagcatattcgttttcctatgtgtataaatgagatttaaaaatcactgactttttgrccgggcacggtggctcatgcctgtaatcctggcactttgggaggctgaggcgggtggatcacgaggtcaggagatcgagatcatcctggccaacatggtg

SEQ ID NO: 19142 - DNA, 201 bp, Homo sapiens
agtgctcccttcagaatggaagaatttatctgcctcttatttgatgtggatcagagctaagatggctgactaaataaacatgggggactggaatctccttrgagatactctggaggaagttcacatccactccaccatgattggaaagatctggctcaccatcctgttcatatttcgaatgcttgttctgggtgtagcagc

SEQ ID NO: 19143 - DNA, 201 bp, Homo sapiens
ggtggtgcatgcctgtaatcacagctactcaggaggctgaggcaggagaatcgcttgaacccaggaggtggaggttgcggtgagctgagatcatgccattrcactccagcctgggctacagagtgagactccgtctcaaaaaaaaaaaaaaaaagaatataattttaggccatgcgcattggctcatgcctgtaatcccag

SEQ ID NO: 19144 - DNA, 201 bp, Homo sapiens
ttcctcatctgtaagatgggggaaacaacatacttaccgcataggattttagtgatgaacacatcttgtatcttagtagtttgtttgattgtgtaacagtkccctttatataaaggggacaggacatacatttatattttaaatgaaaaataatgaaaatattcacttttaaaatctttcctttggggtatatttcctctg

SEQ ID NO: 19145 - DNA, 201 bp, Homo sapiens; identical to SEQ ID NO: 3365

SEQ ID NO: 19146 - DNA, 201 bp, Homo sapiens; identical to SEQ ID NO: 3366

SEQ ID NO: 19147 - DNA, 201 bp, Homo sapiens; identical to SEQ ID NO: 3367

SEQ ID NO: 19148 - DNA, 201 bp, Homo sapiens; identical to SEQ ID NO: 3368

SEQ ID NO: 19149 - DNA, 201 bp, Homo sapiens; identical to SEQ ID NO: 3369

SEQ ID NO: 19150 - DNA, 201 bp, Homo sapiens; identical to SEQ ID NO: 3370

SEQ ID NO: 19151 - DNA, 201 bp, Homo sapiens
aaaggaaatggaggccctgtttctgggggcaatcggctggcatgccaggaagggggccttggcagagcctagagtcagacagggtgatgacaaatgacccyggggcccctccagcaccgcccctggggactctgccttgcccactctactccagccactcaggcttccttctgttccttgaaactcagcaagctcatctcc

SEQ ID NO: 19152 - DNA, 201 bp, Homo sapiens
cttgaactgcagcaatgcatttcttgatcagttcgtcctgcctttctaggtcactcactcccctcccaatacacctaatcttagctcccaagacctttgtstcttgctcagcatttgcccacatgactttccttcctttcttattacctagcccgaccgtattacttcgtattgtcaacatcatctctggctcctgtgtct

SEQ ID NO: 19153 - DNA, 201 bp, Homo sapiens
aagaagtatcattgtgaaacaaggaaatgtcagtcaagaaatattccttggaatataaaacaaagccttgactctgctggcataggtctgagttttcataractggagcttcacaaatctgtaaaactcataatattaatgggtgctttttcagaaattatagaatagctgccacctcttctaaattaagcattgactgtc

SEQ ID NO: 19154 - DNA, 201 bp, Homo sapiens
gacttcgaatatcagtaaaatcagttgataaaaccaaagcagggtttgagaggatgcactcccaattttgaaagaagttcttgtgtgggtgaacgctatcrtaccaaacagcatcgcaagctacagataaatctttcgtgatagagtcaattgacgtgacaaacttcattgttgtcattttaaggcattgccacagtcacc

SEQ ID NO: 19155 - DNA, 201 bp, Homo sapiens
tttttaattcttatttaacattaattgaataaagaccattgaactgagattacagtttagaatttgttactaataaagctatataatctcctataatttasttaacctttccaggcttcaatttcctcatctataaaatgacagactaaataatctttaaggtttcttctagtagaatagaatgttctgagattttgttta

SEQ ID NO: 19156 - DNA, 201 bp, Homo sapiens
tatttaacattaattgaataaagaccattgaactgagattacagtttagaatttgttactaataaagctatataatctcctataatttacttaacctttcyaggcttcaatttcctcatctataaaatgacagactaaataatctttaaggtttcttctagtagaatagaatgttctgagattttgtttaaatcaaattat

SEQ ID NO: 19157 - DNA, 201 bp, Homo sapiens
gcttcctgagccaggagaagaaagaaaacagtgtgtgtggagccctgtacctgtcaaggttaaccaggtcatactgtggcaacaatcccacaatctctgtrgcttacaacagaaaagatttatttctctttcatacccgtgtccggaaccagttggctctgacttgattccatgttgtccacatttcaggatttaagtgag

SEQ ID NO: 19158 - DNA, 201 bp, Homo sapiens
gcaggatttttcagactccttttggcatctgaaaacattcagcaacttcaagaactgtccttccttggaggagggcaaaaatggtgctcatcccctatcaygtaaagcaacatggtaacaacacaaggtaagaatggaaacagaggaaacaaaatgggagaagaggggaaaatatttaaaatgattacaagaaaatcagtc

SEQ ID NO: 19159 - DNA, 201 bp, Homo sapiens; identical to SEQ ID NO: 3373

SEQ ID NO: 19160 - DNA, 201 bp, Homo sapiens
ttgggtatcattgaaacttctattggagtgatttattaaaatattaacatagtattgcattatcagagttggcaagaggaagctttctttgaagtctcacrtgtattaaatgtttttcttcccagactcaaaattcactttaactccaaattgtctaaattttaaaacttttggtaaagaaacttggcctgaaatacagtg

SEQ ID NO: 19161 - DNA, 201 bp, Homo sapiens
atactgtatgtgggcaagggataaaaatccattttatttttatggtctcatattgattgcatttgtaaaatttgactccttatatattcaaatgcctcacrtgttcttaatagaatgtcttttaaacaacagcgtagtatagcaaaaagaggattggactgaaagttgggaaacctgggtgaccttccggctgacatagtg

SEQ ID NO: 19162 - DNA, 201 bp, Homo sapiens
gacgtcagcctcactcttggactttgctactcagcctgtcacccctgtgaattcccatgaggttgacagtgtaaacctgctctaagttttcactttgcacygtgtaccaaaatgaaactgcttatttaggaaaataaaaatatcttttgtgttggacaaaatacagagcgcctatcttctttttctgttgtgtttcagtta

SEQ ID NO: 19163 - DNA, 201 bp, Homo sapiens
tactaaattagatgctgtaattttgataaaatgaaaaatctgctttatttgcaacaattgttttcttccttgacgtcagcctcactcttggactttgctaytcagcctgtcacccctgtgaattcccatgaggttgacagtgtaaacctgctctaagttttcactttgcactgtgtaccaaaatgaaactgcttatttagg

SEQ ID NO: 19164 - DNA, 201 bp, Homo sapiens
tgaaaacaaagaaagtcaattcgagactattaaaaaagtcaatttgagactatttggtgagaatgtggtaactttgatacacataaggctgttacacttaygattttctaataacttctgaaagttctgtttaaaacagagtcagcctttccagttgctttctgtttgactattctcatgaaataaatggttaccaaactt

SEQ ID NO: 19165 - DNA, 201 bp, Homo sapiens
ctttcaaaaatcaaagctcttcggctttcttttccttcttttctttccttgtttatataaactttaggaatgtatgtgcgattttttttttttgacagggwctcagtctgtcacccaggcttagtgcagtggtgcagtcacagctcactgcagcctcaacctcccagggtcaggtggtcctcccacctcagcctcctgagg

SEQ ID NO: 19166 - DNA, 201 bp, Homo sapiens
agcgtaggggagactgagaagacaggttcaggttagtaagggcgctcatattttgacactgaatgttaactatgtgcacatcatgctagctattctaaatyaggcattttcaaatggaagcaggcactgacatttttgagcaaagacgtgatgttatgagataaatatcttaggggacttttttatatttttatagcagga

SEQ ID NO: 19167 - DNA, 201 bp, Homo sapiens
accactaataatcagacctgattctggaaaccctcttgacactgtgttaaaggtaaattttcatatgtaactttattattagaatccctctgtaggccagstgcatcaatactacttttcatttatatacacacaatttcagagctgtgtggaccagtcccctttattttagagttgcagcccagagagagtaatagattt

SEQ ID NO: 19168 - DNA, 201 bp, Homo sapiens; identical to SEQ ID NO: 3372

SEQ ID NO: 19169 - DNA, 201 bp, Homo sapiens
gtgttgggacataggggctttcatgtggaaaggaaaaaagaaatagaagaaaagtctgcagggagaagggggaggaccttacacatagcaatctcagctgrcacacctaattgccgttttccccttagctcagctgaactgacagtctcttaccttggtgtcagttaagtactgttcccaggtgcctttcaggcactttag

SEQ ID NO: 19170 - DNA, 201 bp, Homo sapiens
tcttagagttattcaaggggatggagtagatattaataccttacaagaggtatgtgttttatattaaaagtttcaataaggcatttcttataattaagttygtttatgtttgataaagaacacaatataaatacaattttaagtctttgtaagtgtttatgttggtataaatctctgtgcattgcttaaagtttagaaata

SEQ ID NO: 19171 - DNA, 201 bp, Homo sapiens
tcaacctcccagggtcaggtggtcctcccacctcagcctcctgaggagctgggactgcaagtgtgtgccaccacacctgactcttttttttttttttttttaatgttttgtagagatgggggtctcactgtttcccagtctgggaaacagtctcaactgtttggcctcgaactccttgactcaggcctcctaaagtgctga

SEQ ID NO: 19172 - DNA, 201 bp, Homo sapiens
atcaaacagtatttctgcggtgatggtgtatttagagttccaatatgaggcgtccggaatagatctcttgtaataacagagatgaggtttcttccactacstcttccaaactgccttgcttaagagaagtgggaattccttcagctaagacatttggtgttgggacataggggctttcatgtggaaaggaaaaaagaaata

SEQ ID NO: 19173 - DNA, 201 bp, Homo sapiens
tggggtatgtcaccttttaattacttctgtgttactaccttccttatgtatctaggtagaatgtggttattgagtgcatttgtcaaagattgatgtggccrtggactgttaatatgttgttgggtactactgaccttaactcagaaacaaggaaagaagggagatattaggtaataacagacctaaggagacagagatttg

SEQ ID NO: 19174 - DNA, 201 bp, Homo sapiens
aaggtatgtatttttaagacataatgctattgcacacttaatagactacaatgtagtataaacataacttttatatgcaatgggaaatcaaaaaattcccrtgacttgctttattgcagtggtctggaagcaagcccacagtattttcaaagtatgcctgtattgtcttaaaatttttgcctcgtttactaaataaggttc

SEQ ID NO: 19175 - DNA, 201 bp, Homo sapiens
acagataaatctttcgtgatagagtcaattgacgtgacaaacttcattgttgtcattttaaggcattgccacagtcaccccaaaaccttcagcaaccctgatcagtcagcagccatcaacaacagggcaagaccctccaccaacaaaaagatgactcactgaaggctcaagtgaccattagcattatttagcaatgaagta

SEQ ID NO: 19176 - DNA, 201 bp, Homo sapiens
tacagataaatctttcgtgatagagtcaattgacgtgacaaacttcattgttgtcattttaaggcattgccacagtcaccccaaaaccttcagcaaccctgatcagtcagcagccatcaacaacagggcaagaccctccaccaacaaaaagatgactcactgaaggctcaagtgaccattagcattatttagcaatgaagt

SEQ ID NO: 19177 - DNA, 201 bp, Homo sapiens
ctacagataaatctttcgtgatagagtcaattgacgtgacaaacttcattgttgtcattttaaggcattgccacagtcaccccaaaaccttcagcaaccctgatcagtcagcagccatcaacaacagggcaagaccctccaccaacaaaaagatgactcactgaaggctcaagtgaccattagcattatttagcaatgaag

SEQ ID NO: 19178 - DNA, 201 bp, Homo sapiens
ggaaagaagccatctccatgagtgcagaatgaagcagcaagtgctgatgtagaagctgctgcaagttacccagaagatctagctaagatcattgatgcagrtgactaaacagattgtcagtgtagaggaaacagccttccattggaagaaggtgccgtctaggactttcataactagagagaagacaacatctgctttgaa

SEQ ID NO: 19179 - DNA, 201 bp, Homo sapiens
tattgaccgtgttataaaacagtcttggatgcttcattcatcaatattgtcccttgaaaataatctccattctcttccaaattaaggtttggtttggtttkgttttgttttaatcttctagattgtagaaggcatgaaacaaaaaatgtggagtattgaaaatattgccttcggttctggtggaggtttgctacagaagtt

SEQ ID NO: 19180 - DNA, 201 bp, Homo sapiens
ttccagcagtcttaaggtaatgaagtccagaccaaggtgctaaataaatggaaagaaataggtaaacatgagcaatggcttgggagataaaattgctcaaagttggtaatttgagttgggactcagtagaaaatagattcagctgacgtttatgagcattgtattagtaaggccttgttgaacacttttacatacaacttt

SEQ ID NO: 19181 - DNA, 201 bp, Homo sapiens
ataagccctgacatatacttctagcttttgatgagtcttccctgtaccttttagtatatcactatctgttgtacttaaggaaaacagctccaagtctcctrcttgacttaaactctcagatcacttgttactataaagatttacctccaaggttgtctgtgtgctgcattaggggctatttttatagagttgcaagtatgc

SEQ ID NO: 19182 - DNA, 201 bp, Homo sapiens
ggcgaaccggctcctcgtggcactggcaaagctgggaacgccccctccaggccccgccctcccgcgcccgtgccgggaactcgaacttaggtaagcgcccrggtcacgcgccggggctgccccgctgcctccagcttcccagagctggcgtctgggaggaagagcgcgtgcatcacgtcctcctccccgccccgcctccgg

SEQ ID NO: 19183 - DNA, 201 bp, Homo sapiens
tggcctggagctgggaccagttaggtaacggccccggggacccgcagtggagagtgagcggggctttccccgccgggccagcccggcgcgctcgcccctgsctgggcaggtaagtctcccggggcgcgaggtgggagaagtcctggcgcgggcgccggagcagccgcggtcctctgcggctccggcgcggaggacactcgc

SEQ ID NO: 19184 - DNA, 201 bp, Homo sapiens
agaaagtttgaatggtctgaatagaagatcaaagcaaccacaacatttccttaggctaaagcctaatccagagcaaggccctcgtttcaattctgtgaagmctaagagaggtgatgaagctgcagaagaaaaattggaagctagcagaggttggttcctgtggtttagggaaagaagccatctccatgagtgcagaatgaa

SEQ ID NO: 19185 - DNA, 201 bp, Homo sapiens
tcattatatctgttatggtgatctgtgattagtgatcttcgatgttactactgtgattgttttagggcaccacagggcacacccagataaggcagtgaacytaattgataaatactgtgtgtgttgtgactccttcaccagttacccattccctttctctgctcacttcaagtttccctatgccctgagacacaacagtat

SEQ ID NO: 19186 - DNA, 201 bp, Homo sapiens
agttttcatcagtgcctgtatctgtggtcagcgatagctatgacatttataatgcgtgtgagaaaatatggggtgaagatctaagacatttaatagtatcragaagtacacaggcaccactaataatcagacctgattctggaaaccctcttgacactgtgttaaaggtaaattttcatatgtaactttattattagaatc

SEQ ID NO: 19187 - DNA, 201 bp, Homo sapiens
attgggtaaggtatggttgacccagctacttcatttgccttacgatgtatattcattaaactaagtcactcaccttctctgtgatgttgatggtttggtayagtaaacatgagatatgattaaaggtgattcagggatagatcaagtgtctgcctaagtaaatctgtgttttcatttttttttctagtaccataacagctt

SEQ ID NO: 19188 - DNA, 201 bp, Homo sapiens
tccattttacttaagttttgtctgtttttttccaatcagcttaaaatgctgtttatgatatttagataggttcttgaaatcgagccaagatccatcaacargttgtcttttagatgcaagtttaaagtattgcaaaatccgaacactatcaagtatgattcttgaatattgtcaagtatacgtgataatacctcaagtatg

SEQ ID NO: 19189 - DNA, 201 bp, Homo sapiens
catcgaaatataagaggtccaagagggtgtttgaaacacattttgctaagttgacaggaaattaatagactttttatgggccattaactaataatacactsaaaaaaaaggtacagttaaataaaggttttaaatagtctataccgtatactaaaactaaattaatatttaggactgaaataacatattgattaagtacca

SEQ ID NO: 19190 - DNA, 201 bp, Homo sapiens
tggaatacagtggtaaaacatagtactctcatgtttttgttttgattctttttttttcctttgtttttagccctcctccgatattccgagaaagtattttrgagaattccattttacttaagttttgtctgtttttttccaatcagcttaaaatgctgtttatgatatttagataggttcttgaaatcgagccaagatcca

SEQ ID NO: 19191 - DNA, 201 bp, Homo sapiens
cataccaggcaactcagtgattggccattttagatagtaccttgttccactagcattttttatgcatcaaatcatctcacaatttgaacaccattggcatstctgtatttgactggttggttagtctaattcatcaaaccaggattcaggtattttgcttaataatgtaatataatcatgaaatttccatttatgcaggat

SEQ ID NO: 19192 - DNA, 201 bp, Homo sapiens
ttctctgctatgtggacctggtgtgcttatcttctttgttgctgatttgagagctgagctatgtactatatctggaatgcacacagcaggcatcctgctgygcagttctgtgtctagttaatagtatggaagttcaggacatacctccaaaaaaaaaaaaaagctaggattttcctcagaaagaatgcagtattttatgtc

SEQ ID NO: 19193 - DNA, 201 bp, Homo sapiens
aaacttggggcaatttgacattgcctcaacatccaagtttcagtgtcctttataaactattgatccatgacagatcatgaaactttctaaaaattgatccwtttatcacatagtctttcaaaatattatttgcttctttgaagctttggatagaaacttgataatgtgaagttctctgctatgtggacctggtgtgcttat

SEQ ID NO: 19194 - DNA, 201 bp, Homo sapiens
aatttttaacaaatctgttaatttggatgcattaaatcatataatttggtgtgtgtttgatgttctaagtatgagaaaagttttctgaaataaaaggtttktttttttttttggaaaccgagtttcgctcttgttggccaggctggagtgcaatggcatgatctcaactcagcgcaacctccgcctcctggtttcaggcaa

SEQ ID NO: 19195 - DNA, 201 bp, Homo sapiens
ctccgccgaccgagcagtgacttaagcaacggagcgcggtgaagctcatttttctccttcctcgcagccgcgccagggagctcgcggcgcgcggcccctgwcctccggcccgagatgaatcctgcggcagaagccgagttcaacatcctcctggccaccgactcctacaaggtaaagctcggggcccgggcagatgaggag

SEQ ID NO: 19196 - DNA, 201 bp, Homo sapiens
tagtcactgaattacaaagtagacagtgaccttgattatacaacatatgcggaagtgtttcctgtaacttacgtgagtattttatcaaatacttatatatytgataaaagctaagtacataaagcataactcagtagatagaattctctagtagtaagctaaagtgcttcaagtattagttgtcatattaatccaagagaa

SEQ ID NO: 19197 - DNA, 201 bp, Homo sapiens
tgttgcttgtctttcactgcttctgagcggatgcttcggtattgtcacggtggctcctgagtcaacctgagcctcatgagtggggtactgttgcagcttgyaccccagagactgcctatgcattcataaagatatatgtgacattgtacatatatttcaatttttccattatgttttgttatataggaaaaacttgagcac

SEQ ID NO: 19198 - DNA, 201 bp, Homo sapiens
tctattaaatgataggccaatctgaaagtcttgtcttagcctgcaatatttggttttagcaaacttgataggtttcatgtttttactgttacgtaataaamaatgtacacagctagttatgagaaactgatttcatcaatggggaattttctctttgttagaatctttaatcagtttatttaggaaaaagaaatgattgtt

SEQ ID NO: 19199 - DNA, 201 bp, Homo sapiens
gcaccccagagactgcctatgcattcataaagatatatgtgacattgtacatatatttcaatttttccattatgttttgttatataggaaaaacttgagcmccataaataaaatatataaatcatgaatatacttcatagggagattaatttaggtcattaataattgagctggtgttctcgttgtgagttaatgaaatct

SEQ ID NO: 19200 - DNA, 201 bp, Homo sapiens
tgtttgagatcttttaaaattatttacattatatattaacaaatatttacacaggttgagcatcccaaatccaaaatgctccaaaatctgaaactttttgstcaaaggaaatgctcattggagcatttcagatttcagaactggatttcagatttcagaactggggatgcttaactgataagtataatgcacatattccaa

SEQ ID NO: 19201 - DNA, 201 bp, Homo sapiens
atcatcttagcagctctttttcaaacagatttgaagctgcttcaaataacaatctggtttataaaatgaaaatagaaaattatgatcttagaatgaagaartgaatttctaagccatgataattattacggttgctgtgattagacagacttttctgtggagcttcctgacaaccaagaaaaaaggggaaatcaaggaact

SEQ ID NO: 19202 - DNA, 201 bp, Homo sapiens
taaacatgagcaatggcttgggagataaaattgctcaaagttggtaatttgagttgggactcagtagaaaatagattcagctgacgtttatgagcattgtwttagtaaggccttgttgaacacttttacatacaactttcaagactaggaaactgggaaaataagagtgtctttaacaaagttttaagagttatttttagt

SEQ ID NO: 19203 - DNA, 201 bp, Homo sapiens
gagggttcagccagggctggacatcctttaatggcctcattcccatgtctggggcctcaggtcagatagctgggactaccgggtctcactccagaagaggyttcttcagagcatggtagtcttggggttctaagagaatgagagtagaagctgcaaaacctcttgaaactggggcttgggagtcacacatgactttctcca

SEQ ID NO: 19204 - DNA, 201 bp, Homo sapiens
ggatttccctagctctccttctctctcgttttgttttcttttgttctttaatagcaatcctttatctttcaatctgcagcctttattttgtgaaaataacraatttagaataaaggtagtgttcttggaatacttttagaatatgttggaataaagtcatcctttctcattttctgaaaaagcagggaagaagcaacagtt

SEQ ID NO: 19205 - DNA, 201 bp, Homo sapiens
aacctgctctaagttttcactttgcactgtgtaccaaaatgaaactgcttatttaggaaaataaaaatatcttttgtgttggacaaaatacagagcgcctrtcttctttttctgttgtgtttcagttatggattcagtcttcttgggtatcattgaaacttctattggagtgatttattaaaatattaacatagtattgca

SEQ ID NO: 19206 - DNA, 201 bp, Homo sapiens
tttttaaaaaaactgtcatacttggaacaaggatatttagccttgggaatctaattttttgttacagttggttggccagcactccttaatggaaaaagctrtccatcatttgacttagggctagaccgtttttgttctaggcattaaaataataccagttactgttatctagtatgtaataatttttagaagtttatcctt

SEQ ID NO: 19207 - DNA, 201 bp, Homo sapiens
atacttttttaaaaaaactgtcatacttggaacaaggatatttagccttgggaatctaattttttgttacagttggttggccagcactccttaatggaaamagctgtccatcatttgacttagggctagaccgtttttgttctaggcattaaaataataccagttactgttatctagtatgtaataatttttagaagttta

SEQ ID NO: 19208 - DNA, 201 bp, Homo sapiens
cttaggtttcatttcccttatgtttttaggggtccttataacctattttacatttttgtctttttatcttaggaaaaaggacaaaaatgataatcttgagkttagaagtaatgaaacttatttagaaattacacgagaatgttacatatccttatcagtgcttacaaactattggccaaagttgggaactctagtagtttc

SEQ ID NO: 19209 - DNA, 201 bp, Homo sapiens
atcaaatcatctcacaatttgaacaccattggcatctctgtatttgactggttggttagtctaattcatcaaaccaggattcaggtattttgcttaataakgtaatataatcatgaaatttccatttatgcaggatcttctccatactgtcttcaagaatggcaaggtgacaaaaagctattcatttgatgaaataagaaa

SEQ ID NO: 19210 - DNA, 201 bp, Homo sapiens
taatccgtgagaggaaataccctcgaaagttactatagaaataacaccttactatctggtggcatttacttagttcttagaactgactaattagtttatcrgttaaagtaatttgctattatattgtaaaatagtacatttgaggctcacttataaaaattggaaaacatcgaaatataagaggtccaagagggtgtttga

SEQ ID NO: 19211 - DNA, 201 bp, Homo sapiens
gctatcttgcttagctacttcttaaattttattaaagtgggatcagtccctggattctaaccttaataagccctgacatatacttctagcttttgatgagwcttccctgtaccttttagtatatcactatctgttgtacttaaggaaaacagctccaagtctcctgcttgacttaaactctcagatcacttgttactataa

SEQ ID NO: 19212 - DNA, 201 bp, Homo sapiens
acaaagaacattttcagtatacttttagaccaagatacagagttaaatagcttagagacatttccattttgcttttgactcttcgtcttctcagaaaaagraaataacttgccttctagtaattttaaatctgataaagaatgcatcattaagtacctgaacagtaagggtcaaactgtggagaaataaaactatgaatca

SEQ ID NO: 19213 - DNA, 201 bp, Homo sapiens
gtcattctatttactttctcatcctcagtgtctgaagtaggtacagagtatgtatttgtgaatgaagtatttataaaataacagttgatttgaatttatgmtatatcatccaattttctggtgaaggttcaaaatggcctgtttagtagaaagtaaaatgaagaggacagtaagctagcaaaactagaatcattataaatc

SEQ ID NO: 19214 - DNA, 201 bp, Homo sapiens
ttttttgtagagatgggttttcaccatgttgcccaggctggtctcaaaatcctgggctcaagtgatcagcccgcctcagcctcccaaagtgctgggattayaggtgtgagccaccacgtccaaccttaatgctagctgttaaactgtctttcaggggaggccattttaaaatgaaatcttggctctgttttcagtgataat

SEQ ID NO: 19215 - DNA, 201 bp, Homo sapiens
gctactcaagagactgaggcacgagaatcacttgaacctgagaagtagaggttgcagtgagctgagatcggaccacagcactccagcctgggtgatagagygagactccatctcaaaaaacaaacaaaacaaaactcatttaagataagtacataattattaaagacaaatttcatgtacatcaatgataagcagacctca

SEQ ID NO: 19216 - DNA, 201 bp, Homo sapiens
tgcaaggtttttatgtctgtccctgactgatgaccaaataccctatagcctgcacagctgcaagctgtatagccatacaatttgcaggacacacacacatacacacacacacacacacacacacacactaacatataatataatataatataatataatataatataatataatataatataattaatatatataaacctg

SEQ ID NO: 19217 - DNA, 201 bp, Homo sapiens
gagaaccactactggggaaaggacaaattcagggaaacagtgagctcaatggtgacgccagagctcacgtagcactgggggataccggggttctgatcagyccgaggagagacacctcattgaacatctcgggcattcagtagagaccccagaaaagtcatactttaggagtaggatttatgccttcttagaataaagact

SEQ ID NO: 19218 - DNA, 201 bp, Homo sapiens
gcaaggtttttatgtctgtccctgactgatgaccaaataccctatagcctgcacagctgcaagctgtatagccatacaatttgcaggacacacacacatacacacacacacacacacacacacacactaacatataatataatataatataatataatataatataatataatataatataattaatatatataaacctgt

SEQ ID NO: 19219 - DNA, 201 bp, Homo sapiens
accaaataccctatagcctgcacagctgcaagctgtatagccatacaatttgcaggacacacacacatacacacacacacacacacacacacacactaacwtataatataatataatataatataatataatataatataatataatataattaatatatataaacctgtgtgaacacactgggttctaagctccagtttt

SEQ ID NO: 19220 - DNA, 201 bp, Homo sapiens
agaaagtaataaggaataagaatgaaatttatgaacaaacatgtggaaggttggaagcaagagtggggccaacacgcatggggaggaagcatttgggcagygactccgcagacccagactcaagctgagctatacaacctccttacgcctcagtttcctcaactgaagaacaggaatgacaagtgcctgtttcataggacc

SEQ ID NO: 19221 - DNA, 201 bp, Homo sapiens
accgtcaccatatttccaggacatttttctcatccccaaaggaaacctcatgcccattaagcagtcactcctcattaaaatattagttatgaagactgtakcatttttttaaaaactcatgatataacattgattgaaaaaatcagtataggaaattgtgcattatgatgtaatagtaaaagaagcatataaaaatctgaa

SEQ ID NO: 19222 - DNA, 201 bp, Homo sapiens
tttgtgttgtggcaattgtatgatacctttaatgggaatatttcaaagacacttgttaagactttgttagaacaaaatgtagagggtgctggatgtccctsaatattcttccgcctcctgtaacttgtattgctttggaatttccagtggcctgacaatgaactactgcaggaatccagatgccgatacaggcccttggtg

SEQ ID NO: 19223 - DNA, 201 bp, Homo sapiens
acatcaaagataacaaggataatcttataagccagaggaaaacaatatcatttacatagagggacagtaatgaaagtgaccgatgccttctccttggaaayaatggcataacatctttaaagtgataaagagaaataaaaacagatcaacctaggacgacatgtccagccaaaacaaacaaataaacaaaaaaacccttta

SEQ ID NO: 19224 - DNA, 201 bp, Homo sapiens
agaatattcatagcagctttattttttataaccccaaactgtagacaatttcaatgtcaatcaataagaaaatgaataaataatttgtgaactagtcatayaatggcatactgttcagcaataaaagggagcatgtttttgatactctcaaatagtatggaagatgctcaaaaatattacattaaagaaagatgccagata

SEQ ID NO: 19225 - DNA, 201 bp, Homo sapiens
aatgtgaggattctgagaggttggagcaacattcctgggaggaacgaaggggagcacattctccaagatcccccaccaccggggtcctcaccggctgtgcttttttttttttttttcttgacagagtctcgctctgtcgccaggcaggagtgtaatggcccaatctcggctgattgcagcctccaactccagggttcaaga

SEQ ID NO: 19226 - DNA, 201 bp, Homo sapiens
cctgacacaatgcctggtgacagaatcaagtgtccttgcaactctcacggtggtcccagatccaagcacagaggcttcttctgaagaaggtaggaagtctrtggccagacaaccacaccctaggacgttgggatgaaaagagttgcaaaatcttagtgatatagaagccttccatgctcacacaattccaagtagaatgtg

SEQ ID NO: 19227 - DNA, 201 bp, Homo sapiens
acacactgggttctaagctccagttttctgaagggatatgggttgccaggagaggaagagcaaaagcaagaatgtagatgagaattaggaagtaaacagayatggagattaaaatgggcaggtacatggacaaaaaaccaggtctgacaaaaactggctttctgccataaatgactataaaagatattaaaaaacactttc

SEQ ID NO: 19228 - DNA, 201 bp, Homo sapiens
ctaggacgacatgtccagccaaaacaaacaaataaacaaaaaaaccctttaaaataaacgtgatgtaaatacgtattctgccacctccagaggaaacaagsaaaaaaacaaaagaatgtttccaaggcaggcttctgtattaaaagattttaaggaaagttattcaggtagaagaaaaataataccagatgggaactttaa

SEQ ID NO: 19229 - DNA, 201 bp, Homo sapiens
ctaagaagcgtttgctactttagatttttttttataataataatcttttaagtatgagaaatgtgcagacaggattagtgattgagagccatttgtgcttstggcaatcatatggtacttttatgggaatattagaaaggcactggtaatgaccttgttgcagcacaaaggagagggtgtggggtgcccctgcatattgtc

SEQ ID NO: 19230 - DNA, 201 bp, Homo sapiens
gtaactcggtcctgacactctatctggagacagtgtcagatcccacaagttaaggctcagtcctacaagactgccccactgcagatgccaatcccaagttscaggctgtgacctgtacttctgcccagctggataaagatctgtttttctatatgaccctccatgggtttgattactttgctagagtggctcacagaactc

SEQ ID NO: 19231 - DNA, 201 bp, Homo sapiens
ggtgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttact

SEQ ID NO: 19232 - DNA, 201 bp, Homo sapiens
tgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttacttt

SEQ ID NO: 19233 - DNA, 201 bp, Homo sapiens
tctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttactttat

SEQ ID NO: 19234 - DNA, 201 bp, Homo sapiens
tgctgagtctgggagcactgaggccaggtaaaaggaaacttggcaaatgaggggcacctatgggtgtgggaggctgctcctggtgtttgcatattttaaartttaaatgctacaaaccactgtgagttaggtattattgttcctattttaccattgaggaagctggggctcagagaaggtggagggtggtacagacaaacc

SEQ ID NO: 19235 - DNA, 201 bp, Homo sapiens
tccgcctcctgtaacttgtattgctttggaatttccagtggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagccta

SEQ ID NO: 19236 - DNA, 201 bp, Homo sapiens
atttttatttttttctacagactgtatgtttgggaatgggaaaggataccggggcaagaaggcaaccactgttactgggacgccatgccaggaatgggctkcccaggagccccatagacacagcacgttcattccagggacaaataaatgggcaggtctggaaaaaaatgtaagccactttgatttggactctttttccct

SEQ ID NO: 19237 - DNA, 201 bp, Homo sapiens
cttgcacgtgagcacagtttccattgagaagccctctcatttgtcctttttttctaagcttttatgtgaaatatttctaagaacttactacagttctaaartgttaggaatttgtttctttggtgtttttgtttgttggttggttgttgcttttctcaagtccatctgcctacaaataaagaaacaagaatgttacttgtc

SEQ ID NO: 19238 - DNA, 201 bp, Homo sapiens
catgtcgtcatgaacactctgtagagattcctagaaatgagcttccatgttagtggagtttccgatgagaagcaatctgatatttcttttccactaagttktacatgaaatatttctaagaacttactacagttctagaatggtaggcatctcttactttcgtgtttgtttgtgtgttttctcatgtccatttgcctatta

SEQ ID NO: 19239 - DNA, 201 bp, Homo sapiens
aaatttctatatctttttaaatgagagttgactacttgaagcaaaatgatagcaatatatttaactttagcatatgtagaggtaaaaatttgaacatataractaaatcatgtggggaataattggaagtgtaccattgtaagtttcttaccttatccacgatggtatgtaatattaatgaaaggttgaatttgtgggtcc

SEQ ID NO: 19240 - DNA, 201 bp, Homo sapiens
atattatataataagaattttccatgtatccaaaagagggaagccaaggaagaaaaagaagtctttcaagtactcaagctctgagcacatccagttgctcwttgaaccagcttcctggaatggagggtctgggcttgagactaggtcacatgtgtagagtctctagagagacagtgttggatccccatggcccataataca

SEQ ID NO: 19241 - DNA, 201 bp, Homo sapiens
cgttttctgccccatggcctggaagccagaggccttggctttcatgatcaacgatctagggaaacatgcaaaatttccatgtctttcccctcctctgcccycgacagccaattaccacctgcatcctgcattgccaaatgcagtgccctttgtatgaacattcagtagagtttcatagaaaggtgctacttcgtgagcgca

SEQ ID NO: 19242 - DNA, 201 bp, Homo sapiens
tcgtcatgaacactctgtagagattcctagaaatgagcttccatgttagtggagtttccgatgagaagcaatctgatatttcttttccactaagttttacrtgaaatatttctaagaacttactacagttctagaatggtaggcatctcttactttcgtgtttgtttgtgtgttttctcatgtccatttgcctattaataa

SEQ ID NO: 19243 - DNA, 201 bp, Homo sapiens
gaatccagatgctgagattcgcccttggtgttataccatggatcccagtgtcagatgggagtactgcaacctgacgcaatgtccagtgatggaatcaactstcctcacaactcccacggtggtcccagttccaagcacagagcttccttctgaagaaggtaagaagcctgcagtcagacaaccataccctcggacattggg

SEQ ID NO: 19244 - DNA, 201 bp, Homo sapiens
aaggaagggccaatggaagtttctgttagaagagtcatgcttcaaggtgactgctcaggactcaacttggctcagatgcagaggaacatttcctgtgagcmaaagttcttagagaagactttgtttttttgagacagagtcttgctttgttgcccaggctggagtgcagtggcatgatctcggctcactgcaagctccgcc

SEQ ID NO: 19245 - DNA, 201 bp, Homo sapiens
aagtttctgttagaagagtcatgcttcaaggtgactgctcaggactcaacttggctcagatgcagaggaacatttcctgtgagcaaaagttcttagagaakactttgtttttttgagacagagtcttgctttgttgcccaggctggagtgcagtggcatgatctcggctcactgcaagctccgcctcccgggttcacacca

SEQ ID NO: 19246 - DNA, 201 bp, Homo sapiens
ctgcctcagcctcccaaagtgctgggattacaggcgtgagccaccgtgcctggctgagaagacattttttaagctggctctccttcctcctagttttatgkaagcagaaggatatatggagttgagaagatcttattaataaaacagccgggatgacaaatgaccaaagagttagagtatccttctacaacatcggctgag

SEQ ID NO: 19247 - DNA, 201 bp, Homo sapiens
cggttttcttatggagtatagacgagtttggatgtgttacaataagaatgataatctgtctttgaaatgttcacagttgtttagaagttgaggacgatttrtgattgttacaggacctttagtgagaatatttcaaagtcactttttaccactttgttacaacaaaatgtagaggatgtctggtgcccttgtatcttctcc

SEQ ID NO: 19248 - DNA, 201 bp, Homo sapiens
gccattgctatagcatcctccaggtgtgaaagctgagaagtagatattgagatcaactgtatgtaaataaattcatgaatgtagatcatgtggatggattscttaggtaaataacaaatcagcaaatcaaacactgaatagatcatgcagttttatagagacttacagacagcctgacagataaacatttgtatgtacgtg

SEQ ID NO: 19249 - DNA, 201 bp, Homo sapiens
ctaggaaaaatccacacatttaatatatgtgttaggcaagtcacagaaggagaagaaaaagatatcatgacagacattatacttgaagcgatgatggctcrcaacacgccaaatatacagaaaacaagaaactcatagtcaagaagctaaatgactcaggtatagaattttaaagagcaaaactctatgatttactgggat

SEQ ID NO: 19250 - DNA, 201 bp, Homo sapiens
tatttccaagccaataagcatttccagtaatttcttaaaatagtgttcattgcagtcttcagcgttgtggctcctgaggaatgtggcccctgattctgtcrtcctagagaagcctgacatgactgcattgattctgtatcgtcctgggtctatgtggctgcctggctgtctgtaatcatctgttttatttttatttttttc

SEQ ID NO: 19251 - DNA, 201 bp, Homo sapiens
aacttactacagttctagattggtaggaatctgtaggtttgctgtatgttttttggttggttttctcccatccatctgcctacaggtaagggaaagataamgttcgtaattctcatagactcctttctggttgtgtcataaatggcttcacatatttcgttattctcagagatactcagtttatttcttgtgttttcattt

SEQ ID NO: 19252 - DNA, 201 bp, Homo sapiens
cacagcagtcttgcttaactgaggagagagactggagtctgcgatgcctcaggcagctgatgtgttctaggctggctaagaatgagaagggatttgtggargaaaggagctccaggaatacacacagaagtctcctcaaggctttggctaaatacaaagctgcgtatgcacagggagagttttcataaagaaagaacaaca

SEQ ID NO: 19253 - DNA, 201 bp, Homo sapiens
gtaggtttgctgtatgttttttggttggttttctcccatccatctgcctacaggtaagggaaagataacgttcgtaattctcatagactcctttctggttktgtcataaatggcttcacatatttcgttattctcagagatactcagtttatttcttgtgttttcatttcagcaccgactgagcagaggcctggggtgcag

SEQ ID NO: 19254 - DNA, 201 bp, Homo sapiens
ggacatgtcagtcttggtcctctatgacaccacactggcatcagagaaccacagaatactacccaaatgggtatgtctttgagttttctcccaagagaaasagccacccacttaaatttctcctggaagagccatgcttccagctaacttcttatgacccaatttctctcagacccagaatgttggacagaatgtctcagg

SEQ ID NO: 19255 - DNA, 201 bp, Homo sapiens
gtcttagccagaagaatattctaacattttgccaaatttgtgaagatttaccaagctcatgataagcctttcatggtatttcttcaagtagtcagtgttcrttgcatctttggctttgcggtttcggaggaatgcggtttttgagtctgtcatccttgagaaacctaatatgacttttcttagttccatatacttctgggt

SEQ ID NO: 19256 - DNA, 201 bp, Homo sapiens
atgtagaacagagcatggtcgtcattttcagagatgatgtcctgtttctatcatggattttttttctcatgcttctgtgttctggaaattactcagtttgwtttctcctctttgaatttcagcaccaacggagcaaagccccacagtccaggactgctaccatggtgatggacagagttatcgaggctcattctccaccac

SEQ ID NO: 19257 - DNA, 201 bp, Homo sapiens
ttgaaggaatgccatttttgaggctgttgttcttgagaaacctaacatgtcttcattagatccgtattgtcctgagactttgaagcagtacatagccaccraattgtttatctccccagcctaccttcatcttgggcatgccttccacacctaggatttgagggaagggatttctcagtgttctcatccctgcttctcatg

SEQ ID NO: 19258 - DNA, 201 bp, Homo sapiens
gttacaccatggatcccagtgtcaggtgggagtactgcaacctgacacaatgcctggtgacagaatcaagtgtccttgcaactctcacggtggtcccagayccaagcacagaggcttcttctgaagaaggtaggaagtctatggccagacaaccacaccctaggacgttgggatgaaaagagttgcaaaatcttagtgata

SEQ ID NO: 19259 - DNA, 201 bp, Homo sapiens
agtgaccttgcatagatcttgtcataaaaaatgaaagagaccttgggaaggtcttgggctggtcacttttgtcagagtccagggctgtggggtgaaagccrcagctatagagcttcattctggagtcacttagctttgctctcctggggacaggctgtgcctattcttgcctcaggcatcaaaaaaagtggcacagatggg

SEQ ID NO: 19260 - DNA, 201 bp, Homo sapiens
tcccagtgtcagatgggagtactgcaacctgacgcaatgtccagtgatggaatcaactctcctcacaactcccacggtggtcccagttccaagcacagagsttccttctgaagaaggtaagaagcctgcagtcagacaaccataccctcggacattgggataaaaagatttgcaaaatctttgtgatgcagaaaacttcca

SEQ ID NO: 19261 - DNA, 201 bp, Homo sapiens
tttacactttgttacagcaaaatgtagagggcgctaagtgcccttgaatcttctcccatctctggtgacctgtgttgttttgaaatttgcagtggcctgascaggaactactgcaggaatccagatgctgagattcgcccttggtgttacaccatggatcccagtgtcaggtgggagtactgcaacctgacacaatgcctg

SEQ ID NO: 19262 - DNA, 201 bp, Homo sapiens
tcctttgctttgggaatatgaacatgatcaaaactgagtgaacttgtcttcctggctttctgtacaatgaagtagaacaaaccatccaatttgaccaaagycttggcatgttttctttctaggtttggaaagcacttctgtggaggcaccttaatatccccagagtgggtgctgactgctgctcactgcttgaagaagtac

SEQ ID NO: 19263 - DNA, 201 bp, Homo sapiens
aatttctatatctttttaaatgagagttgactacttgaagcaaaatgatagcaatatatttaactttagcatatgtagaggtaaaaatttgaacatatagmctaaatcatgtggggaataattggaagtgtaccattgtaagtttcttaccttatccacgatggtatgtaatattaatgaaaggttgaatttgtgggtcca

SEQ ID NO: 19264 - DNA, 201 bp, Homo sapiens
ttctaacattttgccaaatttgtgaagatttaccaagctcatgataagcctttcatggtatttcttcaagtagtcagtgttcattgcatctttggctttgyggtttcggaggaatgcggtttttgagtctgtcatccttgagaaacctaatatgacttttcttagttccatatacttctgggtccaggtagcagtacatag

SEQ ID NO: 19265 - DNA, 201 bp, Homo sapiens
tctccatcttaagccagtcctgcacaactaggctttgatgggagggatctctcagtgttcttgcccctccttctcatggaacatatatctgtgttggtctytgagaagaagagtagtggatatctactttgttgcaatgcagaatcctgggccaaagataccagccatccctccaagggaataaaattttggccagtagcc

SEQ ID NO: 19266 - DNA, 201 bp, Homo sapiens
agttttcttataaagcatagattactttgaatgtgttacaataagaatcataagctgtctttgaaatgttgacagttgtttagaagttgaggaccatttgygagtgttatgggactttagtgagaatatttcaaatttgcttgtttacactttgttacaagaaaacatagagggtgccaggtggtgctgtatcttctccaa

SEQ ID NO: 19267 - DNA, 201 bp, Homo sapiens
ttcttataaagcatagattactttgaatgtgttacaataagaatcataagctgtctttgaaatgttgacagttgtttagaagttgaggaccatttgtgagygttatgggactttagtgagaatatttcaaatttgcttgtttacactttgttacaagaaaacatagagggtgccaggtggtgctgtatcttctccaatctc

SEQ ID NO: 19268 - DNA, 201 bp, Homo sapiens
atgggtcatttcagtgtcctagccaaaatggatattctaacagcctgccaaatatgtgaagatttccaagccaataagcctttccagtgatttaaagtagrcttttttcattgcaatctacagtttgcagtttcttaagaacatggcctttgagtatgatatcctagagaaacctaaggagactgcattatttttctattg

SEQ ID NO: 19269 - DNA, 201 bp, Homo sapiens
tagcacgcttatacaaagcctgagaagataaacagagcctcaaggacatctatgaaaatatcaaaatatttaatatttgtttaaagcaagtcacagaggargggaaagagatattggaacagaaaaaatacttgaagcagtgatggctgatgactttctaaatatggaaaaaatgataaactcacatagtcaagaagctca

SEQ ID NO: 19270 - DNA, 201 bp, Homo sapiens
acggctgacaaatttccaaacatacagaaaatgagaaattcatagtcatgaagctcaatgactcaggtatagatttttaaagagcaaaactctgatttacyggggtacatcatagttaaattgtctgatttcaaagctaagaagaaaaaaagggggttcctatgaacaaacattttgacagttgatctaagaccacagctt

SEQ ID NO: 19271 - DNA, 201 bp, Homo sapiens
gtttgctgagaatgatggtttccagcttcatccacatccctacaaaggacatgaagtcatccttctttatggctgcatagtattccatggtgtatatgtgycacattttcttaatccagtctaccattgatggacgtttgtgttggttccaagtctttgctattgtgaatagtgccgcaataaacatatgtgtgcatgtgt

SEQ ID NO: 19272 - DNA, 201 bp, Homo sapiens
gagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatgggtacaaccttgagttttcttcaaagacagacagcagcccccttacattt

SEQ ID NO: 19273 - DNA, 201 bp, Homo sapiens
atagctcttattattttgagatatgtcccatcaatacatagtttattgagagttcagcatggagagctgttgaattttgtcaaaggccttttctgcatctrttgagataatcatgtggtttttgtctttggttctgtttatatgatggattacatttattgatttgcatatgttgaaccagccttgcatcccagggataaa

SEQ ID NO: 19274 - DNA, 201 bp, Homo sapiens
cacatttcccttttctaggcaatactgagcttgattttctcttttaatttcagcaccaactgaaaacagcactggggtccaggactgctaccgaggtgatrgacagagttatcgaggcacactctccaccactatcacaggaagaacatgtcagtcttggtcgtctatgacaccacattggcatcggaggatcccattata

SEQ ID NO: 19275 - DNA, 201 bp, Homo sapiens
tgctggattcagtttgccagtattttattgaggatttttgcatcaatgttcatcatggatgttggtctaaaattctcatttttgttgtgtctctgccaggmtttggtatcaggatgatgctggcctcataaaatgagttagggaggattccctctttttctatgattggaatagtttcagaagaattggtaccagctcctc

SEQ ID NO: 19276 - DNA, 201 bp, Homo sapiens
actacagttctagattggtaggaatctgtaggtttgctgtatgttttttggttggttttctcccatccatctgcctacaggtaagggaaagataacgttcrtaattctcatagactcctttctggttgtgtcataaatggcttcacatatttcgttattctcagagatactcagtttatttcttgtgttttcatttcagca

SEQ ID NO: 19277 - DNA, 201 bp, Homo sapiens
ttctctgctcatgcaattactgagtatgatttattttattttaatttcagcaccacctgagaaaagccctgtggtccaggattgctaccatggtgatggayggagttatcgaggcatatcctccaccactgtcacaggaaggacctgtcaatcttggtcatctatgataccacactggcatcagaggaccccagaaaacta

SEQ ID NO: 19278 - DNA, 201 bp, Homo sapiens
ttgcaatcttagtctttgatgaaacagactttaaaccatcaaagatcaaaagagacaaaggagggcattacctaatggtaaaagtatcaatgcaacaagargatctgactgtcctacttatatatgcacccaatacaggagcacccagattaataaagcaagttcttagagacctacaaagagacttagacttccacacaa

SEQ ID NO: 19279 - DNA, 201 bp, Homo sapiens
atgcgacttcttttcccaccttgtgccacagcatcctcttcatttgattgtgggaagcctcaagtggagccgaagaaatgtcctggaagcattgtaggggkgtgtgtggcccacccacattcctggccctggcaagtcagtctcagaacaaggtaagaacaggcccagaaaccatctatactgtccttccatgtaagcccc

SEQ ID NO: 19280 - DNA, 201 bp, Homo sapiens
cctcagtgtcccagccaaaatttttattgtaacgtgctgtcaggtgtgtgactctttcagtccagtaagcttttccggggatttcttcaagtagccagcaktcagtgcaatcttcagcattgcagattcagagaaatgtggctctggagcctgtcatcctcgagaaacctaacagggctgcattaattccatatggtcctg

SEQ ID NO: 19281 - DNA, 201 bp, Homo sapiens
gaggcacactctccaccactatcacaggaagaacatgtcagtcttggtcgtctatgacaccacattggcatcggaggatcccattatactatccaaatgcrtatgtctatcatgttagccataaaaggaacaatagtcaactaaaatttctcttagctggcccatgctacaagctcacttcctaggtccaaatttctcata

SEQ ID NO: 19282 - DNA, 201 bp, Homo sapiens
ctttgctgtttgctgccccatagtcctcatgaacattcagtagaaattcccataaatgtgcttgcacgtgagcacagtttccattgagaagccctctcatytgtcctttttttctaagcttttatgtgaaatatttctaagaacttactacagttctaaagtgttaggaatttgtttctttggtgtttttgtttgttggtt

SEQ ID NO: 19283 - DNA, 201 bp, Homo sapiens
actcaggatgtgggtcatgagaggatttcatctctcctgcaggggagtaagctgttcgcctccacccatccctgataactgaagtgtctttgtctgcagtyctagacgaaggactgttgtctctcccatggcccagaagctgaagaccttgccttttgttatgaaacgttcattgttttcatgtctgtccgtttctctgcc

SEQ ID NO: 19284 - DNA, 201 bp, Homo sapiens
agcaccaggtaatgtataaaggaaaccctatcagattaacagccagtttttcagcaggaactgtacaagctataaaggattggagccctatcatagcctcytcaaacaaaacaattatcagtcaagaattttgtatccagcgaaagtaagcatcatatatgaaggaaagatacagtcgtttttggacaaacaaatgctaag

SEQ ID NO: 19285 - DNA, 201 bp, Homo sapiens
tgtcacaggaaggacctgtcaatcttggtcatctatgataccacactggcatcagaggaccccagaaaactacccaaatgcgtatgtatttgattaaaacmataagaggagcaacagccaactcaaatattggttagaagacccatgctttaagctcacttcctagggacaaatttctcttagactcacattttggcaaaa

SEQ ID NO: 19286 - DNA, 201 bp, Homo sapiens
catggtttagaaagaacttatatttccttgaaaggagagtgtcctttgttgtttactaccactttttaaacttagaaagaaaaatctaaagagtgtttatsattttaccatttaatttcacctttgagatgtgaaaaactagtgcttggaattcgtcctgaattaaacgacacaattgctaacttggactcaaatgcgact

SEQ ID NO: 19287 - DNA, 201 bp, Homo sapiens
gcacatgagtctttgttccaattgtaagagcactgataggtccttttcccaccaggttttgaatataaaatttctaagaacttattaaaatattagaatgytattaatctattgtttttgcttcagcatgtccttctgcttgtgagtatactaaagagaacagtcataattctgaaactactgtcctgtttgtgtcataaa

SEQ ID NO: 19288 - DNA, 201 bp, Homo sapiens
tttaactttagcatatgtagaggtaaaaatttgaacatatagactaaatcatgtggggaataattggaagtgtaccattgtaagtttcttaccttatccaygatggtatgtaatattaatgaaaggttgaatttgtgggtccaaagggatattgtaaatcctaaagcaatcataaaattttgaattctgagggatattata

SEQ ID NO: 19289 - DNA, 201 bp, Homo sapiens
gaaggttttggcgtgcacacatccttgagaagcaaagtgtctttgccttcagtcagatatataggatcgttttctgccccatggcctggaagccagaggcyttggctttcatgatcaacgatctagggaaacatgcaaaatttccatgtctttcccctcctctgcccccgacagccaattaccacctgcatcctgcattgc

SEQ ID NO: 19290 - DNA, 201 bp, Homo sapiens
ccttcagtcagatatataggatcgttttctgccccatggcctggaagccagaggccttggctttcatgatcaacgatctagggaaacatgcaaaatttccrtgtctttcccctcctctgcccccgacagccaattaccacctgcatcctgcattgccaaatgcagtgccctttgtatgaacattcagtagagtttcataga

SEQ ID NO: 19291 - DNA, 201 bp, Homo sapiens
gcaaaatttccatgtctttcccctcctctgcccccgacagccaattaccacctgcatcctgcattgccaaatgcagtgccctttgtatgaacattcagtakagtttcatagaaaggtgctacttcgtgagcgcactttgcagtgagaagatctgttctgttctgtttttctaaggatttcaggtgaaatatttcctagaac

SEQ ID NO: 19292 - DNA, 201 bp, Homo sapiens
gtgtcccagccaaaatttttattgtaacgtgctgtcaggtgtgtgactctttcagtccagtaagcttttccggggatttcttcaagtagccagcattcagwgcaatcttcagcattgcagattcagagaaatgtggctctggagcctgtcatcctcgagaaacctaacagggctgcattaattccatatggtcctgggtct

SEQ ID NO: 19293 - DNA, 201 bp, Homo sapiens
cagcacctgtactacattttatggattccttcttctctttgcggtatgccctgacaataattatatccgtcagccttacccccttggcagtaggaaaactraaactgtcttaaagtctcagctctactttctcagaggtgcaggcaagggcactgggagtctggggccctggaaaactgttctgactctgccacttgccag

SEQ ID NO: 19294 - DNA, 201 bp, Homo sapiens
gtggcctgaccaggaactactgcaggaatccagatgctgagattcgcccttggtgttataccatggatcccagtgtcagatgggagtactgcaacctgacrcaatgtccagtgatggaatcaactctcctcacaactcccacggtggtcccagttccaagcacagagcttccttctgaagaaggtaagaagcctgcagtca

SEQ ID NO: 19295 - DNA, 201 bp, Homo sapiens
cattgcagattcagagaaatgtggctctggagcctgtcatcctcgagaaacctaacagggctgcattaattccatatggtcctgggtctatggagcagtayatgagctcccaatgctctaaggctcttcagtcctaggctttgaagggagtgatttctcagtgttcttaaacctctttctgatggcacttgtacctgtgag

SEQ ID NO: 19296 - DNA, 201 bp, Homo sapiens
atctatctctttctatatctacgtctattccaatatgtagaaacacagtcggttctgaccaccagtggtctgaagggatactggttgttagagaataaaartggcaggaaggcagatgagagtcagcaaagagagagatcctgtaaagtaaaagggtggatagatggacagaagcccaggtctgaccagcccatggccagg

SEQ ID NO: 19297 - DNA, 201 bp, Homo sapiens
aggaaggcagatgagagtcagcaaagagagagatcctgtaaagtaaaagggtggatagatggacagaagcccaggtctgaccagcccatggccaggctttmggccataagtgacaccaaagacatggaaaaatggtttctacatgttggacaacagacagtagtggaccaaaagaatagtgacagggggaacaatgagatc

SEQ ID NO: 19298 - DNA, 201 bp, Homo sapiens
ataattcaatagaatctacagaaatagctgcacatatatacacacaatggcacacgtgcacacacccacacccacacaggtgtgaatcctagagccacacsagcattgaaacatagagaagtaaaaattgttcattgaggaatatgtagcaatgctcaatgtgttttaccctaataagagcttttgtgatgtatgattgaa

SEQ ID NO: 19299 - DNA, 201 bp, Homo sapiens
agacagtagtggaccaaaagaatagtgacagggggaacaatgagatcaactccatagataccttggctttcttcctggaggcccttcttgcactgaagagyaaggtgatggagcccagatggactgtagccatcttcctgaatgcaggagagagattggaatttgggactactgtggtagctaggattttataggcctgct

SEQ ID NO: 19300 - DNA, 201 bp, Homo sapiens
gaattaaagtcatacagagtgtgtcactttattctcccagaataaagtgagatatgaataatgagaagtttgccagcttctcaaatatttgggagtcatayggtgcatttcaaaatactctttgggacaaagaaaacatcactaaggaatttagaaaagttttgaactgagtaagaatataacacaatttatccaaactta

SEQ ID NO: 19301 - DNA, 201 bp, Homo sapiens
atactataaatattcatcttgtgttttgaaaaagaaaagctctttggaatcccctatgaacaaagactttgacagttgttgatctaagaccacagcttaartatctacacaagaaaaaaaaaaaaagcaaataagagccaaggaaagcagatggaaggaagtagtccaaaccagtgacattcagtgaacaagaaaagagac

SEQ ID NO: 19302 - DNA, 201 bp, Homo sapiens
agaggtgccattactatagcatcttccagttctgaaagctgaaaagaagattttgagaacaattgtatgtgaataaattcaggaatgttaatcatgtgggmcaattcctgaggaagacaacaaatcagcaaaccagatgctgaatagttagtgtagtcctgtagagagacatacagagaggctgacagagaaatatttgta

SEQ ID NO: 19303 - DNA, 201 bp, Homo sapiens
agagtggtaagaaggaaaacaagataaaatcagaaacaatgaaataacacctttagagtagtaagaagaagaaaagatcaggtcagaaaaaatggaataayatgctaagaagaaaaaaaaagatcaagtcagaaacaatggaataacacctttagagtgaaaagaaggaaaaaaacccagcaagcttaaacgctatgcaca

SEQ ID NO: 19304 - DNA, 201 bp, Homo sapiens
taataatttggaatcagcaggcttgtgtaacaagagatgttgcccaaagaaaattagctagaagaagaatagttcaagaggagaactttctgcagcccacrtaatgaagaacccagcaaatggcaaatgtagatgtaaatgcaaaatattttcttgatcaaatttctatatctttttaaatgagagttgactacttgaagc

SEQ ID NO: 19305 - DNA, 201 bp, Homo sapiens
ttacctaatggtaaaagtatcaatgcaacaagaagatctgactgtcctacttatatatgcacccaatacaggagcacccagattaataaagcaagttcttrgagacctacaaagagacttagacttccacacaaaaatagtgggagactttaacaccccacagccaatattagatcgacgtgacagaaaattaacaaggat

SEQ ID NO: 19306 - DNA, 201 bp, Homo sapiens
tagtacagaacagagcatggtagtctttctcagagacaatgatcctgtttcagtcacagatttcttctgatgcttctgtgttctagaaattactcagcttkatttctcctctttgaatttcagcaccaacggagcaaagccccggggtccaggattgctaccatggtgatggacagagttatcgaggctcattctctacca

SEQ ID NO: 19307 - DNA, 201 bp, Homo sapiens
catgatcaagttggcttcatccctgggatgcaaggctggttcaacatattcaaatcaataaacataatccatcacataaacagaaccaatgacaaaaaccrtatgattatcgcaatagacgcagaaaaggcctttgataaaattcaatacccaatcatgctaaaaactcttaataaactaggtattgatggagcatgtctc

SEQ ID NO: 19308 - DNA, 201 bp, Homo sapiens
acacacctccacaaatactaaaaaatgaaatccactgatcctcacagacaggcgggaaaatataaaaagatttcctgcatgtgggtaggaagtcacagaasgagaggaaggagagattgctacaggaacaaatactggaagcaaggatagctaaaaacttttcaaataagaagaatattaaaaaccacagattcaagaagc

SEQ ID NO: 19309 - DNA, 201 bp, Homo sapiens
tacaaatgcaaataataatattattgttgtcttctttgattttctctttcctggtgaaattttgttttattaagcctgacaaagtgatacctttgcttacrtcacttaaagttagtctatttggacctaggtgacagtacaatcagctaagaaacagtatttgtaggagaggcaggtttgggacaggtgacaaggcatgtg

SEQ ID NO: 19310 - DNA, 201 bp, Homo sapiens
agcctagaggctttttttgaacaaggtaagaagttgtgccagacatttacctgcttggatgctgggatgaaaagccatggatacccccactgacgcacaasccttcagtgctacactggttctcgtgtgttggttctgggtctgccatgtgggaggaagccttagcgcactctctgggggagccagaggtgtgatttttgg

SEQ ID NO: 19311 - DNA, 201 bp, Homo sapiens
aacaaatactggaagcaaggatagctaaaaacttttcaaataagaagaatattaaaaaccacagattcaagaagctgaatgaatcagacagggaatttccaaaaaaaaaaaaaaaaaactgtatgattcacttttgtacatcaccgttcaacagtcagaaggcaaagatataataacaagaaacatctcatgagaaactgg

SEQ ID NO: 19312 - DNA, 201 bp, Homo sapiens
aactctcacggtggtcccagatccaagcacagaggcttcttctgaagaaggtaggaagtctatggccagacaaccacaccctaggacgttgggatgaaaasagttgcaaaatcttagtgatatagaagccttccatgctcacacaattccaagtagaatgtggactcagggtcagccactgggaaggaacactcagcgcct

SEQ ID NO: 19313 - DNA, 201 bp, Homo sapiens
gcaatactgagcttgattttctcttttaatttcagcaccaactgaaaacagcactggggtccaggactgctaccgaggtgatggacagagttatcgaggcmcactctccaccactatcacaggaagaacatgtcagtcttggtcgtctatgacaccacattggcatcggaggatcccattatactatccaaatgcgtatgt

SEQ ID NO: 19314 - DNA, 201 bp, Homo sapiens
catgaacacccagaagaggtgtaagcaaaagaccattcacatgagtgtaattttgaagtataggcactctgatctgttttttgtttgtttctttgtttgtytgttttccagggttgaattaaaatatttatgactacttattaaatttctagaatcctataagtctatttgtatttttattctacatttcaatttgcatgc

SEQ ID NO: 19315 - DNA, 201 bp, Homo sapiens
tagacagatagagatacttttgtatgtgcataaccaattccacaatacacacgtcaaaatccataccagttattccagagagatggattgggcagaaggcrgaaggaggatattctgatccctttttggccacatgtatgtataatctcagtgtttctaggaagtgtgtgctgcattagattttttttctttaaaaaaagt

SEQ ID NO: 19316 - DNA, 201 bp, Homo sapiens
caaatgcgacttcttttcccaccttgtgccacagcatcctcttcatttgattgtgggaagcctcaagtggagccgaagaaatgtcctggaagcattgtagsggggtgtgtggcccacccacattcctggccctggcaagtcagtctcagaacaaggtaagaacaggcccagaaaccatctatactgtccttccatgtaagc

SEQ ID NO: 19317 - DNA, 201 bp, Homo sapiens
ggaagaacttgccaagcttggtcatctatgacaccacaccagcatagtcggaccccagaaaactacccaaatgcgtacgtctttgttctttaccataagcraaggaagggccaatggaagtttctgttagaagagtcatgcttcaaggtgactgctcaggactcaacttggctcagatgcagaggaacatttcctgtgagc

SEQ ID NO: 19318 - DNA, 201 bp, Homo sapiens
gtgttttcatttcagcaccgactgagcagaggcctggggtgcaggagtgctaccacggtaatggacagagttatcgaggcacatactccaccactgtcacyggaagaacctgccaagcttggtcatctatgacaccacactcgcatagtcggaccccagaatactacccaaatgcgtatgtctttgttctttaccataaga

SEQ ID NO: 19319 - DNA, 201 bp, Homo sapiens
tgttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgca

SEQ ID NO: 19320 - DNA, 201 bp, Homo sapiens
gttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgcag

SEQ ID NO: 19321 - DNA, 201 bp, Homo sapiens
accgatccgtgtgtgaggtgggagtactgcaatctgacacaatgctcagaaacagaatcaggtgtcctagagactcccactgttgttccagttccaagcayggaggctcattctgaagcaggtaagaagtctgtggccagatatctacacatttgaacattgggatgaaaagagatggaaaatctgactgatgcagaagcc

SEQ ID NO: 19322 - DNA, 201 bp, Homo sapiens
tctttaccataagagaataaagggccaactgaagtttctgtgacaagagacatgcttcaagctgagttctccgaactcaacttgtgtcagattcagatggygtagcaaaatgtctcaggatgatttccttggagctaagggtctgagagaagagaaatgttaagctgcctcaccttcctcctagttttgtggagcagaagg

SEQ ID NO: 19323 - DNA, 201 bp, Homo sapiens
agaaatgttaagctgcctcaccttcctcctagttttgtggagcagaagggaaatgaggaggcgaggagatcaccttatgaagaaagtcagaatgacgaacsaccaaacacttagattacccttgcccaacacccactaagcgtcaatgaagactttccagttggaattccgttattctgacttccaattcctgaagggaag

SEQ ID NO: 19324 - DNA, 201 bp, Homo sapiens
ctgtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatat

SEQ ID NO: 19325 - DNA, 201 bp, Homo sapiens
aagaaaatgaaaaaagaatttccagtatatttatacaaaggaatactattcatcaacaaggaacaagttactgatagtctcagaagcatgaacaaacctcraaaatatattaaggaaagaagccagacgtcaaagtgtatagtctgtatgagtccattcatgtgagtttatagaaaacacaatttatggtgaaagaaacca

SEQ ID NO: 19326 - DNA, 201 bp, Homo sapiens
tgtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatata

SEQ ID NO: 19327 - DNA, 201 bp, Homo sapiens
tatgttttttggttggttttctcccatccatctgcctacaggtaagggaaagataacgttcgtaattctcatagactcctttctggttgtgtcataaatgkcttcacatatttcgttattctcagagatactcagtttatttcttgtgttttcatttcagcaccgactgagcagaggcctggggtgcaggagtgctaccac

SEQ ID NO: 19328 - DNA, 201 bp, Homo sapiens
aagggactgccgtcgcgcctccgactgttaccccggttccaagcctagaggctccttccgaacaaggtaaggagtctgtggccagacatctacacgcttcsatgctgggatgaaaagccatggaaattcccactgatgcagccgccttcaatggtaaacggatgctcgagtgttgcctgagttctaccatgttgggggaag

SEQ ID NO: 19329 - DNA, 201 bp, Homo sapiens
ccctacctctgtttagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagc

SEQ ID NO: 19330 - DNA, 201 bp, Homo sapiens
acatgctgtcaactgtgtgattatttccaagccaataagcatttccagtaatttcttaaaatagtgttcattgcagtcttcagcgttgtggctcctgaggratgtggcccctgattctgtcgtcctagagaagcctgacatgactgcattgattctgtatcgtcctgggtctatgtggctgcctggctgtctgtaatcatc

SEQ ID NO: 19331 - DNA, 201 bp, Homo sapiens
agaagcctgacatgactgcattgattctgtatcgtcctgggtctatgtggctgcctggctgtctgtaatcatctgttttatttttatttttttctacagaytgtatgtttgggaatgggaaaggataccggggcaagaaggcaaccactgttactgggacgccatgccaggaatgggctgcccaggagccccatagacaca

SEQ ID NO: 19332 - DNA, 201 bp, Homo sapiens
ttctacaacatcggctgagggttaatacaaccttttcaccttggaattctatcattctaagctctagtccctgaagtgaatgttgtgttggccttttgcaycttgggtcacagggaattgatacttgcacatctatggagaggcaaatctttttctatctacttctttttcaatgggtacaaacacacttggtcctgagca

SEQ ID NO: 19333 - DNA, 201 bp, Homo sapiens
ctgatggcacttgtacctgtgaggggtctagagagaaaggttagtagacttctcctttactgcaattcaggatgcagggcatgagaggattccctccctcstccaagggaagaaggttttggcgtgcacacatccttgagaagcaaagtgtctttgccttcagtcagatatataggatcgttttctgccccatggcctgga

SEQ ID NO: 19334 - DNA, 201 bp, Homo sapiens
gttttccagtgacattttccactgtcacacccttttagagaataatttggcaatgttactgtgagatagaaatatgtctatataattatgggaactgagayttcagaaagtaataaggaataagaatgaaatttatgaacaaacatgtggaaggttggaagcaagagtggggccaacacgcatggggaggaagcatttggg

SEQ ID NO: 19335 - DNA, 201 bp, Homo sapiens
tgtgatccataaccaggagaaaaatcattcaatacaaatagacccagaaatgacagaaatgatagaattagcaaaaacatttaaaatatacatatgatcayttgatcttgtgatcagatatcacaagagaagaaagagatacttgaacagaaaaaatgcctgaagcaatgatggctgaaaactttccaaatatgaagaaaa

SEQ ID NO: 19336 - DNA, 201 bp, Homo sapiens
tccatctggaaaaacagcatttcctctggcactttagcagaggttctgtttcaatttggcgaaggaaattaagcagtttttcacaaaagaagaactacaaygaggagaattgtccctagtatttcttctccctaattgtcaaggaagtgtaaattagaaaatgaatcaggacaatttccacctactatgttagctaatatt

SEQ ID NO: 19337 - DNA, 201 bp, Homo sapiens
tagaaagaaataactttgtcaaaaaatataataatgatagaaaggaagaaggaacgctcccttttgtcttctaagaatagatgtgaaatgtgtgtgccttrgaatatcttctccctctcctgctccacgtgagctggagcttacatgcctgcttgttttcagtactgccgtaaccctgatggtgacatcaatggtccctgg

SEQ ID NO: 19338 - DNA, 201 bp, Homo sapiens
gtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatatat

SEQ ID NO: 19339 - DNA, 201 bp, Homo sapiens
catgtacctagaagtcacctcagtgtaatataaatctgcatatgcacagggagtgattccacaatgaaagtaggacaaagaacagctactggggaaagaayaactacaagggaacaatgagttcaatggagatggcagagctcacaaagcactgggggatatttgagttcttaccagctagaaaagagacctcattgcaaa

SEQ ID NO: 19340 - DNA, 201 bp, Homo sapiens
agctgggcttgcaacattggaaacttggattatttgtgagagcactgagaaatccctgggcatgtccatctggaaaaacagcatttcctctggcactttarcagaggttctgtttcaatttggcgaaggaaattaagcagtttttcacaaaagaagaactacaacgaggagaattgtccctagtatttcttctccctaatt

SEQ ID NO: 19341 - DNA, 201 bp, Homo sapiens
aatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatatatgt

SEQ ID NO: 19342 - DNA, 201 bp, Homo sapiens
gcttcttgctttgggcacagggtctgagaggagagaaatgtcaggccagctctcttttctcatagttgatagaagtaggaggatacttggaggtggtgagktctcatgaatagaaagctcagaagaacatatgaccatgtgcttagaaatagcaccattccacaatgcccactaaagaccagtgaaatagttcaaccaggg

SEQ ID NO: 19343 - DNA, 201 bp, Homo sapiens
tggatagaagccctggtctgaccaccccatggccaatcatttggccataatcaacaaccaaagacatggaaaaatggtttctacatgtgggacaacagatsgtagaggacctagagaattgagagagggccaatgatgagctcaactccatagatgccttggctttcttcctggatacccttcctgcactgaatagcaagg

SEQ ID NO: 19344 - DNA, 201 bp, Homo sapiens
acccttcctgcactgaatagcaaggagatggagctcaagcagcctgtagccatctagctgagcagaggagagggattggagtttgggatgactctggtatwttctaggtccgctacaaataagaactggtttgtggaggaaaggagctctacaaatacgcatagaagtctcctccagtagttggcctcacatgacactgca

SEQ ID NO: 19345 - DNA, 201 bp, Homo sapiens
gtttgggatgactctggtattttctaggtccgctacaaataagaactggtttgtggaggaaaggagctctacaaatacgcatagaagtctcctccagtagytggcctcacatgacactgcatgtgcacagaaaatggttctacagaaagtgtggcaaagaacatttactgagaaacagcaactacaagagaacagcaagct

SEQ ID NO: 19346 - DNA, 201 bp, Homo sapiens
agcaagtgtccaagcatcaaatgggtttccaatcaatgaagtgcctgtgagaggaaatctcaactctcttcagaagtaaacaacaaagtcaattgcctcarctatgcggtatccccagagtgagtcctaaattaaaaatttgactacgtgtagaaaagaatttcgtgtgatccatgaccagaaaataaatcaggcaataca

SEQ ID NO: 19347 - DNA, 201 bp, Homo sapiens
ccactgttgttccagttccaagcatggaggctcattctgaagcaggtaagaagtctgtggccagatatctacacatttgaacattgggatgaaaagagatrgaaaatctgactgatgcagaagccttccatgctacacagaaacttgagggtatggcaggtggaaagaagcctcagcactctctctggtggagcaattttt

SEQ ID NO: 19348 - DNA, 201 bp, Homo sapiens
aacaaagtcaattgcctcagctatgcggtatccccagagtgagtcctaaattaaaaatttgactacgtgtagaaaagaatttcgtgtgatccatgaccagraaataaatcaggcaatacaaacaggctcagaaatgacatcgataattagaattgcatgaaaatttgacatatcagtatgataactgatttcagatattta

SEQ ID NO: 19349 - DNA, 201 bp, Homo sapiens
tctgtcattctaaatttcaattcccgaaggtttgtttgccatttttgtcatgggtaataagtaaaaaaaaaaaaattaagatgtgtatatatatatatatrtatatatatatacacacacacacacacacacaaacatctgaatatttatatatatgtctgaatatttatatacttgtgtataaaacttatatttaaattt

SEQ ID NO: 19350 - DNA, 201 bp, Homo sapiens
ttgacatcctcatcttttctaggtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggtactcgctcacctgtggtcttcaccccacgctggtga

SEQ ID NO: 19351 - DNA, 201 bp, Homo sapiens
tcttgtgatcagatatcacaagagaagaaagagatacttgaacagaaaaaatgcctgaagcaatgatggctgaaaactttccaaatatgaagaaaaaaaarctcacagattcaagaaaactaatcaatcagaaatatgattttgaaaagtaaaaatgtatgatttactttggcaaatcttcttggttaaattgtctaaaat

SEQ ID NO: 19352 - DNA, 201 bp, Homo sapiens
ttacctacagtctatcacaggcacagatttttttttacacttttgtgaatcattgaattcaatgccgaggctattcatctattcacaaacacatgaacaarttatgggttgtgatccccataaatgaagagtaatcagtccgaacccacagaacctggacattttgggtatcgtttcagtggaacatgcaattcgtaagtt

SEQ ID NO: 19353 - DNA, 201 bp, Homo sapiens
caagcacagagcttccttctgaagaaggtaagaagcctgcagtcagacaaccataccctcggacattgggataaaaagatttgcaaaatctttgtgatgcrgaaaacttccatgctgcacaggaagtcgaaggtgaagtcatggacagccaatgggaaggaagcttcagtgccttctctggggggaccagagctgggatgt

SEQ ID NO: 19354 - DNA, 201 bp, Homo sapiens
cactttgcagtgagaagatctgttctgttctgtttttctaaggatttcaggtgaaatatttcctagaacttactacagttctagattggtaggaatctgtrggtttgctgtatgttttttggttggttttctcccatccatctgcctacaggtaagggaaagataacgttcgtaattctcatagactcctttctggttgtg

SEQ ID NO: 19355 - DNA, 201 bp, Homo sapiens
ggattgctaccatggtgatggacggagttatcgaggcatatcctccaccactgtcacaggaaggacctgtcaatcttggtcatctatgataccacactggyatcagaggaccccagaaaactacccaaatgcgtatgtatttgattaaaaccataagaggagcaacagccaactcaaatattggttagaagacccatgctt

SEQ ID NO: 19356 - DNA, 201 bp, Homo sapiens
gctgtatgttttttggttggttttctcccatccatctgcctacaggtaagggaaagataacgttcgtaattctcatagactcctttctggttgtgtcataratggcttcacatatttcgttattctcagagatactcagtttatttcttgtgttttcatttcagcaccgactgagcagaggcctggggtgcaggagtgcta

SEQ ID NO: 19357 - DNA, 201 bp, Homo sapiens
tcccagcaagagaagatccaaggaaggaaggcagatgagagtcagcacagagagggatgctgaaaagtaaaagggatgggtagatggatagaagccctggyctgaccaccccatggccaatcatttggccataatcaacaaccaaagacatggaaaaatggtttctacatgtgggacaacagatggtagaggacctagaga

SEQ ID NO: 19358 - DNA, 201 bp, Homo sapiens
caacagatggtagaggacctagagaattgagagagggccaatgatgagctcaactccatagatgccttggctttcttcctggatacccttcctgcactgartagcaaggagatggagctcaagcagcctgtagccatctagctgagcagaggagagggattggagtttgggatgactctggtattttctaggtccgctaca

SEQ ID NO: 19359 - DNA, 201 bp, Homo sapiens
gtgttcctccgtagctgtccgacctcttcagatctcttagtctaccctgccatcttcctttatgccatgggtcccactgttctttcaactcatcccccttwccctcagtgcagagtagctgcggccagcagagggtagactgagagcaggagagaaggtcctgcccaggaacccattctagagatgctgcattctgcctgg

SEQ ID NO: 19360 - DNA, 201 bp, Homo sapiens
ggtctatgtggctgcctggctgtctgtaatcatctgttttatttttatttttttctacagactgtatgtttgggaatgggaaaggataccggggcaagaargcaaccactgttactgggacgccatgccaggaatgggctgcccaggagccccatagacacagcacgttcattccagggacaaataaatgggcaggtctgg

SEQ ID NO: 19361 - DNA, 201 bp, Homo sapiens
ttatgtgcttacttatggacaggtgaattgatctgtttctatttctacctgtattccaatagggagaaaatctcttggtcctaagtaccagtggcctgaarggatagaggttcccagcaagagaagatccaaggaaggaaggcagatgagagtcagcacagagagggatgctgaaaagtaaaagggatgggtagatggata

SEQ ID NO: 19362 - DNA, 201 bp, Homo sapiens
gaaaatctcttggtcctaagtaccagtggcctgaaaggatagaggttcccagcaagagaagatccaaggaaggaaggcagatgagagtcagcacagagagkgatgctgaaaagtaaaagggatgggtagatggatagaagccctggtctgaccaccccatggccaatcatttggccataatcaacaaccaaagacatggaa

SEQ ID NO: 19363 - DNA, 201 bp, Homo sapiens
tgggactatgtgaaaagattgaacctacgtttgattggtgtacctgaaagtgatgggagaatggaaccaagttggaaaacactcttcaggatattatccaggagaacttccccaacctagcaagacaggccaacattcaaattaaggaaatacagagaataccacattcaaattcaggaaatacagagaacaccacaaaga

SEQ ID NO: 19364 - DNA, 201 bp, Homo sapiens
ggaaatacagagaacaccacaaagatactcctcaagaagagcaacctgaagacacataatcgtcagattcaccaaggttgaaatgaaggaaaaaaatgttragggcagccagagagaaagtttgggttacccacaaagggaaccccatcagactaacagtggatcttcctgcagaaactctacaagccagaagagagtggg

SEQ ID NO: 19365 - DNA, 201 bp, Homo sapiens
ttatatggttttaggtctaacatttaagtctttaatccatcttgaattaatttttatataaggtgtaaggaagggatccagtttcagctttctacatatgkctaggcagttttcccagcaccatgtattaaatagggaaacctttccctatttcttgtttttgtcaggtttgtcatagatcagatggttgtagatgtgtgg

SEQ ID NO: 19366 - DNA, 201 bp, Homo sapiens
ttggtctaaaattctcatttttgttgtgtctctgccaggatttggtatcaggatgatgctggcctcataaaatgagttagggaggattccctctttttctmtgattggaatagtttcagaagaattggtaccagctcctctttgtatctgtggtagaattcggctatgaatctctcctggactttttttggttggtaggct

SEQ ID NO: 19367 - DNA, 201 bp, Homo sapiens
actttttttggttggtaggctcttaattattgcctcaatttcagagcctgttattggtctattcaaggattcaatttctttctggtttagtcttggtaggktgtatgtgtccaggaatttttccatttcttctagattttctagtttatttgcacagaggtgtttataatattctctgatggtagtttgtatttctgtggg

SEQ ID NO: 19368 - DNA, 201 bp, Homo sapiens
aaaaccaaccgaacctcacagacatgttgcaaaataggaaaagatttcctgcatatgggaagcaagtcacagaaaagagaacgggagattggaaacagaarcaaataccggaatcaaggatggccgaaaacttttcattgatcaagaatattaacaaaatcgcaaaaacacgaaattcaatgcatcaaataggcgtttcga

SEQ ID NO: 19369 - DNA, 201 bp, Homo sapiens
tgcactgtggtctgagagacagtttgttataatttctgttcttttacatttgctgaggaatgcctcacttccaactatctggtcaatttcagaataagtgygatgtggtgctgagaagaatgtatattctgttgatttggggtggagagttctgtagatgtctattaggtctgcttggtgcagagctgagttcaattcctg

SEQ ID NO: 19370 - DNA, 201 bp, Homo sapiens
cttcctccatccctttattttgagcctatgtgtgtctctgcacgtgagatgtgtcttcagaatacagcacactgatggatcttgactctttatccaatttkccagtctgtgtcttttaattggagcatttagcccatttacatttaaggttaatatttttatgtgtgaatttgatcctgtcatcatgatgttcgctggtta

SEQ ID NO: 19371 - DNA, 201 bp, Homo sapiens
ccaagatggtctcgctctgttgacctcgtgatccacccgccttggcttcccaaagtgctgggattacaggcgtgagccaaagcacccagcctgtgcctctyacttactcaattgtttttctgaaccctccatagctggtggaccttttcagatcccatagtctagccagccctctcactttatgccttgggtcccactgtt

SEQ ID NO: 19372 - DNA, 201 bp, Homo sapiens
ttttttctctaaacttctcttctcgcttcatttcattcatttgatctttaatcactgataccctttcttccacttgattgaatcaactactgaaacttgtkcatgtgtcacgtagttctcgtgccatggttttcagctccattagatcatttaaggtcttctctatgctgtttattttagtctgccattcatctaaacttt

SEQ ID NO: 19373 - DNA, 201 bp, Homo sapiens
gttttcagctccattagatcatttaaggtcttctctatgctgtttattttagtctgccattcatctaaactttttcaaggtttttagcttctttgcaatgrgttcgaacatccttctttagctcggagaaatttgttattacagatcgtctgaagccttcttctctcaactcatcaaagtcattctctgtccagctttgtt

SEQ ID NO: 19374 - DNA, 201 bp, Homo sapiens
tgtttgggaatgggaaaggataccggggcaagaaggcaaccactgttactgggacgccatgccaggaatgggctgcccaggagccccatagacacagcacrttcattccagggacaaataaatgggcaggtctggaaaaaaatgtaagccactttgatttggactctttttccctttgctgacaaatcttttcaaacagaa

SEQ ID NO: 19375 - DNA, 201 bp, Homo sapiens
gacattcagtgaacaagaaaatagaccaacaaaggagtaaatccatgaaacagaaagttggttctttgaaaagattcatgtgattgaccacagtctggctraacagatgacagaccaaggagggagtacaaccatcaccatttgaagtaacaggggagaggagccattgctataccatactccaggtctgaaagctgacaa

SEQ ID NO: 19376 - DNA, 201 bp, Homo sapiens
gagtatgatatcctagagaaacctaaggagactgcattatttttctattgtcctggggctgcatagcaggaggtaaccaacgaatgctgtctctccctggyctatctcagtctttcacaggctctgttcacctcagctttgaagttagaaatttctaggtgttcttgcctcttcttctcatgaaacctgcattggcagtga

SEQ ID NO: 19377 - DNA, 201 bp, Homo sapiens
tagatgtaaatgcaaaatattttcttgatcaaatttctatatctttttaaatgagagttgactacttgaagcaaaatgatagcaatatatttaactttagmatatgtagaggtaaaaatttgaacatatagactaaatcatgtggggaataattggaagtgtaccattgtaagtttcttaccttatccacgatggtatgta

SEQ ID NO: 19378 - DNA, 201 bp, Homo sapiens
ccttggcatgttttctttctaggtttggaaagcacttctgtggaggcaccttaatatccccagagtgggtgctgactgctgctcactgcttgaagaagtaygtttaagggaaaactgacatggggtcttatcttcaagacttttttcctccctctcttcctccatcccttctttcttcccaccctccccttccttcctccc

SEQ ID NO: 19379 - DNA, 201 bp, Homo sapiens
acagttgtttagaagttgaggacgatttgtgattgttacaggacctttagtgagaatatttcaaagtcactttttaccactttgttacaacaaaatgtagrggatgtctggtgcccttgtatcttctcccatctctggtgaactgtattgttttgtaatttgcagtggcctgaccaggaactactgcaggaatccagatgc

SEQ ID NO: 19380 - DNA, 201 bp, Homo sapiens
ctcagactactgtgctagcagttcaatctcagactgctgtactagcagtgagcaaggctctgtgggcatgggaccctctgagccatgtgcaggatataatmtcctggtgtgccgtttgctaagaccattggaaaagtgcaatattagggtgggagtgtcccgattttccgggtacatctgtcatggcttcccttggctagg

SEQ ID NO: 19381 - DNA, 201 bp, Homo sapiens
attgtaaacaccatcaacactataaagaaactgcatcaactaatgggcaaaatagccagctagcatcataatgacaggatcaaattcacacataacaataytaaccttaaatgtaaatgggctaaatgccccaattaaaagacacagactgggaaattgaataaagagtcaagacccattggtttgctgtgttcagaagac

SEQ ID NO: 19382 - DNA, 201 bp, Homo sapiens
atcatgctaaaaactcttaataaactaggtattgatggagcatgtctcaaaataataagagctacttatgacaaatgcatagccaatatcatactgaatgrgcagaagctggaagcattccctttgaaaaccagcacaagacaaggatgccctctctcaccactcctattcaacatagtattggaaattctgtccagggca

SEQ ID NO: 19383 - DNA, 201 bp, Homo sapiens
ccaaatggaaatttaaaaactgagaaaagttatatctgtaatgaggaattcactggatggccttataaccagtttagatattatggtaggaaaaggtgaaygagaaaatgattcaattaaagctagacaaaccacaagacagacagacagacacaaatacacatacacacaatgactgaaccaattaatcaacagagcctc

SEQ ID NO: 19384 - DNA, 201 bp, Homo sapiens
caaactggacaaaaataagcaatggggaaaggattccctatttaataaatggtgttgggaaaactggctagccatatgcagaaaactgaaactggatcccytccttacaccttatacacaaattaactcaagatagattaaagaattaaatgtaagacctaaaaccataaaaaccctagaagacactttgggaggccgagg

SEQ ID NO: 19385 - DNA, 201 bp, Homo sapiens
cacctacaacctgcacagcctgatgcatagcagtctagtttcctgccttattctcaggaacacccagaagatgtctatattaaagagcatgcacatgagtrcaattttgactgataggcactctgatctttcctttggtgcctgtgttttaaaggaaatctttctaagaactcgttaaagttctagaatgctatgaatctt

SEQ ID NO: 19386 - DNA, 201 bp, Homo sapiens
gaaaaccaaacaccatatgttctcactcataagtgtgagttgaacaatgagaacacatggacacaggaaggggaacatcacacacaggggcctgttggggwgttgaggctaggggagggattggattaggagaaatacctaatgtagatgatgggttgctgggtgcagcaaaccaccatgacacgtgtatacctatgtaac

SEQ ID NO: 19387 - DNA, 201 bp, Homo sapiens
ataatttgcaacctactggtacacttgaatactattcagcactgagtatcttaaatagcatggatggagctcaaaaatatactcaggaaagaagccatgtrtattctgtatgagttcatttacatgagatcatttacatttcctccaaaagaggaaaaactaatttctgttgaaagaaaccaatgtatttgcctctggcag

SEQ ID NO: 19388 - DNA, 201 bp, Homo sapiens
tatatatgttcatataagttagtattcatatatatgttcatatatatatgttcatacagactagtattcatatatatatacatatatatatacacacacayatatatatatatatatatgttctagggaaacatgcaaggtttttatgtctgtccctgactgatgaccaaataccctatagcctgcacagctgcaagctgt

SEQ ID NO: 19389 - DNA, 201 bp, Homo sapiens
cccctagagcctctggagggagcacagccctgctgatagcttgattttagctccataagattcatttcagagctctggcctccagaactgtaagagaataratttctgtggttttaagctactatgtttgtggtagtttgttacagcatccacaggaaatgaatacagtgctcaataaacgtttgttgcatgaataagtga

SEQ ID NO: 19390 - DNA, 201 bp, Homo sapiens
gcagtgaaagaatgagaaggtgaaatcttaccagttggaatcccaccacttgcttggactcgatgtgcatgacatttgaagccttgtgaatgatgctaccrccgactttccgcttcctccctgtgaagaagtccctggccttgcccttctcatcctgatcaaagatcagcagcgggatccggtgggagaatctaggctgct

SEQ ID NO: 19391 - DNA, 201 bp, Homo sapiens
aataatctcccttagttactactaagtgatattgcagttataaaaatgcaatagcagaatagtgagtcaatgcaaggttatttccagaatattttggatcyccttataaaatcggctgttcagttaaaaacattttaggtctcttataataaaatgtcagtgtattcaaaatcaagaggattttgcctcttgtgtgtgtat

SEQ ID NO: 19392 - DNA, 201 bp, Homo sapiens
agatcagcagcgggatccggtgggagaatctaggctgctttccctctgagacggagttccaggactccgcctctcggcgcttccgggactctggaaagccrtacagggacttcagggcctctctggtctcctgttccaagtcagctagaaggtggcgaacggtgctgtacctgccaaggtggggaggaaaagtcagggaga

SEQ ID NO: 19393 - DNA, 201 bp, Homo sapiens
gtttgtgccctataccctcccacttgtagtgctttttctgttttctccttcctgggtccagagtacatccccactttactagttttagaaattactcttasattaaagttcccctaacccctgtagttggacgttatggcttcctcctttgaaagcagataacattttacatggaaccatgttaaagtacttgtacacttc

SEQ ID NO: 19394 - DNA, 201 bp, Homo sapiens
ttgagttgtgacaatcaaaaacatctccattcattgccaaatcccactccccccgccacagacacagttccctggttgagacccattggtttaaataagtrtgtgttttctaagatgaactggaactgcatctacttggaatggtttggaatttctcaagatattttgctcgagtgtgatacagaatttagaatttttttt

SEQ ID NO: 19395 - DNA, 201 bp, Homo sapiens
aaaatgcaatagcagaatagtgagtcaatgcaaggttatttccagaatattttggatctccttataaaatcggctgttcagttaaaaacattttaggtctsttataataaaatgtcagtgtattcaaaatcaagaggattttgcctcttgtgtgtgtatatataatctgtgtgtgtttatagaagaaatatatggatcttt

SEQ ID NO: 19396 - DNA, 201 bp, Homo sapiens
acctgccaaggtggggaggaaaagtcagggagaggggaggcggccctggcagaactctggtgctcctccaggctgttttccatcaacacgtgtcagcctcrtgcccacctttcccaactccttggcagaggagaccacgcctttcatgacttgacccatccaaagtgacccctggctctggcaaatggggaaaggctcatg

SEQ ID NO: 19397 - DNA, 201 bp, Homo sapiens
gatcaactttcaaagtattttgcagatgcattttgagcatgaccatttttttccccaagtaaaaacaattgtgcgtggcctccatataactcagaaagcaygctcttactacctatgcaagcaaacaataaaacatatagacatgaaatgttaagtcttaaaaaaaaaaggcaacaattatggagctctatttttaaattt

SEQ ID NO: 19398 - DNA, 201 bp, Homo sapiens
aacacaaaatagttataaaggagttgcctgcgtgaagcacaatataccatcttttaattttcacaaatcaaatggttccagcctcctcttaactctctccwctctcctttctcccacttgctctaggcataggcagcagagcatagcaattgagaatagaaacccctgggtttagccaaattacctgagtttaggttcccc

SEQ ID NO: 19399 - DNA, 201 bp, Homo sapiens
agagaaggagggagggagaaagaaagaagaggaagacatggagggcggagagagagtcttagacttgatcttgattttgagctttgcaccaactcactgaygattctggacaagttagtttcgtttgataatctttctcccctgttcttcttcccttctccccacccctgctctgacaaagtctgcctgattctgacctgc

SEQ ID NO: 19400 - DNA, 201 bp, Homo sapiens
tcaatttccataaactgtccattgagggtgggctggcatttgcctgccctactccccagatctgcatgaatgtgggggctccttagatgtccagtttggtygtttttcaggtgcccagccttaagcccgaaagtttaagtcaataatagcagaccccagaaaactcccttgaggatcttcaggagttacaaagcctgagtt

SEQ ID NO: 19401 - DNA, 201 bp, Homo sapiens
cacagatggccattgtgccaggcttgtggttagtgtccactctttaaagctaagggaggaggggacagcatgagtgtaggcagcccaacccaacccagccrcccgtctcaccccttggggtccacatacctgcaggcttccttgcacacagactggcagcccagctcttcctggacaaaggctcgatgcagttggtagtaa

SEQ ID NO: 19402 - DNA, 201 bp, Homo sapiens
tttctgttttattgtaaaataaccatttcagaaatataacagaaagaggaagtatctcatactaggtatcttaatgcgaagggttactgactttaatactrtgttatatagtatccatttagattttttccatgcatatatacattattttatataagtagaatcatttacacatattatttttaccttgctttgtattta

SEQ ID NO: 19403 - DNA, 201 bp, Homo sapiens
tgaacaagcagacgtctttaacttcagacagtccgtaccacgtcgaaggcattaaaacagactagaatgatagagtgtgatggtgggaggctggcaagacracattaggaagggaggtcagggaagacgtccctgaagagaccgcagccaagctgagccccagtgtgctgtgtgaacatggggggaaaggatcccatgcag

SEQ ID NO: 19404 - DNA, 201 bp, Homo sapiens
gggtttggggcagctgaggtgcttacagaagtcacctgggtgtcacttctgagtcagccttgagctcacttatgctgcaggcagagtgaacatgtgagctyggagagccaggggtgcagatgcagatgggggttggctaatttgggcttgatatggggagtgtgcagagggggttagttcgttccaggcctcttctaagtg

SEQ ID NO: 19405 - DNA, 201 bp, Homo sapiens
gacagtccgtaccacgtcgaaggcattaaaacagactagaatgatagagtgtgatggtgggaggctggcaagacaacattaggaagggaggtcagggaagrcgtccctgaagagaccgcagccaagctgagccccagtgtgctgtgtgaacatggggggaaaggatcccatgcagagggaacacccggtacatgcacacaa

SEQ ID NO: 19406 - DNA, 201 bp, Homo sapiens
aaattagcctggcgctgtggtacacccctgtagtcccagctactcgggaggattgttagaacctgggaggtggaggttgcagtgagccgagatcgcaccaytgcatcccagcctgggcaacaagagcgaaactccatctcaaaaaaggaaaaagaaaagaaaaaaaacaagtcactgatggtctgaaaacttggtacatac

SEQ ID NO: 19407 - DNA, 201 bp, Homo sapiens
gggaggtcagggaagacgtccctgaagagaccgcagccaagctgagccccagtgtgctgtgtgaacatggggggaaaggatcccatgcagagggaacaccyggtacatgcacacaagactaggaggagcttggtgtgtgtcaggcacagaaggaatgaagtaaagaacctgtggaattcccttcatgatgctagtctctta

SEQ ID NO: 19408 - DNA, 201 bp, Homo sapiens
tcggcgcctgagggcccgtcacgggcagattcttcttgattttggctttgatcttctctccgggtgccatggcgaggatgggactttgaggacgggactcygaggacgggcgtgctggaggggcaaagaagagaagcaggtgagctggcaggcactagccggctagtgtgtccctggagaccacagtctgggaaacaccag

SEQ ID NO: 19409 - DNA, 201 bp, Homo sapiens
gctagtctcttaaagagtgaagtcattattttaaaaaaatatggttgggtgatttacatgtacttgtaactcatttcacctcacagtagtttttaggcagattggttcactgttaagcaccactgtgagcgaacagtttgatagttgttggaaactggtttcttggtgatcttagcacctctacttccctctgggcctgag

SEQ ID NO: 19410 - DNA, 201 bp, Homo sapiens
gtcacgggcagattcttcttgattttggctttgatcttctctccgggtgccatggcgaggatgggactttgaggacgggactctgaggacgggcgtgctgsaggggcaaagaagagaagcaggtgagctggcaggcactagccggctagtgtgtccctggagaccacagtctgggaaacaccagtccatgcgcccttagag

SEQ ID NO: 19411 - DNA, 201 bp, Homo sapiens
ttttctaaagctcctcttgtgattttggtcttcggtctgtgcagctgaggccaagaaccacagtactgcttggactctgtgggacatagctctggagctgwctttcactgtcacttgcttgccagtgcctcccttgttgtcagagactcaagaatgtggctgcctgtctgtgagaccttccagccctatctagtcctctgg

SEQ ID NO: 19412 - DNA, 201 bp, Homo sapiens
ctgaatccttggccccttttccacgggacgtttgtttttggccaccacagctgccagagaagctgcctacttctcttacggcccccaggcctagccgtgcrggggctgggtgaggtgcaacctgcgaagcgctggctggacaggctgcaggacctttccccgggttcctgggcaggaactctggaagcagccccatcagct

SEQ ID NO: 19413 - DNA, 201 bp, Homo sapiens
cagccccatcagctctcttatcaggcaggggtacccgtgccttatcacctccagtagcccgccttcctcaagggcagcattcctatctcattatgcccccyggttcctagcacagtgtctggcacagagcagtgctcggcagattgtaactgacagatgaaatctgccaagaaaatttcccggcagccaccttagatcatg

SEQ ID NO: 19414 - DNA, 201 bp, Homo sapiens
agaaatgaactaatatactacataaaaactcatttcatgtttataatatatagtctcattagtctcataagtaaatttgtctctctctataaatatacacrtagcctacatatatttccttttgtgtttcaataattccatgaagtaggcatgctattattatatccatgttacagaggagaaaaatgggctcagagaggt

SEQ ID NO: 19415 - DNA, 201 bp, Homo sapiens
tatatgaaaactgtgtcgtcctatgccttctacagtgacaaaggcaaattaggacatatcctagggcatacagggtggtccccaggaccagagaggacccrtgtctgtgacttcgatgtgccccatcaagatttttaggcagtattcggaacctgcagagttatgtctttttttcccaccctgaacccatgaaatatgggc

SEQ ID NO: 19416 - DNA, 201 bp, Homo sapiens
cgtcctatgccttctacagtgacaaaggcaaattaggacatatcctagggcatacagggtggtccccaggaccagagaggacccatgtctgtgacttcgaygtgccccatcaagatttttaggcagtattcggaacctgcagagttatgtctttttttcccaccctgaacccatgaaatatgggctaaaattggaagctgg

SEQ ID NO: 19417 - DNA, 201 bp, Homo sapiens
atgaaaagttagtgagaacctattaggtgcctggtactgtggtagacactgaaatcagcaatgatcaagatagataagttccctgctctcctggaacatascttccagtggggtaaacaaatggtcagcaagcaaataaataaacaagatattttggataaatctggatggtgtttaatgaaatagggtagggaaactgga

SEQ ID NO: 19418 - DNA, 201 bp, Homo sapiens
acctgcagagttatgtctttttttcccaccctgaacccatgaaatatgggctaaaattggaagctggggcaaagctaggaggcttccaagcttatgatgckagtgggtttaaggcctcagatggaaaggaaatggagtgctgggcatggaggtgagatgtccagagcagacaaactgctctaaaccctccatagattgata

SEQ ID NO: 19419 - DNA, 201 bp, Homo sapiens
gaactcttaagttttcgtctgtttttgctgctacttgaatgttctttatttctagctcaggcttagaatttggactgaaagaagtcctcctgcgttcatgrgctcatgtgttctcagtctgccagggaacttccatggagcctggtttgtgctcctccctgagggaagcagggcaggatagggcttcaagtgcaagccaag

SEQ ID NO: 19420 - DNA, 201 bp, Homo sapiens
tgcacacctcattccagacctaacagatcagagtgtgcattttaaattggatccctaatggttcatatgcagatcaaagtttgagaagcattatgctaagyaactgctgtaaccataaatgtgtaactgatcaattggtataattacacaattttccccagcggggctaatgagcccactagccgaaagagagaaactccc

SEQ ID NO: 19421 - DNA, 201 bp, Homo sapiens
ctgcagaggactggaaccagccggcatcatttgttcttgaggtctctggatgaaccccagggatcctcaccagagttcctggtgcaagccacaccccagcytagatataactttgtctcctgggtccgggccataaacccagggctgggtgcccccgccaatctgttacctggagcgagtaggcagcgttgtagatgttcc

SEQ ID NO: 19422 - DNA, 201 bp, Homo sapiens
ttaatgaaaagttagtgagaacctattaggtgcctggtactgtggtagacactgaaatcagcaatgatcaagatagataagttccctgctctcctggaacrtagcttccagtggggtaaacaaatggtcagcaagcaaataaataaacaagatattttggataaatctggatggtgtttaatgaaatagggtagggaaact

SEQ ID NO: 19423 - DNA, 201 bp, Homo sapiens
gctctcctggaacatagcttccagtggggtaaacaaatggtcagcaagcaaataaataaacaagatattttggataaatctggatggtgtttaatgaaatrgggtagggaaactggaggcgttaagagcagatgggcagtttttcccatagagtgattagggaaggtatttccgaaaaagggacctgttggcttagcgtgg

SEQ ID NO: 19424 - DNA, 201 bp, Homo sapiens
atttatctgatgccaactctttctggcttctgttcctacttatctgcctctctttctccttttactttctgctcagcccttaaacatttgcatgtttaggkttctgtctcaggtcttgggtgatggcatttatttccatgtctacaattaccccccaaggttttctccttaactccaggtccatagcatctaatgaatgct

SEQ ID NO: 19425 - DNA, 201 bp, Homo sapiens
aaagccttccttgaacctcatcttccccattgaaaatgagccccaggtcagtcgtgtcataatatgcactcatatggtcttacatttcttcttcatagcasttatggcaattataatgaatcatttgtattatttctggtttattactcaatcctctctgctggactctagactctctcaggacagggacggtgtcctcca

SEQ ID NO: 19426 - DNA, 201 bp, Homo sapiens
agtgaatggcatttctcaagagcccctcaggccaggtgcggtggctcacgcctgtaatctcagcagtttgggaggccaaggtagggggaccacctgaggtsgagggttcgagaccagcctgaccaacatggtgaaacccagtctttactaaagatacaaaaacttagccaagcatggtggtgcatgcctgtaatcccagct

SEQ ID NO: 19427 - DNA, 201 bp, Homo sapiens
tatcctggctcttgaccatactttaacccttagttttgtggtttcacgagtcagttataatttcttgaaatgcagtaaccattattcaacccctttattayagccttttcttttgggtgaggaatgcatactttactagtcgttattcagcaatgaatccttgccaccagctctttgtggtacatatgaatttgcttaaaa

SEQ ID NO: 19428 - DNA, 201 bp, Homo sapiens
ccttagttttgtggtttcacgagtcagttataatttcttgaaatgcagtaaccattattcaacccctttattacagccttttcttttgggtgaggaatgcrtactttactagtcgttattcagcaatgaatccttgccaccagctctttgtggtacatatgaatttgcttaaaatctgacactaatcttatagcagtgcag

SEQ ID NO: 19429 - DNA, 201 bp, Homo sapiens
acctcttatgagttcgacctgtgctgtttgccaggctcatgtccactcccaccccctgtgctctccatcttcactgatcctgccccgttgccacctgctgwcctagcaccatactcccctagaagccattttggtgtattggctattaaatttcatttagaaatccaagctgttcatctccttatgaagagttaccattaa

SEQ ID NO: 19430 - DNA, 201 bp, Homo sapiens
caggccgccaggcacctgagaccgcccggagcgggccacgacttcacaacgccccctggcgccccgaagccgccctgcgccccagcccggccgcgctgcgycttcctgggccaccgcgcagtgcctgctgccgccccgaggccgccctgccatcctgcattcccgctgggtctctgcggcacttaccccaaggcgcctcaa

SEQ ID NO: 19431 - DNA, 201 bp, Homo sapiens
agcattttggattttgaattttcaaatttgggatactcagctggtaagtataacacaaataattagaaatcgaaaaaaatatgaactctgaaatacctttrgttctgagcattttgcataagggatactcaacctgtaccaggaataacatgcttttctctgtggccaaatgtgaacagagtccaaggaatgtgtgtggca

SEQ ID NO: 19432 - DNA, 201 bp, Homo sapiens
gggtgaaaaattgggcaagaaattgggaaggtcataatgactatctgagagtgatcatcaaccttatgacactaaatttcttccaacctctttattattartactgtattgggctttttaatttaagggtttttcagtttagttgaaatgtagttattaaatcagtggttatagtggtcttgctgaaaacttttttctgat

SEQ ID NO: 19433 - DNA, 201 bp, Homo sapiens
aattgggaaggtcataatgactatctgagagtgatcatcaaccttatgacactaaatttcttccaacctctttattattagtactgtattgggctttttartttaagggtttttcagtttagttgaaatgtagttattaaatcagtggttatagtggtcttgctgaaaacttttttctgatggggaactatgatgaagatt

SEQ ID NO: 19434 - DNA, 201 bp, Homo sapiens
gatcacaccactgtactccagcctgggtgatagagtgacactctgtttcaaaaaaaaaaaaaaaaaaaaaaaaagagagagaaagaaagtaacatatttamcatttatacagtatttaccgatttagtcgttcctctttgagggataatctattcaacaaaccagaatctgtttagagtttgggtgccagctctggctgct

SEQ ID NO: 19435 - DNA, 201 bp, Homo sapiens
ataataggcacaatggcaacaagcatttatggggcacttcctgtgttgccaagcactgtcgtaagaactttatgtgaactaactcattgaattctaccaacagccctatgaggcaggtatgtatattttcatcatcctcatttcgcagatgtggaaactgagatgcagattggttaaggaacttgtccaagactatgctgt

SEQ ID NO: 19436 - DNA, 201 bp, Homo sapiens
ggagtaggattccgatgaagggttataagcagagaagcaaccttactaaatctgtattttgaaaatattattctggatattgtgtagataacagattagasgctacaagaatgaagatggggagacctgaaggaggcccttgccttcatccagggtgggctgctagtagatgggataggttgtggcagtagagacggagag

SEQ ID NO: 19437 - DNA, 201 bp, Homo sapiens
agagacagaggaacagggtagaggtaacttacttgttgagctttttgtttacttgccggccttggtcccaagtgagaacaggcagcaaccacttctacaayggagagagaaagcgtgggcctgagggtgcctgagaggctagggccagcctcccgcctcaggctccccaacttgtcccccagcctccacaaggtaattctt

SEQ ID NO: 19438 - DNA, 201 bp, Homo sapiens
attctggatattgtgtagataacagattagaggctacaagaatgaagatggggagacctgaaggaggcccttgccttcatccagggtgggctgctagtagrtgggataggttgtggcagtagagacggagagatgttgaggactgtctgaggaggcggaggtatcaggggcaacacacagatggtccccaggtctggggct

SEQ ID NO: 19439 - DNA, 201 bp, Homo sapiens
catgtcaccacccttccagcaatccagaggcaaacctgcagtgtcctctttgactcttctttcttgtccctctcatctaggcatggccatgcctcttcatygactcctgtgtgtcccctccccattcttgctgtcagacagcgtgctggttcagacattttgttgcttttcagctggtcactgttgcaatgattttaattg

SEQ ID NO: 19440 - DNA, 201 bp, Homo sapiens
catgtagaaaggaactgatctagtctaaacatggaactatctcttaaatcaagataacagctgtaatcatatagatgcttttcctgagttagttgttttaygtcttcctttgtgtgacttaaagtttttagtttgactctgctacttttgttctatttgtgcgtggcttgatggatttttcctgtccccatctatacactc

SEQ ID NO: 19441 - DNA, 201 bp, Homo sapiens
tataatgaatcatttgtattatttctggtttattactcaatcctctctgctggactctagactctctcaggacagggacggtgtcctccacactgaggtgycccatgtctagcacatagaaggtgctcagaaaatgtcaattgaatggataaatgacaggcggatatccaagccctaattgcccaccatctttttatgtaa

SEQ ID NO: 19442 - DNA, 201 bp, Homo sapiens
gttagccccaagataacctcccctctgaccagagaaattccagccctgccatgaacttctccccacaagcctataataagctctcaccctaaaactgaaaratgctcttagtctgtaagagagagcgctcctgacagaaatcagccagaagcccctcttaggtttattctccaaaataaacctgtctttgtcgagccactt

SEQ ID NO: 19443 - DNA, 201 bp, Homo sapiens
taatatgcactcatatggtcttacatttcttcttcatagcacttatggcaattataatgaatcatttgtattatttctggtttattactcaatcctctctsctggactctagactctctcaggacagggacggtgtcctccacactgaggtgccccatgtctagcacatagaaggtgctcagaaaatgtcaattgaatgga

SEQ ID NO: 19444 - DNA, 201 bp, Homo sapiens
ttgtggctggtcttgaacccctaggctcaagcaatcctcctgccttggcctcccaaagtgctgggattcaggcatgagccaccacactggctgaactttgyttttgcacattggaaaatggactagctttcttattctgtttgtcaatgatatttgatgctccaacttgcaagggaagaccatatagagagagtgacattt

SEQ ID NO: 19445 - DNA, 201 bp, Homo sapiens
agcagagttgaaagtgggtaggtcatcgtctatatccagggctggattgtcctggccctgtgggctacggggagcttctggacatgggggagcctgtttcyaggcccaccactccttggctttctgccactggcggcgggcaatgatagagaagaagtcaatgaagaagacctcgatgatctcgatgacgcagacaacaga

SEQ ID NO: 19446 - DNA, 201 bp, Homo sapiens
gaggtatcaggaagagccacctgatactgtcatttttttttaagtcaaatgctttaaagccctttaacagataaggaaaggaagactcagagaggctcatwtaccccctctatatggatccttactggttccaccttagctgatattaaaacctgttcctctagatagctaaaactatcatctgtttccctgatttgtatg

SEQ ID NO: 19447 - DNA, 201 bp, Homo sapiens
agttgggtcgtccagtaggtagctgactgattggggagtggtatgtgcagatggcattgtctggtcaactgaggatttgctctttgtttacctaacctgcrctccccatttacggttttgctagatagagttccttgagttctatcttctctctcattttaaatgattgtgaactactttttttttttttaattaaagatg

SEQ ID NO: 19448 - DNA, 201 bp, Homo sapiens
tggtatgtagtatatacttgacgtgtttttctcttaagtttttgccattattttccactgttgggattttactggcattttgttgttgttgttcaagtgawcatttattgagcccctcacatcctgcttgccctgggctctatcacagcagagatcagtaggtccccagcctctgtcttctgagagtgtaatcaagtagag

SEQ ID NO: 19449 - DNA, 201 bp, Homo sapiens
gcaataaaaaggaatgaaatattgatacatgcaatagcttggatgaacctcaagggcattgtgcttagtgaaaaaatgtcaacgttaagaggttgtgtacyacatgtctccctttacacaacattctcaaactgacaaaactatagagatggagaacagattggtggttgctaagggacagggactggggtaaaagcatat

SEQ ID NO: 19450 - DNA, 201 bp, Homo sapiens
ttgttgaatatctttatgctctttcactttttttgaattttaattctgtatttccttgagattgagtcttggaaatggaatcattgggctaagggcctgcwtgagccttttgggagccaggcagatttcagggctttattcgttgatgtgagggttgatgtgattaatttgattatccgtgtgagtgtctaggatttggat

SEQ ID NO: 19451 - DNA, 201 bp, Homo sapiens
agcaggagggagttcctttatgatgatagaccagttctgtatcttgattgcagtatggttacatgaatctatacatgagtttggattgcacagacaccccwccccaccccacacataaatgaatgcatgttaaaactggcgaaataaaatctgtagtctagtcaacaattgtgtactaatgtcaatttcctagttttaaca

SEQ ID NO: 19452 - DNA, 201 bp, Homo sapiens
gctaagggcctgcttgagccttttgggagccaggcagatttcagggctttattcgttgatgtgagggttgatgtgattaatttgattatccgtgtgagtgkctaggatttggatttctgcatccttcacactcagtgtgttatatatgtatacttctcagggactttctttattaattcagtggtttctgcaacaagaccc

SEQ ID NO: 19453 - DNA, 201 bp, Homo sapiens
tcgctatgttgcccaggctggtctcgaactcctggcctcaagcaatcctccctctctggactcccaaattattggaatttcaggtgtgagttatcacaccyggtctttaatttgattttctacttgtgtgttactaatacattggagttagtgcagctgttcaaggatgtcgtcaagaatcagcctcttgttttctgtggc

SEQ ID NO: 19454 - DNA, 201 bp, Homo sapiens
gttgttaaaatgcagattctgactcgataggggtggagtgggtcttaagagtccgaatttccaaattcctaggagatgccttggttgctggtccaagggckgtttgcccaggtggatggaaacaggtccagcattattggagagaaatttaaagaaaatcctctaaaaaatctcagctgcttcttctaacaatatatgctc

SEQ ID NO: 19455 - DNA, 201 bp, Homo sapiens
tttttttgtagagtcagggcctatactatgttgtccagactggtctcgaactccatatctcaagcagtcctctgcctcagcctcacaaagtgttgggattrtaggcataagccaccatggccggcctggaatgtttattttgatgtaatctttattttgcactgtttctagctataatcgatggtataatgatataatcga

SEQ ID NO: 19456 - DNA, 201 bp, Homo sapiens
gcaatcatagctcactgtagctgccaactactgggctcaagcgagcctcccacttcagcgtctcaaatagctggaattacagaggtaagccacctttcctrgcttcagctgcctttttatagggactcagataactacaagaaacgagattagaaaactgcaattgggagggaccatagagacacagcccctttgtgccgg

SEQ ID NO: 19457 - DNA, 201 bp, Homo sapiens
taatgatataatcgattgtgtaaggattctagaacagtgcctctcacaccatctgtgatgaagaacttggttttttctactttaaaatttccaatcctttmtcaactagtgcatttgtaagaatacaataaaaatatcacggcagtatcagattgctataaaagttttttaaatgcttttctcctttttggtgcttctctc

SEQ ID NO: 19458 - DNA, 201 bp, Homo sapiens
aatgaatggtctagaggacctctctggaggctctcatgactctgtcagtttgatcagatgaatccttacgtttccatttaatctggaaactaaaatgactrcagtcaaggaagttggggaggaatgtgacagcacctgtggcccagtggagttcactggggacagtgggttggacctggcgcaaagaaagctcatgatgtg

SEQ ID NO: 19459 - DNA, 201 bp, Homo sapiens
tggccatctacaagctagggagagaggcctcagaagaaatcaaccctgccaacaccttaatctcagactttcagcctcctaaattgtgaaaaaataaatgyctgttgtttaagccacccgatctgtgatttttggttatgggaggctgcattagtcagggtttttgagagggacagaactaataggatagatgtgtatatg

SEQ ID NO: 19460 - DNA, 201 bp, Homo sapiens
ttttcccaaagtgttttaaaaagcaggatagctggaagaggctcagagagattgtgctttgcccaggccacgtggtggggagtcggctccaggcttggcayggaggcccctggctctcttggccccaggagagcctcaccttccaacatgctgctccccagggaggaagctgtggaatgttctttttagtacagaagcatc

SEQ ID NO: 19461 - DNA, 201 bp, Homo sapiens
acattttctgatcctttgcctgtctcctccacctcatctttggccatttcctgctttgctcagttcatggcagccactctgatctgcttgttcttcttggwacaggccagacttatttccaacttgggccttttgcagttcctctttcctctgtctggatggtccccagatttccataggtgcttgttgccacacctcatt

SEQ ID NO: 19462 - DNA, 201 bp, Homo sapiens
cacatttctccaccatctttgtctggaagcatgaatgaaggcagatctgaaagaggagacccaggaatgccattcatgtctttgctcagggatgtcagggrgtttcctgcacatccctcagcccagggggtcagcctcccttaaccttggccaaccacatgaacctgccccttatgccaactgggctgggcatggtcccgg

SEQ ID NO: 19463 - DNA, 201 bp, Homo sapiens
agcatggaaaatactttgtattttcactgtgacacccccaaaatctatttttttttttttgagataggatcttgctctgtcgcctaggctggagtgcagcygcgcaatcacagctcactgcaacctgtaactcccggcctcaagtggatcctcccgcctccgcctcccaaagtgctgggattacaagcctgagccattgcg

SEQ ID NO: 19464 - DNA, 201 bp, Homo sapiens
ggtgggaggatcaattgaagccaggagtttaagaccagcctgggcaacatgacaaaaccccatctctactaaaaatacaaaaattagctgggtgtggtgtsgcacatctgtaatcccagctactcgggaggctgaggcatgagaatcacttgagcctgggaggcggaggttgctgtgagccaagaccgtgccgctgcattc

SEQ ID NO: 19465 - DNA, 201 bp, Homo sapiens
aaacaggcttcgtctaacaactatacattttttttagaaggatggcctggcctaagaggctcagggacagaggcatggcctggtctctaatgtttggtggmagggaaattaaacaggatgaggctgggaagggcccatttggttggatgcttttgtggcccttttgctggggcatcttggtgggggcgggatggagtggat

SEQ ID NO: 19466 - DNA, 201 bp, Homo sapiens
aaaacaggcttcgtctaacaactatacattttttttagaaggatggcctggcctaagaggctcagggacagaggcatggcctggtctctaatgtttggtgrcagggaaattaaacaggatgaggctgggaagggcccatttggttggatgcttttgtggcccttttgctggggcatcttggtgggggcgggatggagtgga

SEQ ID NO: 19467 - DNA, 201 bp, Homo sapiens
aacacacagatggtccccaggtctggggctttcacacagaggtttgaggttcagctcctatgggagtgaagagtgggcatttggcacccactgtgtattcygttgggatctgcaggtggaaagctggctgagggtttggatcccagcctgctgtttctccttccccagacacagagtaatttcctgggctttctgttttct

SEQ ID NO: 19468 - DNA, 201 bp, Homo sapiens
aacctctcagatgctttgctttctttataataatatcaacttcatgaagttgtgagcatgaaatgaattgatacatgtaaggtgtgtgtgtgcatggtagytctcactaaatgtcatccagaagtatctttctgatgagctcactttttttatttttaaagacagggtcttgttctctcacccaggctgaagtacagtcgt

SEQ ID NO: 19469 - DNA, 201 bp, Homo sapiens
ttggatcttcatggatcataagctaccacaatatccatggagcttatagcataaaagctaatggcagagttcctgaaggcaggctactcaggtcaaatccmatctttgctatttttctgctgtttggcatcatgcaagttacttaacctctcagatgctttgctttctttataataatatcaacttcatgaagttgtgagc

SEQ ID NO: 19470 - DNA, 201 bp, Homo sapiens
atttataacactatttctcaagaaaatatggactggcttgttacatagtttctgggaagaaattgttgggaagaataagacagggctagactttagcatcktgttgctctttatatatagaatagatcttggaaaatgcctggaaacctccaactaccttagaggcagtacagtttggtggaaggagcttgggttagaagc

SEQ ID NO: 19471 - DNA, 201 bp, Homo sapiens
aacacctttgccagcatccttgattggcgttcaccagctcagctttggtaaagaatgtgttttccatttataacactatttctcaagaaaatatggactgkcttgttacatagtttctgggaagaaattgttgggaagaataagacagggctagactttagcatcgtgttgctctttatatatagaatagatcttggaaaa

SEQ ID NO: 19472 - DNA, 201 bp, Homo sapiens
ctttgcatagagatagtaaaaagtccgataaaaattgaactcttttttttttttttctttttaaactttcactttctgcttgggtaatggcaggatagacsttagtttcgacagggacccaggtggtgtgggaaggaccgggcagccacagtactgggagctggaaggagtgagtgcagcttctataatgagcatagtgac

SEQ ID NO: 19473 - DNA, 201 bp, Homo sapiens
ttagtagagacggggtttcaccatgttagccagaatggtctcgatctcctgacatcgtgatctgcccacctcagcctcccaaagtgctgggattacaggcrtgagccaccacgcctggcctctgattatgaatatttttttggaagttttaagttactggatttaggagtatatgatatccaagtctttttagctctttgc

SEQ ID NO: 19474 - DNA, 201 bp, Homo sapiens
ggagatgtcatcatagagccctacttacattggggagggaggtcaaaggtaaaaaccatttactttgaaacgtggtgtaaggtggccttcatgttttaaaraggaggaagggctctcccttctctgatttctctcttctgcctcaggactcagactagcccttttagcagaggggagcctatagagaggaggtcatatact

SEQ ID NO: 19475 - DNA, 201 bp, Homo sapiens
tatagagaggaggtcatatactagttgattttggactaaaggcatcccaaagatgtactattttttgctccctgcactattttttttttaatggaaccaaygtttaaaaataggatttctgccttctcttaaaacatcagatgatctggtaacgctgagctcctgttctcacatgggaacaactggctggagctgagtggc

SEQ ID NO: 19476 - DNA, 201 bp, Homo sapiens; identical to SEQ ID NO: 3415

SEQ ID NO: 19477 - DNA, 201 bp, Homo sapiens; identical to SEQ ID NO: 3416

SEQ ID NO: 19478 - DNA, 201 bp, Homo sapiens
gtcaagtataggggttgtaaataaaacttgggtttgaatcagataagaactgtaccaatctcaaagacggtgaattaaagattaaagaaaatattgcatgyttggcataatgtgtggaacacaacagctattgtaaacacccagtaggaatgtaagctgcaagagggcaggtagaaaccgtgctaatttaatccgctgggg

SEQ ID NO: 19479 - DNA, 201 bp, Homo sapiens; identical to SEQ ID NO: 3417

SEQ ID NO: 19480 - DNA, 201 bp, Homo sapiens; identical to SEQ ID NO: 3418

SEQ ID NO: 19481 - DNA, 201 bp, Homo sapiens; identical to SEQ ID NO: 3419

SEQ ID NO: 19482 - DNA, 201 bp, Homo sapiens; identical to SEQ ID NO: 3420

SEQ ID NO: 19483 - DNA, 201 bp, Homo sapiens; identical to SEQ ID NO: 3421

SEQ ID NO: 19484 - DNA, 201 bp, Homo sapiens
ttctcctgtctagcatcccaagtagctgggattacaggtgcatgccaccacacctggttaatttttgtatttttagtatagacagagtttcaccatgttgrccaggctggtctcgaactcctgacctcaagcgatccacctaccttggcctcccaaagtgctaggaatacaggcatgagccactgtgccccgccaagttaa

SEQ ID NO: 19485 - DNA, 201 bp, Homo sapiens
tcaaggaccatcctgtgtatagcaggcatcaaggaacaaggaaagcattaccaaaaaggtggctcctgagcagtgttctgaaagatgaatagaaatttgcrgggcaaggaagtggtggagttgcatgaaagggcgtgtggttttggggaatagacatttagtggctggctgcaccatagagagcagtgggggtgcaggaag

SEQ ID NO: 19486 - DNA, 201 bp, Homo sapiens
tcaccatgttggccaggctggtctcgaactcctgacctcaagtgatccatctgcctcagcctcccaaagtgctgggattacaggcatgagccaccacaccyggcccactattctgctttgtgtttctacagatttccctagtctagacttctatataaatggaataataaaatacatggtattttgtgactggctttactt

SEQ ID NO: 19487 - DNA, 201 bp, Homo sapiens
tagaaatttgcagggcaaggaagtggtggagttgcatgaaagggcgtgtggttttggggaatagacatttagtggctggctgcaccatagagagcagtggkggtgcaggaagcctgggagaagagtgttggaaactcactgtgaagggcttcgtgagctatgctggtttggatttcatcctctgcaagttgaaaatccaga

SEQ ID NO: 19488 - DNA, 201 bp, Homo sapiens
ttttagaaaatgtgatcataatgtacttttctggatcaagcttataacaccctttgatatatccttgcaggatgactgggtttgtgaactcttaagttttygtctgtttttgctgctacttgaatgttctttatttctagctcaggcttagaatttggactgaaagaagtcctcctgcgttcatgagctcatgtgttctca

SEQ ID NO: 19489 - DNA, 201 bp, Homo sapiens
tgattagcgtgatctcggctcactgcaatctctgcctcctaggttcaagtgattctcctgcctcagcctcctgagtagctgggattacaggtgggcatcastgtgcccagctaatttttgtattttagtagagatggggtttcaccatgttggccagggtggtctcgaactcctgacctcaggtggtccacccgcctcggc

SEQ ID NO: 19490 - DNA, 201 bp, Homo sapiens
aagctaggaagtttaattggggatattaaggttggatttaaataaaggcatgaacaaatgtatagtccacaaggagattttgtttctttctccccacccayaaacaggtaaagaaaaacgtcattatgggccaggcgctgtggctcacgcctgtaatcccagcacttcgggaggctgaggcgggcggatcacaaggtcagg

SEQ ID NO: 19491 - DNA, 201 bp, Homo sapiens
cccctccatgttggatcttcatggatcataagctaccacaatatccatggagcttatagcataaaagctaatggcagagttcctgaaggcaggctactcargtcaaatccaatctttgctatttttctgctgtttggcatcatgcaagttacttaacctctcagatgctttgctttctttataataatatcaacttcatga

SEQ ID NO: 19492 - DNA, 201 bp, Homo sapiens
tcaagaaacagagagaaataaacacagtccctgtgttcctattctcaagcccaacccctccatgttggatcttcatggatcataagctaccacaatatccrtggagcttatagcataaaagctaatggcagagttcctgaaggcaggctactcaggtcaaatccaatctttgctatttttctgctgtttggcatcatgcaa

SEQ ID NO: 19493 - DNA, 201 bp, Homo sapiens
tccatcatgtgggtgccaacacaaagataagtgggaaaattagaggagttgtcaagaaacagagagaaataaacacagtccctgtgttcctattctcaagyccaacccctccatgttggatcttcatggatcataagctaccacaatatccatggagcttatagcataaaagctaatggcagagttcctgaaggcaggcta

SEQ ID NO: 19494 - DNA, 201 bp, Homo sapiens; identical to SEQ ID NO: 3432

SEQ ID NO: 19495 - DNA, 201 bp, Homo sapiens
ttgaaggatttggtaggaattttctaggtggatagtggaaaggtgggaaagtcctttgcagggcagcaaaccctgtaagtgcaagggtttggaacctcaawcaacatggcttcttcagaaaatttcaaggtctagggtggttgtagcagaagggtacaaggtacaaggtagaatgggaggaggcccactgagtgatggttt

SEQ ID NO: 19496 - DNA, 201 bp, Homo sapiens
cctgtaagtgcaagggtttggaacctcaaacaacatggcttcttcagaaaatttcaaggtctagggtggttgtagcagaagggtacaaggtacaaggtagratgggaggaggcccactgagtgatggtttgagcagggctggatctggaagtccttcggtgccatgttgcagaatggcattctgcagaggtaggcaccaaa

SEQ ID NO: 19497 - DNA, 201 bp, Homo sapiens
atttgtgcgtggcttgatggatttttcctgtccccatctatacactcgtcacaatgaggggctactaaataaggcagtgttctctgtttgtgtagtccccmcagctgtttcctatagtaaagactctggaaaacaatgacctcatagtttccacaaaaaaaaaaaaaaaccttttatatttagtaggggaaaataaatcat

SEQ ID NO: 19498 - DNA, 201 bp, Homo sapiens
ggtttagagactcaagtttgaggtttttttctcctctttttggcaaaactttctgtcgtggtgttataaacttccatcagaaagcctgcactgtttggttytatctcttgtggtgccaagaatcactggtagttgttccctgacccgttaatttattaagggttgaaagtggtgaaattataattctaacattcctttttt

SEQ ID NO: 19499 - DNA, 201 bp, Homo sapiens
ggttagttacccttcaggctctattgtgatgtcaggcagctggttaagctgttgtagctgcccccaccccttcccggattctgtcaagcttcagagggtaktgctgagggaggtggagggcatccagggtcagaggctactcttttccttttgaaaatctgtgagcctatgagttttgaatgtagtgagactcctagtgca

SEQ ID NO: 19500 - DNA, 201 bp, Homo sapiens
gcttgtttttctgccaatatccattctttttattctagagacatccctgaatttcctttggagaaccattcaatcctatccacaccccccatcctcattcrtgtggttcaacttaggttgacccccatctctggctctagcaaatcagcttatcttgtcactcaggttatagtctttttttttttttttgagatggaatct

SEQ ID NO: 19501 - DNA, 201 bp, Homo sapiens
gttagttacccttcaggctctattgtgatgtcaggcagctggttaagctgttgtagctgcccccaccccttcccggattctgtcaagcttcagagggtatwgctgagggaggtggagggcatccagggtcagaggctactcttttccttttgaaaatctgtgagcctatgagttttgaatgtagtgagactcctagtgcag

SEQ ID NO: 19502 - DNA, 201 bp, Homo sapiens
gaagccatttgcttgtttttctgccaatatccattctttttattctagagacatccctgaatttcctttggagaaccattcaatcctatccacaccccccrtcctcattcatgtggttcaacttaggttgacccccatctctggctctagcaaatcagcttatcttgtcactcaggttatagtctttttttttttttttga

SEQ ID NO: 19503 - DNA, 201 bp, Homo sapiens
cttgatcatattattttgtactctttgccagggtgagaatcctagacatactcagttgttccttggtgacttagggttgttatgaacatcattgattgatctccttttaggtaatgtggaggtttcttttggggctagtgggactacataggccctattgagtggttctggattgctatattgttcgaattcttatttctg

SEQ ID NO: 19504 - DNA, 201 bp, Homo sapiens
gctttttagttaagtaactagataaatagaatcggctctaaataagacttaactaaactgagttagagtctgagcatctgactaaattaagaaactttagygtttttcctttttaatgtcaactttcttattttttattttatttatttatttatttatttgagatgcagccttgttctgttgtccaggctggtgtgcagt

SEQ ID NO: 19505 - DNA, 201 bp, Homo sapiens
ggtcaagccaagactcccaagggtgctgcctcttagaataaccactacaacttggtaaaaatatagatccttgggctcatcttctagagattctgattcartggctttgagtctgataatcaaccaggtttggaaaccacttctctggaggatatgtttgtgaaggataaaagctaggaagtttaattggggatattaagg

SEQ ID NO: 19506 - DNA, 201 bp, Homo sapiens
ttttctttgcatctgtttttttttttctattctacttttttggagatttctgcaagtttattttccaattcttcttccctcttctatcaaatctttagtcygggtgcggtggctcacgcctgtaatctcatcactttgggaggccaaggcaggcagatcacctgagcctgagctcaggagttcgagatcagcctggccaac

SEQ ID NO: 19507 - DNA, 201 bp, Homo sapiens; identical to SEQ ID NO: 3425

SEQ ID NO: 19508 - DNA, 201 bp, Homo sapiens
catgagatgtgtcactgatttctgttatttatttgtatgttttattattcaaagtgtatgcacttttaagaagcagaatttatatttttacgtttgaaacrttttatttctgaaacagcgttgattatatagtatacagttggaattaagagaaaagtggaaaatgtaacaaaatacaataaatttattacaagatgtcct

SEQ ID NO: 19509 - DNA, 201 bp, Homo sapiens
ggctggttgcagtggctcatgcctgtaatcctaatgctttggaaggttgtagtgggaagactgattgaggccaggaattcgagaccagcccgggcaacacrgctaaaccccatctccataaaaaatagaaaaattatccaggtgtggtgatgcattcttgtagtccaagctacttgggaggctgaggtgggaaaattgttt

SEQ ID NO: 19510 - DNA, 201 bp, Homo sapiens
atttccagcagcagcccataaaccagatttcacttttagataccacccagctgtttgcatttcatctatttctttttctaaaaatgtaaatactattgtcytcctgagttcttctgttttttttgtttgtttgtttttgtttttgtccatgatcactggaaacaaattttgtgtttcttctggcatagaatcaaagaaagt

SEQ ID NO: 19511 - DNA, 201 bp, Homo sapiens
atgcaggcagggctcctttacagaatccaaagaaacacagagggtctcaggagaatgggaaccaggaaaggtctggatctctcaggaggaggattttgtgrtctttttttatttttatttttacttgagacagggtctggctttgtcacccaggctggagtgcagtggtgcgatctcggctcactgcaacctccacctcct

SEQ ID NO: 19512 - DNA, 201 bp, Homo sapiens
cccagggatcctcaccagagttcctggtgcaagccacaccccagcctagatataactttgtctcctgggtccgggccataaacccagggctgggtgccccygccaatctgttacctggagcgagtaggcagcgttgtagatgttcctgattggcacgtcactcccgtcctccgtgcactgactgtagggctcactcagctt

SEQ ID NO: 19513 - DNA, 201 bp, Homo sapiens
gctggagtgcaatgatgcaatctctgttcactgcaacttccatctcccaggttcaagcaattctacctcagcctcccaagtagctgggattacaggcttcygccaacacgctctactgattttttgtatttttagtagagatgggatttcactatgttggccaggctggtcttgaactcctgacctcatgatctgccctcc

SEQ ID NO: 19514 - DNA, 201 bp, Homo sapiens
gtcgggctggtctcgaactcctgacctcgtgatccgcccacctcggcctcccaaagtgctgctcccaaagggctgcgtgagccaccacgcccagcgttggracgtttttgcaatacctctgtagagtttctggtccttagaggatcactgctggggttcagggtctcaggaggctagtcacaagagatagcaggagatctc

SEQ ID NO: 19515 - DNA, 201 bp, Homo sapiens
gaataaattctgggttgcaaaaacatctcatattgcataatttctctactgttgccttctttggcacttgcaactgataattgtctcagtgaaacactctyttctcttggcttctccaatgcattgctttccctgaaattctatttatactcctttggaacatttgtttttgtttttgttttgagacagaatctcactctg

SEQ ID NO: 19516 - DNA, 201 bp, Homo sapiens
ggtgagactctgtcttaaaaaaaaaaaaaaaaaaaaaaaaaaaaaaaaaaggacctcatggggacttggtaaagagtgctgaagattacctgggcaaaaayaaaaatttggaagatgctgtcagtgaccatgtatataatgcaatggataatatgtacttgaattcaaaactttagaaatgaaatttgaggatagaggagg

SEQ ID NO: 19517 - DNA, 201 bp, Homo sapiens
agtaggactagtgagggagtcttctcaggtacaagttttaagggggcatcaaagaatattttagtgcaatatatacatatatacacatatatatacacacwatatacacacacacacacacacacacacacacacatatatatatatatatattttgttttggagacagagtgtcactctattgcccaggttggagtgcag

SEQ ID NO: 19518 - DNA, 201 bp, Homo sapiens
gactagtgagggagtcttctcaggtacaagttttaagggggcatcaaagaatattttagtgcaatatatacatatatacacatatatatacacacaatatacacacacacacacacacacacacacacacatatatatatatatatattttgttttggagacagagtgtcactctattgcccaggttggagtgcagtggca

SEQ ID NO: 19519 - DNA, 201 bp, Homo sapiens
actagtgagggagtcttctcaggtacaagttttaagggggcatcaaagaatattttagtgcaatatatacatatatacacatatatatacacacaatatacacacacacacacacacacacacacacacatatatatatatatatattttgttttggagacagagtgtcactctattgcccaggttggagtgcagtggcat

SEQ ID NO: 19520 - DNA, 201 bp, Homo sapiens
caagcctcaaggaccaaaaaggggctgagtgagaaaggacacagagtcctactcctgcaactctgcactacttgcccaccaaggaagaagcaaaaccagctcttcagggtccctaggcacctaggtttcatccgattgatgctactacgttcctaacaacctttcccatttcctatcatatcaaaagtcaagacatctgga

SEQ ID NO: 19521 - DNA, 201 bp, Homo sapiens
gggagtcttctcaggtacaagttttaagggggcatcaaagaatattttagtgcaatatatacatatatacacatatatatacacacaatatacacacacayacacacacacacacacacacatatatatatatatatattttgttttggagacagagtgtcactctattgcccaggttggagtgcagtggcatgatcttcg

SEQ ID NO: 19522 - DNA, 201 bp, Homo sapiens
ttttttttttttttttgagacaagagtctcactctgcagcccaggcttgagtgcagtagtgcaatcttggcttattgcaacctccgcctcccgggttcaarcgattcttctgcctcagtctcctgaatagctgggactacaggcatgcaccaccatgcctggctaagttttgtatttttagtagagacggggtctcgctat

SEQ ID NO: 19523 - DNA, 201 bp, Homo sapiens
ccggccaggccccgccccctagggacccgcctccccaggccccgcccccacctgcccaggtgctttccccaggccgccaggcacctgagaccgcccggagmgggccacgacttcacaacgccccctggcgccccgaagccgccctgcgccccagcccggccgcgctgcgtcttcctgggccaccgcgcagtgcctgctgcc

SEQ ID NO: 19524 - DNA, 201 bp, Homo sapiens
aagttttaagggggcatcaaagaatattttagtgcaatatatacatatatacacatatatatacacacaatatacacacacacacacacacacacacacayacatatatatatatatatattttgttttggagacagagtgtcactctattgcccaggttggagtgcagtggcatgatcttcgctcactgcaacctctgcc

SEQ ID NO: 19525 - DNA, 201 bp, Homo sapiens
taacatttatacagtatttaccgatttagtcgttcctctttgagggataatctattcaacaaaccagaatctgtttagagtttgggtgccagctctggctrcttttgattgtgttattccattgatgcccagcatctgcggtttacagagagattttgagttgcaccatgccctggctaaggcattagtccagctgtaaca

SEQ ID NO: 19526 - DNA, 201 bp, Homo sapiens
cccgggcaaggtgtcccagcatcccgggcaccgggaagccgccaccggctgatgctggctcggccacccaccgcgctgacggcgtccgacgccctggcgcycggcatccgctccagtgcccagaacccccgagctggtccgacccaacccggctgaactcacctttcggttccaaagggtccaaggctcgtgcgggtgcgc

SEQ ID NO: 19527 - DNA, 201 bp, Homo sapiens
gttttaagggggcatcaaagaatattttagtgcaatatatacatatatacacatatatatacacacaatatacacacacacacacacacacacacacacayatatatatatatatatattttgttttggagacagagtgtcactctattgcccaggttggagtgcagtggcatgatcttcgctcactgcaacctctgcctc

SEQ ID NO: 19528 - DNA, 201 bp, Homo sapiens
gcttcgtgctccgggccacggcgtgggtagacccgggagagctggccgctaccgcccgggcaaggtgtcccagcatcccgggcaccgggaagccgccaccsgctgatgctggctcggccacccaccgcgctgacggcgtccgacgccctggcgcccggcatccgctccagtgcccagaacccccgagctggtccgacccaa

SEQ ID NO: 19529 - DNA, 201 bp, Homo sapiens
agtgtcactctattgcccaggttggagtgcagtggcatgatcttcgctcactgcaacctctgcctcttggattcaagtgattctcctgcctcagcctcccragtagctggaattacacacacccgccaccacacctggctaatgtttgtatttttagtagagtcagggtttcaccatgttggccaggctggtctcaaactc

SEQ ID NO: 19530 - DNA, 201 bp, Homo sapiens
acagaaggaggtctttatttgttcaacactgagtgttaagatgggttaaacagtctgtctaaatatttttggcctggacaaagaaagaaggggaaagtttmtatttactatacctttactttgccttagtaaagagtcagcaatctgtggcactagtggggaagtgtcagcccagggcaaatgtgaccgtgtatctctcct

SEQ ID NO: 19531 - DNA, 201 bp, Homo sapiens
ggcttcgtgctccgggccacggcgtgggtagacccgggagagctggccgctaccgcccgggcaaggtgtcccagcatcccgggcaccgggaagccgccacyggctgatgctggctcggccacccaccgcgctgacggcgtccgacgccctggcgcccggcatccgctccagtgcccagaacccccgagctggtccgaccca

SEQ ID NO: 19532 - DNA, 201 bp, Homo sapiens
tggagtgcagtggcatgatcttcgctcactgcaacctctgcctcttggattcaagtgattctcctgcctcagcctcccaagtagctggaattacacacacycgccaccacacctggctaatgtttgtatttttagtagagtcagggtttcaccatgttggccaggctggtctcaaactcctgacctcaagtgatccaccca

SEQ ID NO: 19533 - DNA, 201 bp, Homo sapiens
gccacctggaaggcgactgggagctgcaaattagcagcccctgatccaatcccacctccccttgtggttgctgaggggaacccagctggcccaaggccatyatccagcgaggggcaccagcaggcccggaagccatgctcttgacccttcagccagtgtctctcccagaccgcttctttcctgttcctcccttgccaaggc

SEQ ID NO: 19534 - DNA, 201 bp, Homo sapiens
attttattacacacagtatttgtgtgtttgcttattttctgttgtcttcccctagcatggaaaatactttgtattttcactgtgacacccccaaaatctatttttttttttttgagataggatcttgctctgtcgcctaggctggagtgcagccgcgcaatcacagctcactgcaacctgtaactcccggcctcaagtgga

SEQ ID NO: 19535 - DNA, 201 bp, Homo sapiens
ttccaaatgttcttatcacacaaagcttggaaacttttctaaatggacagatgtcaactgattttggctggttgcagtggctcatgcctgtaatcctaatrctttggaaggttgtagtgggaagactgattgaggccaggaattcgagaccagcccgggcaacacggctaaaccccatctccataaaaaatagaaaaatta

SEQ ID NO: 19536 - DNA, 201 bp, Homo sapiens
gattctaagataccattaatttagagaatgcccttgatttaataacagctttgggggagagtaccagtattggaaggcaaattatcacattcatcaatgtrcacgatgcatctcaactatacaaactttacaatgagaaataattttagaaatgaactaatatactacataaaaactcatttcatgtttataatatatagt

SEQ ID NO: 19537 - DNA, 201 bp, Homo sapiens
tataattatgcaaaaaacgtttaaagtttaaagtgaaaagagaatctttgaagagattccaggttttctccagaccatgctaatcaggtttcccccctcartttaattcaagatatttcatagaagccttcaaattttattttctaaaacactagatcatgatgttattggtgaccctctggggttggacagggtgcaatc

SEQ ID NO: 19538 - DNA, 201 bp, Homo sapiens
tcaacagtatgttgggattgggaaatgtgcatttcccattagttgctgacaggataaaacctttctgggggtcagcttgacaataggtgtcatatatggamtacgcataccctttgatccaaggtttcagcctaaggagatagctacatgatggacaaggtataggtcatgataatattcactgcactgttgtttctaatt

SEQ ID NO: 19539 - DNA, 201 bp, Homo sapiens
ttaatagtgacaggaagaaaggagagtagcttcatttcccttcagatgggaaagaaaggagtattggctgctttttattttatatccagctggaggaaggrgttagttacccttcaggctctattgtgatgtcaggcagctggttaagctgttgtagctgcccccaccccttcccggattctgtcaagcttcagagggtat

SEQ ID NO: 19540 - DNA, 201 bp, Homo sapiens
ctgtgattgattggaggcctaagagtcagcctggcttgcctgtcaagtatccatagggttggctgtgtagagtgccacagcaggtctgtgacttgcaagcrtctcaggcagttaaaatttactgggagtactctgggtttatggcgatgtgaatgcataatttatagtgaaacttgctggatctgcttatgaataatctcc

SEQ ID NO: 19541 - DNA, 201 bp, Homo sapiens
cctgggggtaaaccacctctcccactgcttcaggagcttcaaacccaagaccaggtatttctagcaagtgacaggtggacgagggctagactggaagctcygtgagattggaatgcatgcctgacttgctctctgctgtgcccccacagcttagcccaaaacaggggttcaaacacagtattactgtcacagttcttgcca

SEQ ID NO: 19542 - DNA, 201 bp, Homo sapiens
cagggactccttgatcccagatgggctggctctgaaggtcatgctcctttcatcccatgaggcttaccttcgtttcaccttcagtgtcttacagtgttgtyagaatgtcttcattggcttaacttaacagtattctctttactgtgttcaggaggcttttcaactcgaccatttgtgagaagtgtccagcgtcagagtttg

SEQ ID NO: 19543 - DNA, 201 bp, Homo sapiens
tgaacactgatggaaacactgatagaaaaaggggcatccctggtttctggccaagtgggagagatcccgcttttccagagggctcccgcatccccactgtsctgctgcccccatgtccactattggagggcctcaagatctccttggcacaggtttccttaccatattcgctgccccccatggaggtgctgagaatggtct

SEQ ID NO: 19544 - DNA, 201 bp, Homo sapiens
tgatcctcccacctcagcctcccaagtagctgggactgcaggtacatgccaccatgcccagctaatttttgtatttttttgtagagacagggtcttgctaygttgccagggctggcctggagctcctgggcacaagccatcctcctgattcactctcccaaagtgttgagattacaggtgttagccactgagcctggccca

SEQ ID NO: 19545 - DNA, 201 bp, Homo sapiens
aggttaattcctttttttttttcctatcctaatcttgcccaggacgaagtctcagcttgatgttagcctgtttttaatacctcttgttcaccccccacccwtttttttttttttttttaaacagaacaagcttcaagtctagaagcattggcaggtaacagtagctagaatttaataaggttatgtttttattgggtttcc

SEQ ID NO: 19546 - DNA, 201 bp, Homo sapiens
ggttaattcctttttttttttcctatcctaatcttgcccaggacgaagtctcagcttgatgttagcctgtttttaatacctcttgttcaccccccacccatttttttttttttttttaaacagaacaagcttcaagtctagaagcattggcaggtaacagtagctagaatttaataaggttatgtttttattgggtttcca

SEQ ID NO: 19547 - DNA, 201 bp, Homo sapiens
gatcttggcaatttgaatggaagtacttgactgagatagggactggaaaaaaagatctatgtcagtgatctcaaaattattattattattattatttttgagatggagtctcactctgtcgcccaggctggagggcagtggcctgatctcggcccactgcaacctctgcctcctgtgttcaatcaagcaattctcctgtct

SEQ ID NO: 19548 - DNA, 201 bp, Homo sapiens
tggaggaaagtttggagactcagcgcaagtttccttttacttccccagcctttaaaatggttaccttgttatctctcgcgctctctctttctctctctctccccccccccaacctctccctctctctttctccttctctgtctctgagtgtgtatatgtgtttgcagcagcactagggtaaaacttgggcttcactggcag

SEQ ID NO: 19549 - DNA, 201 bp, Homo sapiens
gagggagaaagttgatagaatcatgaagttttagacttggaagcagacttggatgtggtgtgagtagttcctagcctttcaggatgtgggaactgagttcmcccactagctagaggttgagggagcagaaccagaattctgacttccactgactgtgaactctgtgtacccctgcactgctggtgcacaaactgggtcctg

SEQ ID NO: 19550 - DNA, 201 bp, Homo sapiens
gagacagtatagaaggagaagacgaggagggcgcactgccagaggatgagggccacggcagtcagtgtgaacccgatccagaggaggcggcgcagacggcmgcgggacaccacgatgcggcgacagccatgggtgttggtgttgaggcagtaccaccgcatcagctctttaatggtcggcgcctgagggcccgtcacgggc

SEQ ID NO: 19551 - DNA, 201 bp, Homo sapiens
gagaaagttgatagaatcatgaagttttagacttggaagcagacttggatgtggtgtgagtagttcctagcctttcaggatgtgggaactgagttcacccmctagctagaggttgagggagcagaaccagaattctgacttccactgactgtgaactctgtgtacccctgcactgctggtgcacaaactgggtcctgggcc

SEQ ID NO: 19552 - DNA, 201 bp, Homo sapiens
agttatttctccacagacttattctaatacacagttctgatcatgttacatgctattgatttaccagtggttccccttttctaagatcaaatctaaacacyttgaaaggagcataaccccctcctcccctgccatgatttggtccttgcctttctttccagtctctctactccattttctctccttcctcggttcttctct

SEQ ID NO: 19553 - DNA, 201 bp, Homo sapiens
ttgaagccttgtgaatgatgctaccgccgactttccgcttcctccctgtgaagaagtccctggccttgcccttctcatcctgatcaaagatcagcagcggratccggtgggagaatctaggctgctttccctctgagacggagttccaggactccgcctctcggcgcttccgggactctggaaagccgtacagggacttca

SEQ ID NO: 19554 - DNA, 201 bp, Homo sapiens
ctgaggtgggaagatcacctgagccaagaggtcaaggtgtggtgagccgagattgtgccactgccctctggcctgggctacagagtgagaccctgtgtccaaaaaaaaaaaaaaattattgtataaatgctaaagagaaatagataggtgtatgagagggaataatgggtgtgaccaggcaggaagaataaaatgcagaag

SEQ ID NO: 19555 - DNA, 201 bp, Homo sapiens
aagccctttaggtaggtgatcgtgatgcaagctaagtgagaactgccgctcttatcaggattttccacgccttgattttttgagctgaattcccccactarcctccacttttcttttgattccagttccattccttgacttccacctccctactggaatttctacttagaaatcctacaggcatcttacccttagcatttc

SEQ ID NO: 19556 - DNA, 201 bp, Homo sapiens
agtgaaagaatgagaaggtgaaatcttaccagttggaatcccaccacttgcttggactcgatgtgcatgacatttgaagccttgtgaatgatgctaccgcygactttccgcttcctccctgtgaagaagtccctggccttgcccttctcatcctgatcaaagatcagcagcgggatccggtgggagaatctaggctgcttt

SEQ ID NO: 19557 - DNA, 201 bp, Homo sapiens
cctttcattccagaaataaatcccatttggttatgatgtctatttagattttgaagactgtttttgatttttaaactttataagagctctctatagaatatgtgtgtgtgtgtgtgtgtgtgtataaggtaacaactttaaacatttggtacatttgataaaaatatttccctcattctcttcctcttttagtttggtact

SEQ ID NO: 19558 - DNA, 201 bp, Homo sapiens
ctttttggcatcttatcatgacattcaggaagatatactatgccataggtttttttttttttttttttttttttaaattttgctatcagctcttaagattstaacatttttgctatagaatgttttcttggtacctgcttttaagaaatttgcatgtaactcttcattgataggcagcaaaatgaagtaaagccctggaca

SEQ ID NO: 19559 - DNA, 201 bp, Homo sapiens
ctttcattccagaaataaatcccatttggttatgatgtctatttagattttgaagactgtttttgatttttaaactttataagagctctctatagaatatgtgtgtgtgtgtgtgtgtgtgtataaggtaacaactttaaacatttggtacatttgataaaaatatttccctcattctcttcctcttttagtttggtactt

SEQ ID NO: 19560 - DNA, 201 bp, Homo sapiens
tcaaagaagtatcttgatctggggtggtgggtgatagtgctgttcctgtcagaccacacctaggattttatgtttacgtgtcattctggaaacctaggatatcatgtaatttctgggctgacaaactgtagtgtgtctagagttggtggtggaagactccctaggggagtctttcagcagggagaggggattgctttgaga

SEQ ID NO: 19561 - DNA, 201 bp, Homo sapiens
tactttaaaatttccaatcctttatcaactagtgcatttgtaagaatacaataaaaatatcacggcagtatcagattgctataaaagttttttaaatgctkttctcctttttggtgcttctctcgtgtgggctcgtgtcagtccgtgagccataattctagtagcactggcctagagaatacttcagaaagtagttctagg

SEQ ID NO: 19562 - DNA, 201 bp, Homo sapiens
caaagaagtatcttgatctggggtggtgggtgatagtgctgttcctgtcagaccacacctaggattttatgtttacgtgtcattctggaaacctaggatatcatgtaatttctgggctgacaaactgtagtgtgtctagagttggtggtggaagactccctaggggagtctttcagcagggagaggggattgctttgagag

SEQ ID NO: 19563 - DNA, 201 bp, Homo sapiens
aaagaagtatcttgatctggggtggtgggtgatagtgctgttcctgtcagaccacacctaggattttatgtttacgtgtcattctggaaacctaggatatcatgtaatttctgggctgacaaactgtagtgtgtctagagttggtggtggaagactccctaggggagtctttcagcagggagaggggattgctttgagaga

SEQ ID NO: 19564 - DNA, 201 bp, Homo sapiens
aggagaagagtcctggacccagcccatcccatgcccctaagcagtgaaagaatgagaaggtgaaatcttaccagttggaatcccaccacttgcttggactygatgtgcatgacatttgaagccttgtgaatgatgctaccgccgactttccgcttcctccctgtgaagaagtccctggccttgcccttctcatcctgatca

SEQ ID NO: 19565 - DNA, 201 bp, Homo sapiens
ttgcagtagccttctagcccctccgctgttgctaaactctgtcctttctaattggtagtttttcttttttaaaattttattatattaaaaaatattagttggggggggggtgtcactttgttgaccaggctgggctcgaactcctggcctcaagtgatactcccatcttggcctcccaaaatgctgggattatgggcgtga

SEQ ID NO: 19566 - DNA, 201 bp, Homo sapiens
atacagatttttatgtggagatatgtttttgttcctcgggtatattttagagatggaattgctgggtcatatggtaactgtgtttaattgtttgaggagcygtcaggcacttttccaacattgctataccattttattcccacgagcactgtgtgagggttccagtttttccatatcctcatcaacacttgttaacgtctg

SEQ ID NO: 19567 - DNA, 201 bp, Homo sapiens
cacgagcacaaccttttagtatttcactgttaaagataatagcccacagccgggaacagcctcccgagtagccgggattacaagtacctgccaccgcaccrggctaatttttgtatttttggtaaagatgggttttcaccatattggccaggctggtcttgaactcctgacctcgtgatctgcctgcgttggcctcccaaa

SEQ ID NO: 19568 - DNA, 201 bp, Homo sapiens
gcggaggttgcagtgagctgagattgcactactgcgctccatcctgggcagagagagactccatctcaacaacaacaagaacagagagagactccatctgmacaacaacaacaacaaaaaaaaaaagaaaaggaaaaaaatcaaacgtagtagaatgagaacttgaaccctggtattcataatccagtctttctttttcta

SEQ ID NO: 19569 - DNA, 201 bp, Homo sapiens
gagctgagattgcactactgcgctccatcctgggcagagagagactccatctcaacaacaacaagaacagagagagactccatctgaacaacaacaacaamaaaaaaaaaaagaaaaggaaaaaaatcaaacgtagtagaatgagaacttgaaccctggtattcataatccagtctttctttttctactgcatagtttcta

SEQ ID NO: 19570 - DNA, 201 bp, Homo sapiens
ctggagcctgggatgcttcgacctctttactagggctctacaggaagaaagaccctcatgtctaattttatggctcttttctgacccatgtttccaactcttttttttttttctttaagggaaaaaaataaaaacattctctctttgaagggtaaggagaaattttgtgaaacttgaaaacccggtaagtgttttgccttt

SEQ ID NO: 19571 - DNA, 201 bp, Homo sapiens
gtagcagtttatttatccattcacctactgaagggcatcttggttgcttccaagtttgggcaattatgaataaagttgctataaataaatatctgtgtgcrggttttttttgtggacacaaattctcaactcctatgggcttttttttaaagctatccaattggcaagaatggtgaagtttaacactgtgttggagaggat

SEQ ID NO: 19572 - DNA, 201 bp, Homo sapiens
cactatttctcccttttatcctggctcttgaccatactttaacccttagttttgtggtttcacgagtcagttataatttcttgaaatgcagtaaccattaytcaacccctttattacagccttttcttttgggtgaggaatgcatactttactagtcgttattcagcaatgaatccttgccaccagctctttgtggtacat

SEQ ID NO: 19573 - DNA, 201 bp, Homo sapiens
caaagaattgttaggtctcctgattgagtggtccattcagaattcaagtacaatttgctcaagatgaggacttgggcttctttgctcggccactgctcttyggggaatccacatggtgtgggtggcacgcacctttatccaggatgggcacatgactcaaacatggccaatgagagtgtcatcctctgactgctgtgattg

SEQ ID NO: 19574 - DNA, 201 bp, Homo sapiens; identical to SEQ ID NO: 3435

SEQ ID NO: 19575 - DNA, 201 bp, Homo sapiens
ggtggcaggtgaggtccactcttgttcttgggcagttttttccagagcaaaagattgtaatgaatggtctagaggacctctctggaggctctcatgactcygtcagtttgatcagatgaatccttacgtttccatttaatctggaaactaaaatgactgcagtcaaggaagttggggaggaatgtgacagcacctgtggcc

SEQ ID NO: 19576 - DNA, 201 bp, Homo sapiens; identical to SEQ ID NO: 3423

SEQ ID NO: 19577 - DNA, 201 bp, Homo sapiens; identical to SEQ ID NO: 3422

SEQ ID NO: 19578 - DNA, 201 bp, Homo sapiens
gctactcgggaggctgaggcatgagaatcacttgagcctgggaggcggaggttgctgtgagccaagaccgtgccgctgcattccagcctgcgcagcagagygagaccctgtctcaaaaacaacaacaacaacaacaacccaaaaaagtgtaaactctttgacctggctgctccagtaggaatttatcctaaggaaatagtt

SEQ ID NO: 19579 - DNA, 201 bp, Homo sapiens
aggaattcatttaaacaacaacctaaaccacttgaaatttggcttggattatcatagactgtcttctcctacacaaacagcagcaaagcaggggaaaatgkattctcccacatcaagagcaggcagcgacaagattgtcctgttggtgtgtaaccgagcctgcactgggcaacaagggaaaaggtgagaaccagattattt

SEQ ID NO: 19580 - DNA, 201 bp, Homo sapiens
tgcttctatttacagaggacattgataatcaactttttcaaaactgcaaacatacagaaagattaatttaggacatcaaataaactaaggtttaattatgaaaaaaaatcgtaaaaggcaaatcaaagcaacatcagatgtgaccaaaaacgtataccagatcactttccgggactcttggagaagggcttgggtgaagat

SEQ ID NO: 19581 - DNA, 201 bp, Homo sapiens
gactcttggagaagggcttgggtgaagatttgggatgcaggggtcttatctgctcatttgatgaaccaggattcgaatcacaggttcagtgagttgcctcttgataaccagtggtttgtggcagagccggagcttgagcttaggattcttgactcctactgcttttcttttttctgtgatacatactaaaggattggccgt

SEQ ID NO: 19582 - DNA, 201 bp, Homo sapiens
gctgtgtataaaatatctgctttgaaatacaatgaagagtttgatttcagttaatttgtttggaatgtctatgttgaaactttcttttttttttttttttycctattttttccccattgggagtcagttaagagagaggattcaggacagaagcttgctgtacttctgacagtttgtgtggcccaactctatgccatgaga

SEQ ID NO: 19583 - DNA, 201 bp, Homo sapiens
ttgaatgctaggttgcttttaggatgtgttgtgaacatccatgcaacacctgtgttaacacccactcatcattttctttcttttctaagatttttttctargacaaggttttgctttgtcacccaagctggagtgcagtggcatgagcatactcactgtagccattgggaggcagagatgggagaatcacctgagtctggg

SEQ ID NO: 19584 - DNA, 201 bp, Homo sapiens
accaaggtttcattagtgctaatgatgttttttttattaattcttttttttttttgggacggagtttcgctcttgttgcccaggctggagtgcaatggcaygatctcggctcactgcaacctccacctcccaggttcaagcgattctcctgcctcagcctctcgagtagctgggactacagacatgcaccaccgtgcccgg

SEQ ID NO: 19585 - DNA, 201 bp, Homo sapiens
taattgtcacatatttgtgaatttcccaaatttctttctgtcactgatttacaattccactaaattgtgcttagagtacaacggcccccaagtgtagtgcraagtgctatctagtattcctaagcacagcaagactgtatgtgccttactgagaaaggcatatgttagacaggctttattaaggcatgaattatagtaatg

SEQ ID NO: 19586 - DNA, 201 bp, Homo sapiens
aaatgaatacagtgctcaataaacgtttgttgcatgaataagtgattgttaaactagtgactaaaggagatgcgttcttctatagtacatgatcttgcactttttttttttttggcaaatctcggtcaatcaattgacttttttttctattgattacattaagcattggttacattaagcagaagaccactgagaaaacaa

SEQ ID NO: 19587 - DNA, 201 bp, Homo sapiens
gactgtcattatttcttgcctctttagtttgtttcctaactactctcccattgtacagttacctcccctgctttctgtcttttttatttttatttaattawttatttatttatttatttttgagacggagtctcgctctgtcgtccaggctggagggcagtggcacgatcttggctcactgcaagcgctgcctcccgggtt

SEQ ID NO: 19588 - DNA, 201 bp, Homo sapiens
cgcatgccaccacacctggctaatttttatatttttagtagagatagggtttcaccatgttggccaggctggtctcgaactcctgacctcaagtgatccayctgcctcagcctcccaaagtgctgggattacaggcatgagccaccacacccggcccactattctgctttgtgtttctacagatttccctagtctagactt

SEQ ID NO: 19589 - DNA, 201 bp, Homo sapiens
taagtgattgttaaactagtgactaaaggagatgcgttcttctatagtacatgatcttgcactttttttttttttggcaaatctcggtcaatcaattgacttttttttctattgattacattaagcattggttacattaagcagaagaccactgagaaaacaaaggcagtgaagaattgatgctgctaagttcaaattaga

SEQ ID NO: 19590 - DNA, 201 bp, Homo sapiens
attctgtgaagaaagtcattggtagcttgatgggaatggcattgaaactgtaaattaccctgggcagtatggccattttcacgatattgattcttcctatmcatgagcatggaatgttcttccatttgtttgtgtcctcttttatttcattgagcagtggtttgtagttctccttgaagacgtcctttgcatcccttgtaa

SEQ ID NO: 19591 - DNA, 201 bp, Homo sapiens
ctatgatcatgccactgcgctccagcctgggcaacagaggcaagaccctgcctgtttcatatatatatatacgtatatatatatataatatataaatacgtatatatatataatatataatatatataatatataatatatataaaatataatataatatattttatatatattatatatatatatgggtgaaagttgtgt

SEQ ID NO: 19592 - DNA, 201 bp, Homo sapiens
aaaataggatgagttgcctcacataatagtatttttcctatcatcacacaagcttaagcagagtcttgggtgatactgtaggggggcagtcacatgcttcrtagtggattgggctggattcacttactttcttttctttgtctcttgctgctttcttctgacttttgagcttataaaaatgtatgttagaagcagtgttga

SEQ ID NO: 19593 - DNA, 201 bp, Homo sapiens
atgttcagaaaacctttctttgtgaacatttcaactatatataactaagaggggagagcagtacgatgaacctgcatttccctgtcacccagcttcaacarctaccaatttgtggacaatcttatttcatctgtataacctttgcctttattctccccaaacttttgaagcagcttccaaatgtatttcacccataaatat

SEQ ID NO: 19594 - DNA, 201 bp, Homo sapiens
ctttttcctgtgggcatttggtgctataaatttccttctacacactgctttaaatgtgtcccagagattctggtacgttgtctttgttctcattggtttcraagaacatctttatttctgctttcattttgttatttacccagtagtcattcaggagcaggttcttcagtttccatgtagttgtacagttttgagtgagtt

SEQ ID NO: 19595 - DNA, 201 bp, Homo sapiens
tatgatcatgccactgcgctccagcctgggcaacagaggcaagaccctgcctgtttcatatatatatatacgtatatatatatataatatataaatacgtatatatatataatatataatatatataatatataatatatataaaatataatataatatattttatatatattatatatatatatgggtgaaagttgtgta

SEQ ID NO: 19596 - DNA, 201 bp, Homo sapiens
tgccagtctgtcttttaattggggcatttagcccatttacatttaaggttaatattgttatgtgtgaatttgatcctgttattatgatgttatttggttawtctgcccgttaattgatgcagttttttcctagcattgatggtctttacaatttggcatgtttttgcaatggctggtaccggttgttcctttccatgttta

SEQ ID NO: 19597 - DNA, 201 bp, Homo sapiens
agtacctcgggggacagagactatgtctgcttgattgtcctggttcccccagcacctcacacagcacctggcacctagggggtgctctatgaatgttggamgcaagattggccagattggctctcatggcaggcaggcccagcagtgcgcatgagggagatagtgatggcttagagaaatgtgagttcacatggcatgatt

SEQ ID NO: 19598 - DNA, 201 bp, Homo sapiens
gtctgttggagtttgctggaggtccactccagaccctgtttgcctgggtatcaccagtagaggctgcagaacagcaaatattgctgcctgatcctttctcyggaagcttcgtcccagacaggcacccgcctgtatgaggtgtctgtcggttcctactgggaggtgtctcccagttaggctacatgggagtcagggacccac

SEQ ID NO: 19599 - DNA, 201 bp, Homo sapiens
gagttcgagaccagcctggccaatatggtgaaaccccatctctgctaaaaatataaaattagccagatgtgatgttgcgcacctataatcccagctacttrggaggctgaggcaggaggattgctgaaacccaggaggcagaagttacagtgagctgagatcacaccactgcactccagcctgggtgacagagtaagactc

SEQ ID NO: 19600 - DNA, 201 bp, Homo sapiens
ttggcttaattctcatctaacatctgatgcaggtgtgtccattcagcttgcgtgtggtcagtgttgttggaataacatatttgctgccccaggaggagcakcccttgtgccacccaatagtagaaaggtaaaaaaaatttttttttaaattaccttttagaatctcacacatattcatgtgtgatttcaagtgatgtctta

SEQ ID NO: 19601 - DNA, 201 bp, Homo sapiens
gcggttgaggatgtgagttgaaggtcagaccacccttggtttggatccagctctgttcctttctggctgtgtgaccttgggcaagccacttagcctttctsggccttggttatctattctgtgaaaaggtaatatccaccgttcctacctcctggagttgactaaggtggtcagttgcaaagtataatttaagccaggctt

SEQ ID NO: 19602 - DNA, 201 bp, Homo sapiens
ctcagcctcccttatagctgagattacaggtgtgcaccagtatgcccaggtaattaaaacaaattttttttttttagaggcaaggtcttgctatgttgccmaggctggtctcaaactcctgggctcaagtgatcttcctacctttgtctcccaaagtgctgggattataggcatgagctaccatgcctggcccaaaagtcc

SEQ ID NO: 19603 - DNA, 201 bp, Homo sapiens
cttttactcagtgtctacaccacctctcagctcagctcttatctaagttggaagactcagtgctgaaggtttctggtccttttgttctgctgggatgattytcatggactctctggggtatcctggtaggaggtgaactataaattcccagaatgtgagaggaggcagaacagatcatctcacttaagtgttgaaaagtca

SEQ ID NO: 19604 - DNA, 201 bp, Homo sapiens; identical to SEQ ID NO: 3414

SEQ ID NO: 19605 - DNA, 201 bp, Homo sapiens
caaagctaggaggcttccaagcttatgatgctagtgggtttaaggcctcagatggaaaggaaatggagtgctgggcatggaggtgagatgtccagagcagmcaaactgctctaaaccctccatagattgatatgattttgctgggatgaagaacaccatcaaaatgatgctagtagcctctgggcaagaggaatataattt

SEQ ID NO: 19606 - DNA, 201 bp, Homo sapiens
ttatcacttaaaatattgcctatccttacctcctccctcactacaatccaaaaaaataaaaaatgaaataaagaagaaggaaagaaagaaaaaaattagcragagtttgtttttaaaatctaggtccaggttcaattgcttgtcaaataaaactgcagccctcctctgtgaatgttcaacagaagctgtgattctggaagc

SEQ ID NO: 19607 - DNA, 201 bp, Homo sapiens
agaagaaggaaagaaagaaaaaaattagcgagagtttgtttttaaaatctaggtccaggttcaattgcttgtcaaataaaactgcagccctcctctgtgartgttcaacagaagctgtgattctggaagctcctatccccagctctcaggggtacctctgccccatcagccccttccccagaaccgaccttgaccccaatg

SEQ ID NO: 19608 - DNA, 201 bp, Homo sapiens
cagtgaggggtgagtggcgcatgccttctgcatcctcatcttcacgcctagtattgtaacagaagtagcttgatgtggacacttaattttttataaatactttttttttttttttttttttgcgacggagtctcgctctctcaccaggctggagtgtggtggcgtgatctaggctcactgtaacctccgcctcccgggttc

SEQ ID NO: 19609 - DNA, 201 bp, Homo sapiens
agtgaggggtgagtggcgcatgccttctgcatcctcatcttcacgcctagtattgtaacagaagtagcttgatgtggacacttaattttttataaatactttttttttttttttttttttgcgacggagtctcgctctctcaccaggctggagtgtggtggcgtgatctaggctcactgtaacctccgcctcccgggttca

SEQ ID NO: 19610 - DNA, 201 bp, Homo sapiens
tttcactttctgcttgggtaatggcaggatagaccttagtttcgacagggacccaggtggtgtgggaaggaccgggcagccacagtactgggagctggaargagtgagtgcagcttctataatgagcatagtgactcaatctgccaacaagtctcagtctgcagccagcatttcgatcactgtaatctgcttctagtggtg

SEQ ID NO: 19611 - DNA, 201 bp, Homo sapiens; identical to SEQ ID NO: 3429

SEQ ID NO: 19612 - DNA, 201 bp, Homo sapiens
ggtaggaggtgaactataaattcccagaatgtgagaggaggcagaacagatcatctcacttaagtgttgaaaagtcagatgtctacaggagacagtgatgkaagtgacatactggaggggtagtgaaaactgtgggagccagagaacacctgcttcatttattggggtagctacacccactgtttatcctgcaggaaatat

SEQ ID NO: 19613 - DNA, 201 bp, Homo sapiens; identical to SEQ ID NO: 3430

SEQ ID NO: 19614 - DNA, 201 bp, Homo sapiens
aggggtagtgaaaactgtgggagccagagaacacctgcttcatttattggggtagctacacccactgtttatcctgcaggaaatatgggctcaatgttgcygtatcgtttcattttttcgagaggctgggaatctggattttcttgtgaaattccttgactttcgaacaccatccaggctcttgaaaaaccaggtatgcca

SEQ ID NO: 19615 - DNA, 201 bp, Homo sapiens
aacacctgcttcatttattggggtagctacacccactgtttatcctgcaggaaatatgggctcaatgttgccgtatcgtttcattttttcgagaggctggraatctggattttcttgtgaaattccttgactttcgaacaccatccaggctcttgaaaaaccaggtatgccacctggaaggcgactgggagctgcaaatta

SEQ ID NO: 19616 - DNA, 201 bp, Homo sapiens
aaagctcaacagagtagaatgctaccctgatcatgagaggaggtaaacagcattgtcactcaaaattcaaaatccttattcaataattttttttgcttttkttttttagagatgagggtctcactctgtcacccagggtggagtgcagtggcacaatcaagggtcactacagcctctacctcccgggctcaatggaccttc

SEQ ID NO: 19617 - DNA, 201 bp, Homo sapiens
tgtttttatttttttggttggggagatgggggtaaagagaaaaagaatggcagatttgtgggagggaagaaaattattttctctttgaagaaagaatgaamacgggtagagggggaaggaattaagaggtttgaggcaggtggaaactagccatctcaactggtataatccctttctgtttgtattgcatttcatctgctg

SEQ ID NO: 19618 - DNA, 201 bp, Homo sapiens
gctgctgcttctgccagggaggggacagcagggatggccaggctggggatggaacaggtggatggttttcttcttgaacctgtgcagacctgggagggactttttttttttttttcttggagatggagcctcactctgttgcccaggctggagtgcagtggcatgatctcagctcactgcaacctccacctcccgggtgta

SEQ ID NO: 19619 - DNA, 201 bp, Homo sapiens
gcctcctgagagcatctgggggcccagaaagaccattttgatggtttcccttgtccagtgttgtccttttcatggggcaccatgaggcagtgaagccccasatttcatctgtcatacttccattccggttcatcatctcgctgtctcagcttaaatagcacctcctcaggaaagccttccttgaacctcatcttccccatt

SEQ ID NO: 19620 - DNA, 201 bp, Homo sapiens
ttctttctctctctctctttctctctctctccctctctccctccctccctccctcgcttccttcctttttttttttttttttttatggagacaaagtcccrctctgttgcccagtctggagtacagtggcatgatcacaactcactacaacctctctgcctcctaggctcaagtgatcctcctgcctcagcctcctgagta

SEQ ID NO: 19621 - DNA, 201 bp, Homo sapiens
cctgggtgacagagtgacactctgtctcaaaaaaaaaaaaaaaaaaaaaaaaagaaaagaaaagaaaagaaaaacatcattatgaaagaatgaaattaaaatgataacagataccatttttctcttgacagattagcaaagattaaacattaatacattatgttggttagagtgtggggaaatagctactctcatattgct

SEQ ID NO: 19622 - DNA, 201 bp, Homo sapiens
ctgggtgacagagtgacactctgtctcaaaaaaaaaaaaaaaaaaaaaaaaagaaaagaaaagaaaagaaaaacatcattatgaaagaatgaaattaaaatgataacagataccatttttctcttgacagattagcaaagattaaacattaatacattatgttggttagagtgtggggaaatagctactctcatattgctg

SEQ ID NO: 19623 - DNA, 201 bp, Homo sapiens
tgggtgacagagtgacactctgtctcaaaaaaaaaaaaaaaaaaaaaaaaagaaaagaaaagaaaagaaaaacatcattatgaaagaatgaaattaaaatgataacagataccatttttctcttgacagattagcaaagattaaacattaatacattatgttggttagagtgtggggaaatagctactctcatattgctgg

SEQ ID NO: 19624 - DNA, 201 bp, Homo sapiens
ataacagataccatttttctcttgacagattagcaaagattaaacattaatacattatgttggttagagtgtggggaaatagctactctcatattgctggkgtggttctcaattgctatatcctcattgggggacaatctggcaaacacatgtcctgtttgacaaacttctaggaagtaactgggcaaatacacgtcacat

SEQ ID NO: 19625 - DNA, 201 bp, Homo sapiens
aacagataccatttttctcttgacagattagcaaagattaaacattaatacattatgttggttagagtgtggggaaatagctactctcatattgctggtgkggttctcaattgctatatcctcattgggggacaatctggcaaacacatgtcctgtttgacaaacttctaggaagtaactgggcaaatacacgtcacattg

SEQ ID NO: 19626 - DNA, 201 bp, Homo sapiens
gaatgtgtgagagatgtgactcattttccccatcttgctcctgatcaaatgacaaacaaggcccctcatcctggttgacacacatggacatagaactagactctctgccttctgttttctctcggaatcttctcaccttcatctctatcctgacttgacattctttgtgccatgtctgtccccaaattcctccacttttga

SEQ ID NO: 19627 - DNA, 201 bp, Homo sapiens
aatgtgtgagagatgtgactcattttccccatcttgctcctgatcaaatgacaaacaaggcccctcatcctggttgacacacatggacatagaactagactctctgccttctgttttctctcggaatcttctcaccttcatctctatcctgacttgacattctttgtgccatgtctgtccccaaattcctccacttttgaa

SEQ ID NO: 19628 - DNA, 201 bp, Homo sapiens
ccaactcttagggagacatgattccagttatttacttttcacaagaaccaatctgtctgctaacatatacagataggtgaaagaggcttagtgttttattktattgtattgtattgtatttttatttctgagatagggtcttgctcttttgcccaggctgaagtgcagtggcgcaattatggctcactgcagcctcaacct

SEQ ID NO: 19629 - DNA, 201 bp, Homo sapiens
tccataaaaaatagaaaaattatccaggtgtggtgatgcattcttgtagtccaagctacttgggaggctgaggtgggaaaattgtttgagcccaggagttmtaggctgcagtgagctatgattgcaccactcccacctgagtgacagagtgaaatcttgtttctaaaacaaacaaacaaacatctatataaagagttgatt

SEQ ID NO: 19630 - DNA, 201 bp, Homo sapiens
atacagggtggtccccaggaccagagaggacccatgtctgtgacttcgatgtgccccatcaagatttttaggcagtattcggaacctgcagagttatgtctttttttcccaccctgaacccatgaaatatgggctaaaattggaagctggggcaaagctaggaggcttccaagcttatgatgctagtgggtttaaggcctc

SEQ ID NO: 19631 - DNA, 201 bp, Homo sapiens
gaagctcctatccccagctctcaggggtacctctgccccatcagccccttccccagaaccgaccttgaccccaatggatcagtcgacaatgtcagaggagcccccaagtgaaggaagggaactgatcttgctctttgcaaaacagataaaatattcatataaataatatttcaacttcaaagcaaaacaagactgtagcta

SEQ ID NO: 19632 - DNA, 201 bp, Homo sapiens
gttgaaagtgggtaggtcatcgtctatatccagggctggattgtcctggccctgtgggctacggggagcttctggacatgggggagcctgtttccaggccyaccactccttggctttctgccactggcggcgggcaatgatagagaagaagtcaatgaagaagacctcgatgatctcgatgacgcagacaacagagcagct

SEQ ID NO: 19633 - DNA, 201 bp, Homo sapiens
gcattattggagagaaatttaaagaaaatcctctaaaaaatctcagctgcttcttctaacaatatatgctcattgcaaagaattaaaacaataaactgtgcccccccctccccaaataagcatggctaacagtttggttattatttggtgtgtgtgtatgtgtgtgtgtccacacacacatattagttttatatatataca

SEQ ID NO: 19634 - DNA, 201 bp, Homo sapiens
acacacactgttcaaattctatgtttgttttgaatgacaatacacagttatattctcactgcaaaataaagccagctttttcttctttttgtcttttaaawtatttatttatttatttattttgagacagggtcttgctctgtcacccaggctggaatgtagtggcatgatcatggcttactgcagtctcaacttcctgtg

SEQ ID NO: 19635 - DNA, 201 bp, Homo sapiens
aaaaaaaaaaaaaaaaaaaagaagaaagaatggttcagtattcactaagtcagtgtttgtggcaactttatagaacatagctatccacaacagcaagaatrggccaggcgtggtggctcatgccagtaatcccagaactttgggaggctgagacaggcagatcacctgaggtcaggagtgcgagaccagcttgaccaatat

SEQ ID NO: 19636 - DNA, 201 bp, Homo sapiens
gtgacagagctagactctatctcaaaaaaaaaaaaaaagaaaaaaattgtgcatgtccggttctaaaggtaatctgaccatgatatcactcatctatacasactgaataggctggctggacaatgtccctttcactccttcatcctccttactgtattcatttcaacattgtgaatggcatttcatgggagatgggcatcc

SEQ ID NO: 19637 - DNA, 201 bp, Homo sapiens
gaggacgggactctgaggacgggcgtgctggaggggcaaagaagagaagcaggtgagctggcaggcactagccggctagtgtgtccctggagaccacagtytgggaaacaccagtccatgcgcccttagagacctccttcctctgttcctctgtggcttaggcactttgcattctgaatccttggccccttttccacggga

SEQ ID NO: 19638 - DNA, 201 bp, Homo sapiens
tgggtgacagagtaagactccataaaaaaaaaaaaaaaaaaaaagaggatttggccatacacatacagaagcaagtgagaaggctgggggctgtggtgggmagagacagaggaacagggtagaggtaacttacttgttgagctttttgtttacttgccggccttggtcccaagtgagaacaggcagcaaccacttctacaa

SEQ ID NO: 19639 - DNA, 201 bp, Homo sapiens; identical to SEQ ID NO: 3426

SEQ ID NO: 19640 - DNA, 201 bp, Homo sapiens; identical to SEQ ID NO: 3427

SEQ ID NO: 19641 - DNA, 201 bp, Homo sapiens
ccataggcaacgtcctctccttcttgaagcatcagtgttcagatttataaaatatacctagaatctacttctccccacctctggggccaccaccatgctcyaattgatcattgtctctcacccgaatcattgccataggctcctcactaatcttgctaattctgccctccacagcctcttgtcaataagccagtcaaagag

SEQ ID NO: 19642 - DNA, 201 bp, Homo sapiens
cctatccacaccccccatcctcattcatgtggttcaacttaggttgacccccatctctggctctagcaaatcagcttatcttgtcactcaggttatagtctttttttttttttttgagatggaatctcgctttgtcgtccaggctgcaatgcagtggtgctatctcggctcactgcaatctccgcctcctgggttcaagtg

SEQ ID NO: 19643 - DNA, 201 bp, Homo sapiens
atctccgcctcctgggttcaagtgattctcctgcctcagcctcccaagtagctgggactacatgtgcacaccaccacacccggataatttcttttttttctttttttttttttagtagagacagggtttcaccatgttggccaggctggtctcaaactcctaacttcaggtgatccacccactttggcctcctaaattgct

SEQ ID NO: 19644 - DNA, 201 bp, Homo sapiens
gcatcaactacatattaaataaggtgactttaaacagaaacacacataaagcaaagttacatattgatcagttgatgaaaatgttgtgaccagaggctctyggaaacctaactctgtattttgtctagaagcaatggttgaccttctccccattttaacctgagctgcctaatgcacagtggggctggggaggggctgggg

SEQ ID NO: 19645 - DNA, 201 bp, Homo sapiens
taagtggcacttaacgggagtcatgcttctgttttcagcttgcccccgatgatgcctggcgttgcccacactgtaagcagctgcagcagggaagcattacrttaagcctctggactctgcctgatgtgcttattatacatctaaagagatttcggcaggtatggaaatcctttatcctcaggaacaaacaagttgtgacaa

SEQ ID NO: 19646 - DNA, 201 bp, Homo sapiens
tgagcaaaagcatcctcacagttgatcaataacttttcttgtttttaaaccatcatgtcttcattttacattggaataaagcgagtttttgaaacctgccaaaaaaaaaaaaaaaaaaaaaaagaagaaagaatggttcagtattcactaagtcagtgtttgtggcaactttatagaacatagctatccacaacagcaaga

SEQ ID NO: 19647 - DNA, 201 bp, Homo sapiens
gagcaaaagcatcctcacagttgatcaataacttttcttgtttttaaaccatcatgtcttcattttacattggaataaagcgagtttttgaaacctgccaaaaaaaaaaaaaaaaaaaaaaagaagaaagaatggttcagtattcactaagtcagtgtttgtggcaactttatagaacatagctatccacaacagcaagaa

SEQ ID NO: 19648 - DNA, 201 bp, Homo sapiens
gcctcacagtgtttccagtacttcttggtctatagatatttttccttatcccatttagatggcaagttttcatgaaaatgtgatataattatgcaaaaaamgtttaaagtttaaagtgaaaagagaatctttgaagagattccaggttttctccagaccatgctaatcaggtttcccccctcaatttaattcaagatattt

SEQ ID NO: 19649 - DNA, 201 bp, Homo sapiens
tgactggctcactgcagcctcaaactctggggttcaagtgatcctcttgcctcagcctcctgagtagctgggactacaggcatgtgccaccgcacccagcttttttttttttttttttttttaatagagacagggtctcactatgttgcctagactggtcctgaattcctggcctccagccatcttcctgccttgggttcc

SEQ ID NO: 19650 - DNA, 201 bp, Homo sapiens
tgtagagatggggttttgccatgttgcccaggctggtctcaaattcctgagctcaatcaatctgcccgctctggcctcccaaagtgctgggattacaggcrtaagccaccacatccggcctccatttctttctttatgagttcctgagctgttagaattacacaagctgatgtgtgtgaagtgcttagcagaatccctggc

SEQ ID NO: 19651 - DNA, 201 bp, Homo sapiens
gagttcgagatcagcctggccaacgtggcaaaaccccgtccctactaacaatacaaaaaattagccaggcatagtggcacacacctgtaaacccagctacktgggaggatgaggcagaagaatcgcttgaacccgggaggcagaggttgcagtgagccgagatcataccattgcactccagcctggtcaacagggtgagac

SEQ ID NO: 19652 - DNA, 201 bp, Homo sapiens
tgaggcagaagaatcgcttgaacccgggaggcagaggttgcagtgagccgagatcataccattgcactccagcctggtcaacagggtgagactctgtcttaaaaaaaaaaaaaaaaaaaaaaaaaaaaaaaaaaggacctcatggggacttggtaaagagtgctgaagattacctgggcaaaaacaaaaatttggaagatg

SEQ ID NO: 19653 - DNA, 201 bp, Homo sapiens
agaggctcacacttgctgagtttcccagcctgcttttccatgcactcatgctgggggttctggtgctatgctgcaaacccatggtacacagtttttttctkgttagtgtcaagctctttagtatactgatacttcagtgttttccacaaagcacactgacttcagggtgtcccttggaaaaaatgaaattgtgtaggtcac

SEQ ID NO: 19654 - DNA, 201 bp, Homo sapiens
tcacttgagttttagcaaagctccacacctctgagggagaaagttgatagaatcatgaagttttagacttggaagcagacttggatgtggtgtgagtagtycctagcctttcaggatgtgggaactgagttcacccactagctagaggttgagggagcagaaccagaattctgacttccactgactgtgaactctgtgtac

SEQ ID NO: 19655 - DNA, 201 bp, Homo sapiens
gacagggactggggtaaaagcatatggatggaaatatagaggggcagcaggagggagttcctttatgatgatagaccagttctgtatcttgattgcagtayggttacatgaatctatacatgagtttggattgcacagacacccctccccaccccacacataaatgaatgcatgttaaaactggcgaaataaaatctgtag

SEQ ID NO: 19656 - DNA, 201 bp, Homo sapiens; identical to SEQ ID NO: 3428

SEQ ID NO: 19657 - DNA, 201 bp, Homo sapiens
cacattaagtaaaatcatttgtttagaaaataatatgtggcttccctctccacttccctggttctatagggcattaaaatcttgtggaccaggtggcactrctcatgtgaaattagtagtcgagtgggacaaggagacaagagatttgtgagtatttttaaagttagtgtttatagaaacattgttttaattatcattttt

SEQ ID NO: 19658 - DNA, 201 bp, Homo sapiens
tgtttaggacattttgagttgtttatctcactcaaaaccaaaaaagtcccaactaatatagagaataaaaatcctatcttcccacttggatgtggtgatgycttcttctgtttcttaaagtgagtgtatttcatatctagtcccagatgaatatctacaaatctgggcaacatttttatatgccaaatgacaacagggaga

SEQ ID NO: 19659 - DNA, 201 bp, Homo sapiens
ggaaggcgactgggagctgcaaattagcagcccctgatccaatcccacctccccttgtggttgctgaggggaacccagctggcccaaggccatcatccagmgaggggcaccagcaggcccggaagccatgctcttgacccttcagccagtgtctctcccagaccgcttctttcctgttcctcccttgccaaggcctactta

SEQ ID NO: 19660 - DNA, 201 bp, Homo sapiens
aaatgacaacagggagagccctgagctatttaaagggataacaggtaattagaactctgacagggaaatagactccccttgatcctagctctctctctctytttttttttttagatgttgtctctgtcacccaggctggagtgcagtggcgtgatctcagttcactgcaatctctgcctcttgggttcaagtaattatcgt

SEQ ID NO: 19661 - DNA, 201 bp, Homo sapiens
tgaacactaagctacattgtgtctctatctagtctgggtatttcagataaaaggaatcatatatgtggccttttgcatctggcttctttcacttagcatgrtattttcaagattaatcatgttgtagtatatatcgtactacatttctttttatagctgcaaaatattctattatatgaatatttcacattttgtttattc

SEQ ID NO: 19662 - DNA, 201 bp, Homo sapiens
gaaatatatggatctttggcttaggggtagttcaaggccttatctcatttttcctctagtccttgcctttcccaccttattctgcctcctgggatgtatargtcactttacttccacttcggagaggagcaccactcagcgaagaacattgattggctcttgtgctgtgggcagggtcattgtgctgagttcgtatgtctg

SEQ ID NO: 19663 - DNA, 201 bp, Homo sapiens
catcctggatggaagccccctttccctgtgcctcatttctttctcctctcccaccagggtcccctgcttatctttctgaggagggagagtggtttgaaggrtgtggtggagggcattccagccctaggggaagtacatatgaaagcctagaggccttagggtccctttcaagggccttttgccccagccagcaaatattag

SEQ ID NO: 19664 - DNA, 201 bp, Homo sapiens
gctgtacttctgacagtttgtgtggcccaactctatgccatgagattgtcattacccctgttacacctaagagctcttcttggcagttgtcctctactttctttacaaaataaactcaaaaaaccaggttccctgccttcctgtctctggcttatctgcatgcaggactatctttacctccttctcttccatctctcctac

SEQ ID NO: 19665 - DNA, 201 bp, Homo sapiens
ccttcagccagtgtctctcccagaccgcttctttcctgttcctcccttgccaaggcctacttaggaggtgggtctgtctcagctgtacattgagttccacrgaaacctcggtgtatcaattaagctctggttacagacgaactgcagaggactggaaccagccggcatcatttgttcttgaggtctctggatgaaccccag

SEQ ID NO: 19666 - DNA, 201 bp, Homo sapiens
ccttggaatcagtagctcctagctatggcagttgcttatgaaaggggtctgggaatgaagttgttctactctgtcctcacctttgtcctgggaaaagaagscccctcagctgagtaggccggatctgaagctaaagagggctggagaaaacttcaggggcagacacacttagcctctagggaaaagcttctatctgaaagg

SEQ ID NO: 19667 - DNA, 201 bp, Homo sapiens
ggtacgttgtctttgttctcattggtttcaaagaacatctttatttctgctttcattttgttatttacccagtagtcattcaggagcaggttcttcagttwccatgtagttgtacagttttgagtgagtttcttaatcctgagttctaatttgattgcactgtggtctgagagacaagtttgttgtggtttctgttctttt

SEQ ID NO: 19668 - DNA, 201 bp, Homo sapiens
actagtgagggtggtggctccatttgagaagaccaggggtacattaagaacaggcattcttgtgacttacaaatggagtcggtgtcccttggaatcagtarctcctagctatggcagttgcttatgaaaggggtctgggaatgaagttgttctactctgtcctcacctttgtcctgggaaaagaaggcccctcagctgagt

SEQ ID NO: 19669 - DNA, 201 bp, Homo sapiens
acagggtttccctgtgttgtggctggtcttgaacccctaggctcaagcaatcctcctgccttggcctcccaaagtgctgggattcaggcatgagccaccayactggctgaactttgtttttgcacattggaaaatggactagctttcttattctgtttgtcaatgatatttgatgctccaacttgcaagggaagaccatat

SEQ ID NO: 19670 - DNA, 201 bp, Homo sapiens
ctaccttccctagaaatgtaatcatagtggaatagtagtgctggaaattgcagtggtattattttgagggtagtagcagcagcagcaatggtggtagactsgtagcaatgctagtaacggtaataatagcagtaataacaatagcaactagcacttattgtgtgcttggtatgtgttatggctgaattgttttctgcctca

SEQ ID NO: 19671 - DNA, 201 bp, Homo sapiens
cagaagaggaagagacatcacaggcctctctctgttgacacaccacagaggaaaggccatctgaggacatggagagaagacagccagccttctgcaacccwaagagagaagcctcaccagaaccgagtctgcctgtgccttgatcttagactttctagtctccaaaactgtgataaataaatgtctactgtccaaggcacc

SEQ ID NO: 19672 - DNA, 201 bp, Homo sapiens
atttttgagacagagtcttgctctgttgcccaggctggagtgcagtggtgcgatcttggctcactacctctgcctcctgggttcaagcagttctcctgtcyagcatcccaagtagctgggattacaggtgcatgccaccacacctggttaatttttgtatttttagtatagacagagtttcaccatgttggccaggctggt

SEQ ID NO: 19673 - DNA, 201 bp, Homo sapiens
ggctggagtgcagtggtgcgatcttggctcactacctctgcctcctgggttcaagcagttctcctgtctagcatcccaagtagctgggattacaggtgcaygccaccacacctggttaatttttgtatttttagtatagacagagtttcaccatgttggccaggctggtctcgaactcctgacctcaagcgatccacctac

SEQ ID NO: 19674 - DNA, 201 bp, Homo sapiens
ttttgtatttttagtatagacagagtttcaccatgttggccaggctggtctcgaactcctgacctcaagcgatccacctaccttggcctcccaaagtgctrggaatacaggcatgagccactgtgccccgccaagttaaggatctttagatgtggaaaatatcttgaattatctgggtgtaccctaaatgtaatcacaagt

SEQ ID NO: 19675 - DNA, 201 bp, Homo sapiens
caccatgttggccaggctggtctcgaactcctgacctcaagcgatccacctaccttggcctcccaaagtgctaggaatacaggcatgagccactgtgcccsgccaagttaaggatctttagatgtggaaaatatcttgaattatctgggtgtaccctaaatgtaatcacaagtgtttttattaaaaggaggcggaaggaga

SEQ ID NO: 19676 - DNA, 201 bp, Homo sapiens
ggcagagggtcccctgtgcacacgtctgggggcacccgatccatgtccttagaccatggctggtggtcctgactagatctgtcttctcaaccctgcctcasagctcatccagcatctgggtatctgtgagctggttggaaaaggccctctccaagcgcaaggtattgtatttggggggcggtgtgccgggcacttgggttc

SEQ ID NO: 19677 - DNA, 201 bp, Homo sapiens
gtttaaagcaggctttttggtcagagtatctgaaaagcccagagtggggcagagggtcccctgtgcacacgtctgggggcacccgatccatgtccttagamcatggctggtggtcctgactagatctgtcttctcaaccctgcctcagagctcatccagcatctgggtatctgtgagctggttggaaaaggccctctccaa

SEQ ID NO: 19678 - DNA, 201 bp, Homo sapiens
cctcctgcgcatgcccaggccccatcttgcggtttaaagcaggctttttggtcagagtatctgaaaagcccagagtggggcagagggtcccctgtgcacaygtctgggggcacccgatccatgtccttagaccatggctggtggtcctgactagatctgtcttctcaaccctgcctcagagctcatccagcatctgggtat

SEQ ID NO: 19679 - DNA, 201 bp, Homo sapiens
ttatccccagaggagactctatatccattaagcaatcactctccatttctcctccctgcaatctgctttctgtctgtgaatttatccattctgagtatttygtataaatggaatgggaccatatatgaccttttgagtctgctggctttgttcacttagcgtgatgttttcagggttcattcatatgtcagtagttcattc

SEQ ID NO: 19680 - DNA, 201 bp, Homo sapiens
tctagtgacgtgctaatagttcaggtcccgggatttatctcagcctggacagttgtgagtgttgctgcgtagtacccgatggctcctcctgcgcatgcccmggccccatcttgcggtttaaagcaggctttttggtcagagtatctgaaaagcccagagtggggcagagggtcccctgtgcacacgtctgggggcacccga

SEQ ID NO: 19681 - DNA, 201 bp, Homo sapiens
tcaagacccgtaaagagctgcatcagtcctcactctggccttcacttgggccagcaccactgcctcggctcccagtctctagtgacgtgctaatagttcargtcccgggatttatctcagcctggacagttgtgagtgttgctgcgtagtacccgatggctcctcctgcgcatgcccaggccccatcttgcggtttaaagc

SEQ ID NO: 19682 - DNA, 201 bp, Homo sapiens
acagagccagaaagatatttgcaccttgaggacatttctttgaatgctaggttgcttttaggatgtgttgtgaacatccatgcaacacctgtgttaacacscactcatcattttctttcttttctaagatttttttctaggacaaggttttgctttgtcacccaagctggagtgcagtggcatgagcatactcactgtagc

SEQ ID NO: 19683 - DNA, 201 bp, Homo sapiens
cggctttggggctttggaagagtccttccctctcaagacccgtaaagagctgcatcagtcctcactctggccttcacttgggccagcaccactgcctcggytcccagtctctagtgacgtgctaatagttcaggtcccgggatttatctcagcctggacagttgtgagtgttgctgcgtagtacccgatggctcctcctgc

SEQ ID NO: 19684 - DNA, 201 bp, Homo sapiens
acattcccagggcagccaccctggggaatgccaggccgatcatttcttggggatgcctctatggaggaggggacagagccagaaagatatttgcaccttgrggacatttctttgaatgctaggttgcttttaggatgtgttgtgaacatccatgcaacacctgtgttaacacccactcatcattttctttcttttctaaga

SEQ ID NO: 19685 - DNA, 201 bp, Homo sapiens
atccatctcctgggcccacccatgccccaaagtgaggacactctgacatagtcccagacctccaccacggcactctgatctccaccaacactccaagggcyctgggccagttctctgctgcctgagggcatggaggacacctttctccagtgtcaatgatgaagaacagtttattcacaaacggctccagcttcagggctg

SEQ ID NO: 19686 - DNA, 201 bp, Homo sapiens
gctgggaagattcccctgggaatgttcctggaggagggcgaaggagcgttttaacaatcagttctgtttcacctcctcctgctgctccttccagcttgcasctgggcacaatggggcaccttcagtctgcagcccgcaattagagcacatgtctcgggaatcctgctgatccagaccccttctccaccctgggcctgtcct

SEQ ID NO: 19687 - DNA, 201 bp, Homo sapiens
ttcaagattctgtcccagctgcttcctcttctcaccatatgttccctgggttctgtctcatgtgataggtgtgtgctgctctgattcaaatttccagctcrgatctctttcctgagcaccagatttaacctcacttgggatcatgttgatacctcaaatgcaacttgttcaaaactgtggtcccctaatctcttcctctat

SEQ ID NO: 19688 - DNA, 201 bp, Homo sapiens
ctcaatttattcatccacaaaattgaataactaaatccatctcctgggcccacccatgccccaaagtgaggacactctgacatagtcccagacctccaccwcggcactctgatctccaccaacactccaagggccctgggccagttctctgctgcctgagggcatggaggacacctttctccagtgtcaatgatgaagaac

SEQ ID NO: 19689 - DNA, 201 bp, Homo sapiens
tggatggaaatgtgaatggaaggaaaatggatgaacaagttaatgtcagatgattcagaggctggaggtattcagggggcagaagtgtgttctgaggctgrcagggatctggggactgactggctgcagaagattggcaggcaaccacagatagccagcctccctgtcttgccaaaactccctttgcttttcttctttttc

SEQ ID NO: 19690 - DNA, 201 bp, Homo sapiens
tcaccttctcagaaagattgcctgtcttgccacagcttagaggtttgcaaattctgttctgtctgcaccctgttttagggcccatcacagcggggtgggcrgtaagcaggctggtttcccaggctcagctacattcatcctgcatttctgtttccattgtgtacatttctgggtaagactttgtttgagtgagagattctc

SEQ ID NO: 19691 - DNA, 201 bp, Homo sapiens
ggaggctgaggtgggaaaattgtttgagcccaggagttctaggctgcagtgagctatgattgcaccactcccacctgagtgacagagtgaaatcttgtttytaaaacaaacaaacaaacatctatataaagagttgattttggtatcaagaagagccttgcagatatcccatgaaaggacccaagaagactttgaaatctc

SEQ ID NO: 19692 - DNA, 201 bp, Homo sapiens
agggtctcgatctgtcacccaggctggagtgcaatggtgcaatcatggctcatggcagccttgacctcctgggctcaggtaatcttcccacctcagcctcycaaagtgctaggattataggtatggggcgctgcacccagcaagctcattctttaaggtataaacagtgctaagggggaaagcccagatggcagcagagcc

SEQ ID NO: 19693 - DNA, 201 bp, Homo sapiens
gggttcaaatcctagctctgccacctcctcactgtgtcaccttgggccggtaacttaatctttctgtgcctcaatttattcatccacaaaattgaataacyaaatccatctcctgggcccacccatgccccaaagtgaggacactctgacatagtcccagacctccaccacggcactctgatctccaccaacactccaagg

SEQ ID NO: 19694 - DNA, 201 bp, Homo sapiens
gtgaccagtttattacaactgtgtgtttgtgtgctgtgtgcatccacgtgcccatgtataattgtttttatttttttggttggggagatgggggtaaagasaaaaagaatggcagatttgtgggagggaagaaaattattttctctttgaagaaagaatgaaaacgggtagagggggaaggaattaagaggtttgaggcag

SEQ ID NO: 19695 - DNA, 201 bp, Homo sapiens
gtaatgggattgctgggtcaaatggtaattctagttctagatccttgaggaattgcaacactgtcttccacaatggttgaactaatttacactcccaccarcagtgtaaaagcattcctatttctccacatcctctccagcatctgttgtttcctgactttttaatgattgccattctaattggtgtgcgatggtatctca

SEQ ID NO: 19696 - DNA, 201 bp, Homo sapiens
cactgcaacctccacctcccaggttcaagcgattctcctgcctcagcctctcgagtagctgggactacagacatgcaccaccgtgcccggctaattttgtrtttttagtagagacgggatttctccatgttggtcaggctggtcttgaactcccgacctcaggtgatccgcccacctcaacctcccaaagtgctgggatcg

SEQ ID NO: 19697 - DNA, 201 bp, Homo sapiens
tatttttagtagagacgggatttctccatgttggtcaggctggtcttgaactcccgacctcaggtgatccgcccacctcaacctcccaaagtgctgggatygcaggtgtgagccaccacacccgcctattcatttttttaaaattaggaaatcttctcttctgtaggtcacattcttccattatacatactaatgcctttg

SEQ ID NO: 19698 - DNA, 201 bp, Homo sapiens
cccacagatctgtatttttcagttgtttaccagataacttccattcagagcttctgtagaacttcagctacaatggattcgaaaggggggactcattccgsgaactctttcctggacttcctccttttttattttctgtcttgatgcagggtactaccagttgctcatcatctaggtaggacacctgagtgacattaatgc

SEQ ID NO: 19699 - DNA, 201 bp, Homo sapiens; identical to SEQ ID NO: 3433

SEQ ID NO: 19700 - DNA, 201 bp, Homo sapiens
cagcaggcccggaagccatgctcttgacccttcagccagtgtctctcccagaccgcttctttcctgttcctcccttgccaaggcctacttaggaggtgggyctgtctcagctgtacattgagttccacggaaacctcggtgtatcaattaagctctggttacagacgaactgcagaggactggaaccagccggcatcattt

SEQ ID NO: 19701 - DNA, 201 bp, Homo sapiens
tcccgggttcacgccattctcctgcctcagcctcccaagtcactaggactacaggcgcccaccaccacgcctggctaattttttgtatttttagtagagamggggtttcaccatgttaactaggatggtctcgatctcctgacctcgtgatccaccctccttggactcccaaagtgctgggattacaggtgtgagccactg

SEQ ID NO: 19702 - DNA, 201 bp, Homo sapiens
gaaaatatgaaaagtgagaaggaaaaaaagcacctgttattctatcacccagagataatacttaatatgtaggtatgtgtttagaactttttctttgtatrtatatgtctacacccccctaaatgatttttacaagaatacattcacatttcacactacttatttataaccttttttcacttatatagtatttcttaagga

SEQ ID NO: 19703 - DNA, 201 bp, Homo sapiens
tgagtagctgggactacaggcacacaccaccacactcagctaatttttgtatatttttttgtagagacagggtttccctgtgttgtggctggtcttgaacycctaggctcaagcaatcctcctgccttggcctcccaaagtgctgggattcaggcatgagccaccacactggctgaactttgtttttgcacattggaaaat

SEQ ID NO: 19704 - DNA, 201 bp, Homo sapiens
ttgaccaaaaatacttttgacctgtttggacttgacatgtttttgcatatagcttttactcaatttactattattattttatttggaaaaacattccttayttaagatttattaaggaaagatgactccgtagctaaattgctttccctagatagtagcttctggaagctactgtgtaatccctggaataataaaggtgtt

SEQ ID NO: 19705 - DNA, 201 bp, Homo sapiens
tttttgctttttggggatttatttttgagatggggtcttgctctgttgcccaggctggagtgcagtggttcaatcacagctcactgtgaccttgacctccytggctcaagccatcctcccacctcagcctcctgagtagctgggactacaggcacacaccaccacactcagctaatttttgtatatttttttgtagagaca

SEQ ID NO: 19706 - DNA, 201 bp, Homo sapiens
ggacctcataggtctagtccaactcccttatttgaaagaggctcagaaaaggcatgtgacttgttcaggtttgcagggctggttgatgacaggccggaccrgaacctgcatgcccaatccagtgctttttcactagacagcgtggctgagcatataatgaagtctttaaatgtctccagtgttctcctctccatcttttgt

SEQ ID NO: 19707 - DNA, 201 bp, Homo sapiens
ctggtctcgaactcctgacctcaggtgattcgcccgccttggcctcccaaagcgctgggattacaagcatgagtcactgtgtctgaccccagctgggtgtrtttcttccagttggaccacaggggctagtggtcaaggagaagagtcctggacccagcccatcccatgcccctaagcagtgaaagaatgagaaggtgaaat

SEQ ID NO: 19708 - DNA, 201 bp, Homo sapiens
ggtcaatcaattgacttttttttctattgattacattaagcattggttacattaagcagaagaccactgagaaaacaaaggcagtgaagaattgatgctgmtaagttcaaattagatagcaagagagctagagagctacaggctctgaggcagctctctctttgttagaaaagagagacgaacagtgttagaaagtattga

SEQ ID NO: 19709 - DNA, 201 bp, Homo sapiens
atgcataatttatagtgaaacttgctggatctgcttatgaataatctcccttagttactactaagtgatattgcagttataaaaatgcaatagcagaatartgagtcaatgcaaggttatttccagaatattttggatctccttataaaatcggctgttcagttaaaaacattttaggtctcttataataaaatgtcagtg

SEQ ID NO: 19710 - DNA, 201 bp, Homo sapiens
ggctcacccctttcctgcattctttatgcctgacagtttctcaagtcgtgcctgtccttttaaatcaagcgatctgttcttccctttgatgtcgtcctccyggccaccagcctacatcctcattacctgataacttagatgatttaaagcctcactggttggcttcttgccgtcattttctccccagcttcagtctgttaa

SEQ ID NO: 19711 - DNA, 201 bp, Homo sapiens
ggccaccagcctacatcctcattacctgataacttagatgatttaaagcctcactggttggcttcttgccgtcattttctccccagcttcagtctgttaayggccatgaaaatctcactaaagcccttctacagcaaggcacatgcctaaatgggaacccaaaacatctccctctttcccattgccccctctgccctgttc

SEQ ID NO: 19712 - DNA, 201 bp, Homo sapiens
cctacatcctcattacctgataacttagatgatttaaagcctcactggttggcttcttgccgtcattttctccccagcttcagtctgttaacggccatgaraatctcactaaagcccttctacagcaaggcacatgcctaaatgggaacccaaaacatctccctctttcccattgccccctctgccctgttctctgtggct

SEQ ID NO: 19713 - DNA, 201 bp, Homo sapiens
gggaggcacctgcctgatgagctcctcacgtgtggcccgcctgctcctcgcatctttctgtgcttcctgtctgcaggtcctgggcactcccatttgccccyaccatgtgtcctgccctctcacatggcccctgtggccaccctccctgcctgcagcttctgggctctgaccgcggccctgccctttccccttggcaggagg

SEQ ID NO: 19714 - DNA, 201 bp, Homo sapiens
gtgtgaaacacagtgcaaagccgagaactcactcattcttatactagctgtgctcaatcttgttcccagtggttctcaggagatgccacaagtggggaagwtgactgacatttaggcaggtcatttaaatactgtaaaaactctgtagcagctgtgaaaactcagcaaaagctctcattggaagcaaggggacagattagg

SEQ ID NO: 19715 - DNA, 201 bp, Homo sapiens
gcttcagtctgttaacggccatgaaaatctcactaaagcccttctacagcaaggcacatgcctaaatgggaacccaaaacatctccctctttcccattgcmccctctgccctgttctctgtggcttttgaagccttcctcagcactgatgccacctgaactccagcagtgctcatgcctgcccccgactctggccaccgat

SEQ ID NO: 19716 - DNA, 201 bp, Homo sapiens
tttggtgcatgaatatttgatggtgttgtctggggtctcccaggtgctctgctgccctggcaagttagggagcctctgatggagtggaccatggctctgckcactgagtgatcttggaaaaatctctgcatctcttgaggcctcagtttgtcatctgtaaagtgagagcattgtactagatgatctctgaggcctttccct

SEQ ID NO: 19717 - DNA, 201 bp, Homo sapiens
tgtgacaaatgatgtcatttgtcatagacatgctagcccccggcagaataatgaatggtttcaaaggcaggatgcaggttgaaaacatcagtttctgtctsttctagtgcttttttttttttttttttaatttcaggactagccacatgtaagttactaggtttacaaaagccagccaaggctaaagggtgttgccctgct

SEQ ID NO: 19718 - DNA, 201 bp, Homo sapiens
cttcctggtggagcatggccagacattgagcatctggggtgccccctaagtgaggtgggttggtaagttagtcagcctctgaactctgtgcccatagctgwaagagtaacatcgacaggagaacatgagaaatgtcattggaaaggaactctttaccagtctttggtcagtaggtagtgtggagggaggaaggaaatctac

SEQ ID NO: 19719 - DNA, 201 bp, Homo sapiens; identical to SEQ ID NO: 3463

SEQ ID NO: 19720 - DNA, 201 bp, Homo sapiens
tgcgttggcctcccaaagtgctgggattacagatgtgagccaccgtgcccagcctccataacactttattagtatctttattgttgctcatgtcatatggrtaattatgaacagactcctgcctcctcctgtgtttctggggacaataagaagtctttctttgtatggcccgtaggctgctttgtccacacaatgtcttgc

SEQ ID NO: 19721 - DNA, 201 bp, Homo sapiens
gctgcagcctctaaccaatctgattaccttcctccactggggctttaaatcaagggtggtggctgagaaattaaattgctctccctggcggcttcctttgrcaagggcctggctgtctggaaggggccaatatgtgtatgtgggagtgaggagtaagggcatgggcgtggtggggagtgggccagctcagccatgcccact

SEQ ID NO: 19722 - DNA, 201 bp, Homo sapiens
agatgtgagccaccgtgcccagcctccataacactttattagtatctttattgttgctcatgtcatatggataattatgaacagactcctgcctcctcctrtgtttctggggacaataagaagtctttctttgtatggcccgtaggctgctttgtccacacaatgtcttgcacatggttgtgctcatacatggttgttgaa

SEQ ID NO: 19723 - DNA, 201 bp, Homo sapiens
atgtcttgttatccagttttgtggcccctggacaccaacacagtattcattggatggtgaagaacggtgggaaaagcctggtccatttggtgtgcacaaarcatcttcctgacctcttactgtaaaagccatgacagtttgctccctatgttgtacaagagaaaggataaaagccttttgcctccagtgttacagagagag

SEQ ID NO: 19724 - DNA, 201 bp, Homo sapiens
gcccatgcccctccttctggcatttctctctcagtccagctagtggctctaattccaagcctttgttctgagggtgcagtgggtgagggccagggtgggcrtgcacgagtgcatgtgtcctggcaggtgggagctcatgtagtagcctgttggccacacatggtcatttccttccaccatatgtgtctttcaggtcctgag

SEQ ID NO: 19725 - DNA, 201 bp, Homo sapiens
tacaaagcactggtctaaatactggggatacatcagggaacaaaacaatccaaatccctgccctcatggaacttacattgtttacagtgtaaaaataaaayagataaatcatatacatagtgcattagatggtgatacagtacaaggggacggggtcggttttggtaggagggcctgatggtgtacttttatatggggtag

SEQ ID NO: 19726 - DNA, 201 bp, Homo sapiens
ctaggaaatgggatgctttcagggcctttttcctaacccggtgtatagagtgtcccagtaggatgaatgacagcctcagggctctgtctgtaccttgttcrccctgagcagcttcagcctcttccaggaggcacaacagaattctcagagccatccctcaagtctctctgagtacaagtggaagcctcatctttaggctaa

SEQ ID NO: 19727 - DNA, 201 bp, Homo sapiens
catgattatttgaaggcttttggcttgagcagctggtaggatggcattgtaattaactaagctgtggagaatggtgagaagagcaggtctgtgttttattrgggaggggggaaggatcaggaactcaggtttaaacgtgaagttggaggtggctactagacatccatagaggatcttttgtaggcaggtagaaaaatgact

SEQ ID NO: 19728 - DNA, 201 bp, Homo sapiens
tattcactgtatcattcttcttattttgatctctaaaaatcatgtgtctctctttgaagtataaaggacaaagagatagaagcatataggaaagaacccaycccatctttaggaagaacagagcccactggcataacaggacagagtggcaagaaaggttgggctgtggaaccagacgggctcttgtttgaatcccagccc

SEQ ID NO: 19729 - DNA, 201 bp, Homo sapiens
tgaggagtgggaagacttaaataagtaaagaggaagagggcttcctagtgtggttgtgcaggttgtacataaacaactctaaacagcaccataaatgtcayaatccatgtgtatggccccaagatggaaagacactccaggagggaaaaaaagcatggaaaaaaacaaggagatagagttacataatacatggaaagttta

SEQ ID NO: 19730 - DNA, 201 bp, Homo sapiens
cttaggacggggcctgatgtagtgtgaacagtcaatacatgttgattcccctcctcatccttccattctcttatcacatcatgaaatccaaatataggagsaagtacatattgatgcacaatgtatacagatagatgtgtgcaggctggcccaagacctagttgttttatacagacacaccccccttgcctatgcccgtgt

SEQ ID NO: 19731 - DNA, 201 bp, Homo sapiens
aggagtgggaagacttaaataagtaaagaggaagagggcttcctagtgtggttgtgcaggttgtacataaacaactctaaacagcaccataaatgtcacamtccatgtgtatggccccaagatggaaagacactccaggagggaaaaaaagcatggaaaaaaacaaggagatagagttacataatacatggaaagtttatt

SEQ ID NO: 19732 - DNA, 201 bp, Homo sapiens
gatgatgtgcagtagagctgtcatctgtcttgttctttctttgtgccctttgaaacatggcggtggtggctttggcgctggtggcaggggaagccttaacrgccccggagctgaagcctctctgttggtcctcagaccaggtacagtgcaggggcccccaggaaccccctcgttctggggtccacacttatgtgatgtatt

SEQ ID NO: 19733 - DNA, 201 bp, Homo sapiens
acactccaggagggaaaaaaagcatggaaaaaaacaaggagatagagttacataatacatggaaagtttatttggctgatgctagtcaaatatccatctasttatttaggaaatatttatcgtctggcatcattgagatcacactgaacagagtggaagattcatttaggaaagcagtgacaaaaatgtgtgggctgttgc

SEQ ID NO: 19734 - DNA, 201 bp, Homo sapiens
atgttttctacaagcatatatgttgtttatgcagtggctgaagagaagactgttctccacagctgcatacatcaagttaagggaacgtttataatgtaaasctggaaaattccattagggaactttattgacttttgaggaggaagggaaggggattttttcatttgtttatttttcttcttggatttattttaagtgtgg

SEQ ID NO: 19735 - DNA, 201 bp, Homo sapiens
aatatttatttaccacttacaatgttacaggtactgcaggggttaccagtaactgattcaagaaggagagctgttcacagagcaagatgtttcacagaagrgaaagctattgaactaggtcttataggaagagttatcaattgacagaatatgaaaatggggcatcttgggaagaggaaatggtacctgtatctggaaaat

SEQ ID NO: 19736 - DNA, 201 bp, Homo sapiens
ttacaggtactgcaggggttaccagtaactgattcaagaaggagagctgttcacagagcaagatgtttcacagaagagaaagctattgaactaggtcttayaggaagagttatcaattgacagaatatgaaaatggggcatcttgggaagaggaaatggtacctgtatctggaaaatgtaatgcattatcaaaggaccgtg

SEQ ID NO: 19737 - DNA, 201 bp, Homo sapiens
tttagtgtcatgtcttttccacccacctctgctttctctttctaaccgtctcccaccccatgttattggcatttagttcatattcattttagtattaaagkgaagtaattatttctgtattgtgaaattggcatttgagatcattggaaatattctttaatgctgtaagctagagttttaaaaaataggattagttaagtc

SEQ ID NO: 19738 - DNA, 201 bp, Homo sapiens
cttaatagaggtacttgctcagatgctctctctctgttgcttgattcactctttcccttagtcatggccctgtccaaacccagtgaatcttatccttcttrtccacagggaatttgccaaagagagagagagagtggagaaccgaagggctttcatgaagctgcggcgccagcagcagattgagcgtgagctgaatggcta

SEQ ID NO: 19739 - DNA, 201 bp, Homo sapiens
tggcaagattgtcaagcaagggggtagatgcaaaagacccaggcccagaatttgcccttggcattggccccattttctcctccagcccaggtttctgatgygcctgtcatttgctttttgtagatcctgacgggtgaggactggaatgaggtgatgtacaatgggatccgctcccagggtggggtcagctcaggcatgtgg

SEQ ID NO: 19740 - DNA, 201 bp, Homo sapiens
cagccagagggtgaggagggagggggagtggaggaggctttccagtgagtcatccctcctgcatgttaggagttttggttaaaagatttacagagagagakagtgagagagagagagtgagagagagagagcgtgagagaaagaaagagagcaagaaagcgagagagagagcacgagagcacacaagtgagcgtgagcgag

SEQ ID NO: 19741 - DNA, 201 bp, Homo sapiens
ccgcctcataaagctcctgcgtcagggctataccatacgcattttgctgtggacctttgtgcagtcctttaaggtaagaggtaccagcaaatcctctctgrgggttgtcatatcagacagtacagccaggcaacactggcatcattacccaagtcccttcacctctgggaagctgaagctagtagaacgggtgtttgttag

SEQ ID NO: 19742 - DNA, 201 bp, Homo sapiens
tatagattaatatctacatatattttgtgcattcatgacatacctaactttgatatttctaggttacacagttctgtaagttttttcaaattgttgcaaaygtccaaattttttttccaatatatttattgaaaataatctgcatataagtggacccatgcagttcaaacatgtgttgttcaaggatcagttgtatgtact

SEQ ID NO: 19743 - DNA, 201 bp, Homo sapiens
ctgggtgactgctgttttgtccacatttagctgggtgagccccagagctgaaggagtttattttcggtgtaggaagaaaagctttttggatttgcctgtcrgttccttttatttttttcaaagactccaaagttgatatggctttttccccctgccttgcttcagaggcccaaagatgtagacaatgagtctctgcatgac

SEQ ID NO: 19744 - DNA, 201 bp, Homo sapiens
gatgtagacaatgagtctctgcatgacatttaattcgcctacggtgctgttttgaatgttacagatgaaccaactatgaattggctgtatgtctgtatttrtatgaatatgtgagacaaggggactagatgaactagagagaagcattcttgggaagaataagaagacaccagcgaagagatggtggtgggcatggcagat

SEQ ID NO: 19745 - DNA, 201 bp, Homo sapiens
atcgtgccactgcactccagcctgggtgacagagcaagactccatctcaaaaagaaagaaaaaagaaaccatctggttgagtcctttgtccttcagtagaygaagtgtcctcatccatattttatagacaatacaattgaaatccagagatgtttcattatttgaagaagaagttggaatctgattctgctagcctgtgaa

SEQ ID NO: 19746 - DNA, 201 bp, Homo sapiens
aaatatttgctgagtaaacaccaaatatatacctacagctgctgaaaattcatttatgttacactttaagttgttctccagagcatctggttaatctggcyctaaagtactacaaaaattatcagtttttaaattcatagatacatgataacaagtaaaataaatggatttcagtttattagatgagggttcattcatata

SEQ ID NO: 19747 - DNA, 201 bp, Homo sapiens
catagataagcagaatgagatatagtgaataaatttaataactgccaactagttagcatttatggagctccttaatggcttaaagcatgactgtatcacaygagttttttttactacaaccctatgaaattagtgttatcagccatctttcaatttcaatgaggaaaccaagatgccgagagactgagtgacctattgtgc

SEQ ID NO: 19748 - DNA, 201 bp, Homo sapiens
gtttatttcctgagccactgaacacagggtatactaatggccacctctgtgtcctacaaataaatagggacatctgggcaggttaatatgatgtgtttccyctgcacagtctcgtggagctgtacagaggtgtacatatgataaatataagtaaaaaattgacagctgagacccagactttgagtaaaagtttcttaaaca

SEQ ID NO: 19749 - DNA, 201 bp, Homo sapiens
ggtgctgtcagcattatcagagcgtttcctagcaatgcccatcagcaaagaggctgtgttttctgaaccttctccaaagaggctgccctctcccctcttcratatgcacccccatccctgagagaagtgatttcctcttgttatttggaaatcagggagagagtttcccaatctttgtctggggctctacagggaccacag

SEQ ID NO: 19750 - DNA, 201 bp, Homo sapiens
  misc_feature (1)...(201): n = A,T,C or G, or insertion/deletion polymorphism (see Tables 1-2)
aagtgcagtaaagtacagtaaaatgaggtatgcctgtagaactaatctcgtgtcttagatgtgtgaaaaaaagaaaagaacactaaagccaggttagaganttctgctttctgctgtgcctttcatggacttttgaaccttgggaagttactcagcctctctcagggcctttcaccatttacaaggtgaggccatggactc

SEQ ID NO: 19751 - DNA, 201 bp, Homo sapiens
ctttcccttataatgatgatgctgcctccagtttttagaactttctggaaacttctgagaagtgactgtctaaagggggatgatgggagaaggggagttgyccatgggttcccatcgtgcttgctggagcaatgggtgttggcagatttcttcagaaggagtttgtcagcagtggggtggggctgggaagaaagccacagt

SEQ ID NO: 19752 - DNA, 201 bp, Homo sapiens
acagtcatctttgggcagtttgtactgagagggaggggaggccgagtgtaaaggatcggtgccttaattttagcaaggctctgagccccttggaaggcaarctttatttctacatagattgaaagtattattattattacatccttacgctgtatcagcgccaaacactggagtcctcaatactgtatttatttctctggg

SEQ ID NO: 19753 - DNA, 201 bp, Homo sapiens
cttgggattaaagatgtgagccactgcgcccagcctgaatttagttgttattcagtaatccatataatttgggaatgattgttcaaatggcacagactctsacaggggttcaatctaccattgtgtcagtgtagcagatgagatttttgtcaaggggcttgctgaaatccagggtaccatatctttagcattttcctagtc

SEQ ID NO: 19754 - DNA, 201 bp, Homo sapiens
catttgctgagtcccagcctgtgccaggcactgagctaagcttgtcccatgcactgtttgatcatcctgctttctcgttgctcacacactgtgtactgacstacggctgaattctcctgggattgacaatgagcttactggttatcactgtagagtcttctgtttggaatcaagacatttgctcaggttttaaggcctctg

SEQ ID NO: 19755 - DNA, 201 bp, Homo sapiens
gggaaaaccaaggtatgaaggaataggttaggacttaatggtgcataaactcagagccagcagtcattcttccatccctggtcttggcatttggaagatgwgatccactatgttgtaagctctaaggggcaggaaatacaagatgatgtatttatgtaaatataatgtactatgttgtaatcatatgtgcatgcaggaatg

SEQ ID NO: 19756 - DNA, 201 bp, Homo sapiens
ttgcatcatggcagcaacacccctggtccctctggggtggatggggtgcagcacaccttggtgaggggtttacactaaatactgctgaccccaggacagcratttctcatacatttttattccaaagtattcctgaaaggtacttttgcttcctcatgtttccacaacaaccccctctagagcaaggatataaataagaaa

SEQ ID NO: 19757 - DNA, 201 bp, Homo sapiens
catttataagaacactcaggtctccttccttaagcccaccgtccctgcagggaggtgggcagagttttggcaaaggttgggttcagggcttcgttattccrctgccctgacaacacccgctttctgggccacatggagacagagtgtttgctgactataaatgtccagagctgtgccttctgtactttgaggtctcaagaa

SEQ ID NO: 19758 - DNA, 201 bp, Homo sapiens
tgggatcaacattcccaccaccttcctccctgtcacctgggtgctggcttctggaaggctcagccctgcaggtccatagcaggactttcctggctgtgccrtacaaagtacctgacgatgagattgcttggaagggcatggggaggagccagtgacagatgtggtgggatccatagaaagggctgctgtggagcctctgcg

SEQ ID NO: 19759 - DNA, 201 bp, Homo sapiens
ggcttcgttattccgctgccctgacaacacccgctttctgggccacatggagacagagtgtttgctgactataaatgtccagagctgtgccttctgtactytgaggtctcaagaaaagtctggtgagtggctggatctatgaaaccttcctcttttatctttttctttccaatgaagagggattcttttgtgtgatttcat

SEQ ID NO: 19760 - DNA, 201 bp, Homo sapiens
acagccttggcatttctggggatctgcacatgaggcacattcccctgctttgggggaccctgctccccaaccaaagtcagctgccttgtagggaggtcacrtaaccactacacagattacattcatgaacctcacagaaccctcatgtttcatgtgtttcatgtctagtgaagtgacttgggcaaacaggtgggcagggac

SEQ ID NO: 19761 - DNA, 201 bp, Homo sapiens
gcctctttctagttaatcttttctcttcatcctcagcctctagtaactgctgattttttgttcttatagttttgccttttctagaatgtcataaatgggawgaggagtctacagcctttttggcttcttgcactttgcataatgcttttgagattcatccatgttgctgcatatatctgtagttcatttctctttatttct

SEQ ID NO: 19762 - DNA, 201 bp, Homo sapiens
aattggcatttgagatcattggaaatattctttaatgctgtaagctagagttttaaaaaataggattagttaagtcatattttttaaaagcgaaaaaaatyacccagaagctattgaagatgatgagataatgagatgaagaagttgagatggactgtgtgtctcttgagtcaatgtcgataacctttggaacctgtccta

SEQ ID NO: 19763 - DNA, 201 bp, Homo sapiens
gattctaagtagtcatctcacagcttataattgatcgtcagcacagatggtttaatagaaaaataactagcaattctgctcccatctcctcccccacctcrgaatttaccatggcccgtgcatcagtcagttacacaggctctctggcggctgacgccaaagcttcccattgccatttgctgttgtagcagggcatggggt

SEQ ID NO: 19764 - DNA, 201 bp, Homo sapiens
tcattttgatgctcgacagacagctgatattttataaaactttatgattgcctcttcatcaagcactgtaattgtaggtttgtcttctttgcaagtatggrgaactgggtattttcttttaaatacttgtcatcctaggaggcggattgcctatgcctgtcatgcaaatcaacttttcaggcatcataggcagaactagga

SEQ ID NO: 19765 - DNA, 201 bp, Homo sapiens
ttaatgctgtaagctagagttttaaaaaataggattagttaagtcatattttttaaaagcgaaaaaaattacccagaagctattgaagatgatgagataaygagatgaagaagttgagatggactgtgtgtctcttgagtcaatgtcgataacctttggaacctgtcctaagtgagaacctcgattgccctactgcaaatg

SEQ ID NO: 19766 - DNA, 201 bp, Homo sapiens
ataggaggattttgtttcctgacactccagtttaaaagtcacctcaagaatgactacatctgatttttgtgcccagacaaggacactaaggatgatcaatrcccatggacttttgaggtgcctactactatatcatagctgccttgaaaatggagtttgggagggagtaaggagggacagagtggcagccacatggaggga

SEQ ID NO: 19767 - DNA, 201 bp, Homo sapiens
ttactaggattctggggggaaattaattcaagagagcaaattatatcctttatccaggtgtgtgggaggagcaggaaatattgggccctcccgcagaagaygcatgtctatgagcatgacctctgagaaccttttcagatgctacaggatagaaaggtctccgagataaggacttgagctaagcagaaggcagaagcttgg

SEQ ID NO: 19768 - DNA, 201 bp, Homo sapiens
tcctaaaaaataccatagtctttttgagtttggagaatattattactgttgtcaattactttttattagcaccctgtatgatataggtactatcttaggtkggtttccctggaagtcagctctgcaaaagagaattgcaagcagaacgtctttcgaagtgtgctttgggaagatacacctgaggatgcaaaaaagccaaag

SEQ ID NO: 19769 - DNA, 201 bp, Homo sapiens
tgaaagattatcccttagttcttccttaagacaaatgtagcctggggaaagggaaacctttgtggttattttggtaaattttttaattgatttcatttttmctatggcagcttgcagttatacttttattaatgtgcttgtttacttgaggtctatcttccctactagactaggtaagtttcaaaaggttggcaacctcat

SEQ ID NO: 19770 - DNA, 201 bp, Homo sapiens
aggttaagggatttacccgatgtcacagaacaaagaagaaagaggtaaggccagggttttcctattagcctatgatgtctcacagagataacctgtccagktagatacccagttttggctggagaaggcatcacagaccttgggtaattgatggcccaccagtttgcacccctttccattaatgtggaccgatcatgccct

SEQ ID NO: 19771 - DNA, 201 bp, Homo sapiens
cttctaagagacatcagtgagtctctctctgagtggttgcgtgtccctctttagatgaaaccctttataagcataactgtgccagtgtgtgagagaatttctggcccagagtgggcatagttcctgcagcctggtttcttataaattcactggaaacagagtttgtctgaagactgcataggaaatgaaagtaaacgcctg

SEQ ID NO: 19772 - DNA, 201 bp, Homo sapiens
gggaagatcctcccttaagctttcccctctgtttttccaactcctgaaacttacatccttctgcaggcttcaggactcagtgtaggtgtgtctgatgcccrgtcatcctagagaaggggttgtgggaggggctgtacctgttgctatggcagcaaccagttgagatcatgaacccatttgattcagaggcaattgcaaggt

SEQ ID NO: 19773 - DNA, 201 bp, Homo sapiens
ttttctactgctctctgattggatcctccataggaacgctttggggtaaatatgttcgattatctttgaagtaaacgatacaaggaatgagttggaggagygagaaagtatggttgggaggggaggggctcacgcactgagaaaagagtggtcagtttttatttatatccaagggatcaaaattaggagtcaccaagcctt

SEQ ID NO: 19774 - DNA, 201 bp, Homo sapiens
gccaccaaaggcagcccactgtggccttagcattcccacctctttctctctccttggaatgtcttcctctgttgattggccatctgaatccaccttccacttcatgtctgggtgaaagtagagtctcaggaagccttacatgacatctctatccttgctcctatcttcattaaatggcagtgtttgcaggtctgatttcag

SEQ ID NO: 19775 - DNA, 201 bp, Homo sapiens
tacttccatacccaataagtggagtaccttttggcagtcacttggcttttgaaccttggttcttctgtaaaatgaggggtttgtgcaagatgctgtgattycttccagctctagaatctgcaagatgataaaggttagagtactcatattagactgagtgggaaatagtgatttgttagtaagaggggagaggggaacatc

SEQ ID NO: 19776 - DNA, 201 bp, Homo sapiens
cctcccctcttgttttcagagccctttctggtgcttgccactctttaaagaatacaaatctctcatcagcaagccctgtagaaggggcaaaggggtgatgyactttagctcatcaccactgggcacgttctctttaatcctctcttaaattcacctgctttggctgatctgcatacagtgggagtggtgtcagatcaacac

SEQ ID NO: 19777 - DNA, 201 bp, Homo sapiens
gacagacccatgggtgccctacaggtgagagcagtaagaggaagagaaggaaacggtgagaaactgggagatgtggtggctgggatgccaagaacgatgasctctgaggagagggggaggtcagtggtgtcaaatgctgcagagtggtcaagtaggagggtaaaaaaagggaccatcaggggttcagtggtagtcttagag

SEQ ID NO: 19778 - DNA, 201 bp, Homo sapiens
ggagtcatgtctacgatttgccttgattaacaggtttcctattcttttcccgtttgtccattttgttttgtttttcttctcctgttttctgtattttgttygtttttgctctctgggaatgcctattctcctctcctatctttctgcatccttctccccacttccttctcctttccctgccaccccactgccccgctaacc

SEQ ID NO: 19779 - DNA, 201 bp, Homo sapiens
ttctctttcatgaagagaaagcacttcagaaacttatggggctctgtagtcatcaccaagaacatttgctttcattgtactgttaagtaggagtgctcatyagcagagattctggtcaaccaaatgctgggttagtgtagagtatgctacttgatctaaattcaggaaaacatgcccagggcgtaggacttccatactaca

SEQ ID NO: 19780 - DNA, 201 bp, Homo sapiens
tgcccaattttgtgtgcagaggcttagaacccacattaccaaatgctataaaaccagtggttgtttgcgtgaccttggaaaagtatctgacctttctgtaytgtcttctcatgtgctaagcaagagtgtgagaatattccaactcagtatattatggtgaggctgatgctgtgttcttcattacgtacatgggagattttg

SEQ ID NO: 19781 - DNA, 201 bp, Homo sapiens
aaggaagaccaggatcagaggcaggtttgggattaactaactggaaggactttggtgttgaggagtttcagtctcaggacaagcagtgaagcagctgatgmtctttgcttagccttctacatggagtgagttgtggggaaaagttgtttgcaacatgtatttctctaatggccagggaggggttatttcactattatttct

SEQ ID NO: 19782 - DNA, 201 bp, Homo sapiens
gagtttcagtctcaggacaagcagtgaagcagctgatgatctttgcttagccttctacatggagtgagttgtggggaaaagttgtttgcaacatgtatttytctaatggccagggaggggttatttcactattatttctctccaacttttctatcaaatacacttgtggagtttctgtagtgtgaattgtcttacttcaat

SEQ ID NO: 19783 - DNA, 201 bp, Homo sapiens
gcttagccttctacatggagtgagttgtggggaaaagttgtttgcaacatgtatttctctaatggccagggaggggttatttcactattatttctctccarcttttctatcaaatacacttgtggagtttctgtagtgtgaattgtcttacttcaatctgtaagttcaatctatattcatgaagtaggagggcacccctaa

SEQ ID NO: 19784 - DNA, 201 bp, Homo sapiens
aacattaaaaatgattatatataaattacaaattttttatggtaaaggacaccataagtaatgtcaacaaatgattaatacactgagaaaaatgacacgtraaaaaaattctaatataagtatatataaagagcctctataaatttataagaaaaagacaacatatagaaatatggacaaaggaagagagtaagcgattca

SEQ ID NO: 19785 - DNA, 201 bp, Homo sapiens
tatgctttccgcatctgttgtgactacttaagatgctccaagctgctatggtggaaggggttttatggacttcattggcttttggcaagaagaggcaactkaaagtctggatgctttctgagagtcttcccaactcctcagaaatcttttggtctataaacaatgactgtggctgtcttttaagttgccttttcacagctg

SEQ ID NO: 19786 - DNA, 201 bp, Homo sapiens
gtaaaggacaccataagtaatgtcaacaaatgattaatacactgagaaaaatgacacgtaaaaaaaattctaatataagtatatataaagagcctctatamatttataagaaaaagacaacatatagaaatatggacaaaggaagagagtaagcgattcaaaggaaaggcaaaccatatggccaataaacacctgaaatga

SEQ ID NO: 19787 - DNA, 201 bp, Homo sapiens
gaaaagtaggggaaaggtaatttatttcagtgtttacagagggtttgcgtgtaattagcagtttatttctgtgacacagctggcctcctcagcttggaacytgactttgaaatgctcttaaagagacccatacctaggcaatctgaggggtgctggggacttgggaagagagtgaagaaaaatgtcatgccctgtctttgg

SEQ ID NO: 19788 - DNA, 201 bp, Homo sapiens
aggaagagagtaagcgattcaaaggaaaggcaaaccatatggccaataaacacctgaaatgatgctaaaactcagaaaaatgcaaattaaagcaataaatyggaccaattctttatccatcagattggctaacatgagtaggaagattagtggaatgttgcctacctgtggttctgtgcatctgtgtgggtctactttaat

SEQ ID NO: 19789 - DNA, 201 bp, Homo sapiens
atgcaaattaaagcaataaatcggaccaattctttatccatcagattggctaacatgagtaggaagattagtggaatgttgcctacctgtggttctgtgcrtctgtgtgggtctactttaatgagtttagatctaggtgcttgtcctggaggcacattcacagtgtgttttttaaataagaaaagcaagttacagagtaat

SEQ ID NO: 19790 - DNA, 201 bp, Homo sapiens
tctctgaatatatcttaagttgcctgataccagaggtgtcctctcacagtgtgctcccccagcatcgtgctctgagcataggtggtgttcagcaagaagaraggtgcctggagtgtgtttaggattccagaggagtgcctgggccgtattcccagaaggagagggcgttgttgcagtatggctgggtggtgagataggcct

SEQ ID NO: 19791 - DNA, 201 bp, Homo sapiens
gcctgtctccctgggtagcacatccccaaagaatcctctgagcattgatctttgattgtgccccttccgtgctacccagcaggaccttctcccctaaagargggtcactttgtattgaggatctccttcttatattgcatttgcttagagggtgcatggcctcagaccacattttggggctgatgggaagaagttggggca

SEQ ID NO: 19792 - DNA, 201 bp, Homo sapiens
ccatcagtgctcttggtacactgtcaatgagctgtaatattttgaaaggaatctttttttttttttctgagcaggtctcaacagtgggcttaaaatattcrggaaaccatgctgtaaagagatgtgctgtcacataggctttgctgttccatttatagagcacaggcagagtagatttagcataatttttaagggccctag

SEQ ID NO: 19793 - DNA, 201 bp, Homo sapiens
taatattttgaaaggaatctttttttttttttctgagcaggtctcaacagtgggcttaaaatattcaggaaaccatgctgtaaagagatgtgctgtcacayaggctttgctgttccatttatagagcacaggcagagtagatttagcataatttttaagggccctaggatttttggaatggtcagtgagcattggtgtcac

SEQ ID NO: 19794 - DNA, 201 bp, Homo sapiens
gaataggcaagtgggttattgtgagtgacagaaacctaacttggactagtttgagcaaggaggtacttttcagggaaatgatgtttcacaaaactgccacrctgcaggcagaattagaaaataggccttgggaattgcagaaatagggctccaggtccaccagaattatttcctcttttcattccctcttggccctgtaag

SEQ ID NO: 19795 - DNA, 201 bp, Homo sapiens
taacttggactagtttgagcaaggaggtacttttcagggaaatgatgtttcacaaaactgccacactgcaggcagaattagaaaataggccttgggaattrcagaaatagggctccaggtccaccagaattatttcctcttttcattccctcttggccctgtaagattggctttatttttctctctcactgtagccagttt

SEQ ID NO: 19796 - DNA, 201 bp, Homo sapiens
ttatttctgtattcttcgtctggcatcctttggggaacctcttcttgaggttaaggtgagatgaaggcttcctttggagacacgttcaggccaagcttcaygctctgaggagttgtttcaggaagaaagagagaggagctatgtgtatgttctcccagtgtgaatagggactaatgtgaaacatatgccattgcctttaat

SEQ ID NO: 19797 - DNA, 201 bp, Homo sapiens
tcttatctgttatatattgtctgtggtcttagaagaaagtctgtgctccagtttggccataaattaactcagagccatatgtattgagcaatataccccaycaagctgtaaaacaaatgaacaaatggaaaacaacaaaagaaactccaaaccaaccaaccaatcagaaacaggtcactgccccatgacagttttgaagtg

SEQ ID NO: 19798 - DNA, 201 bp, Homo sapiens
aaacaggtcactgccccatgacagttttgaagtgtgtgtgaaagaggagaaagagctttaagactgtccattctggagggcagcaagatgttgttgcttcrggtagcataagagggaacagattctcttctacaatgccatgtttgtggttcttggaaaagcacagcaaaacctttcaaggcaaactgtttcatcattctg

SEQ ID NO: 19799 - DNA, 201 bp, Homo sapiens
attttcttacagttctggaagtcagaagtctaaaatcactttcactaggctaaaatccagggttgtgcttcccatctctcctccccagaggctttagttcrtttctttgcctctcccagcttctagagctacattcttgtgttctttggcccttgggcccttcctctatcttcagagtcagatgcagaataacttgcttct

SEQ ID NO: 19800 - DNA, 201 bp, Homo sapiens
ttttcttacagttctggaagtcagaagtctaaaatcactttcactaggctaaaatccagggttgtgcttcccatctctcctccccagaggctttagttcgkttctttgcctctcccagcttctagagctacattcttgtgttctttggcccttgggcccttcctctatcttcagagtcagatgcagaataacttgcttctg

SEQ ID NO: 19801 - DNA, 201 bp, Homo sapiens
ccctctccccctttgcatttcttcgggtgaaggggggtacctagcatggaatgtatcccccaccccttcctggtgccaatttgcccctttgctgaagcacmctcttcggtgcatctaaggggcaagcttggtgccgtggagacccgtttgggcactagtgtttttcaaggtaagacttttggttttttatttttcctatgt

SEQ ID NO: 19802 - DNA, 201 bp, Homo sapiens
tatcatctgatttctactgcgttgggtctacattcagtttcagaacatgtgttcccatcccaggtggtaggtccttgcagtcataaccagcttagaagccrgcccttaatctcatgagcaccacctcacctcttagcaggaaattctctcctgggacaacttcttggtggggctgggtagtggtggtatggcccagctcgg

SEQ ID NO: 19803 - DNA, 201 bp, Homo sapiens
tcttgggccagcaatgtaagaaaggaggactgcattttcttaacttgattaagaattatagagagaagatgggaaaagtaactattcagccattaaataarcattttccaagcactgtttaaggcccacgtatgaggcacggagatctggaagatatgtaagatgtttaacatgcagtctttacctttgtgtgcacatagt

SEQ ID NO: 19804 - DNA, 201 bp, Homo sapiens
gcagcttcagacaagggtggaaaaatcaggagacagagatccatcatcacggggtctaaaggagccttggagtattcagagaggctcatcctatttaataytaaatgactaactccagtaactaactctagaaaatgtttcttccctgcccaccctcatctctaggaagactggctgttttgctattaagtctggtggggc

SEQ ID NO: 19805 - DNA, 201 bp, Homo sapiens
ttgcctgataccagaggtgtcctctcacagtgtgctcccccagcatcgtgctctgagcataggtggtgttcagcaagaagaaaggtgcctggagtgtgttyaggattccagaggagtgcctgggccgtattcccagaaggagagggcgttgttgcagtatggctgggtggtgagataggcctcctgcctgccccctcagtg

SEQ ID NO: 19806 - DNA, 201 bp, Homo sapiens
tctccacagagatattcctgagggatagcaagagtggggagctaacctgtttctttgcactgaatgagcaatgcttgtgcctttcctcttttcttgtatcygtacatttccagaggagccagtttatagagggtatagagtaacccaagaatacaggtttgggagtaagggagctggcttttattccaagtgctgccactg

SEQ ID NO: 19807 - DNA, 201 bp, Homo sapiens
ggtgtgtggtgagaatggtggccatactcccttggggtgctgtcaccaggaccagtcttgagcccagttcagccctccttgtttagtagcatatgtctcaraacatgatatgcacggccacttccacccactgctttcacttccggccccttttcttaggagttttggtctcataatggctctagaagcagaggaactgaa

SEQ ID NO: 19808 - DNA, 201 bp, Homo sapiens
ggctaaatggaaatagaacctgtacaagtcaaatgtttctggagcatctgccatctacagggcacttggaggaaacataaagacattcaagacacaatccrtgtattcaaagaatgcacagtccagccaacaatgttttaaagcttccagtagtttcctaaaaaataccatagtctttttgagtttggagaatattattac

SEQ ID NO: 19809 - DNA, 201 bp, Homo sapiens
ggaggtcgaggctgcagtgagccatggtcatgccattgcactccagcctgggtgagagagcgagacgaccttgtttcaaaaaaaaaaaaaaaaaaaaaaaraaaaaaaaaaagcgcccagctcttcccaaagtctggaaaagcaggcttcctggcccctaggggctatgtcaaatctgtgttccacagtggatggcaaggc

SEQ ID NO: 19810 - DNA, 201 bp, Homo sapiens
catcttggctttattcgggaggccaattatgtgtatgctagccttgtgggtgccctagaaactccagcaaaggccagtgacagtgttgtgagccttctgcycctcattatccacagaggcaggagcctatcagagcctccaaccttgaatttttgtgtgagttctgcttctgttctcctactccaggtatgtcccctcacc

SEQ ID NO: 19811 - DNA, 201 bp, Homo sapiens
gaggtcgaggctgcagtgagccatggtcatgccattgcactccagcctgggtgagagagcgagacgaccttgtttcaaaaaaaaaaaaaaaaaaaaaaaamaaaaaaaaaagcgcccagctcttcccaaagtctggaaaagcaggcttcctggcccctaggggctatgtcaaatctgtgttccacagtggatggcaaggct

SEQ ID NO: 19812 - DNA, 201 bp, Homo sapiens
aaaagacacagtaaataagtaattattatatggggtgataagtattgtaataacctgcaaataataagagatttaaaagtatacaaccaactccttgctcrtggcaagtaaaatatttagatgataggaatataaataataatgacctattcatttatttttctttctttgccaagaattgcctgaagggaactgagctta

SEQ ID NO: 19813 - DNA, 201 bp, Homo sapiens
aggtcgaggctgcagtgagccatggtcatgccattgcactccagcctgggtgagagagcgagacgaccttgtttcaaaaaaaaaaaaaaaaaaaaaaaaawaaaaaaaaagcgcccagctcttcccaaagtctggaaaagcaggcttcctggcccctaggggctatgtcaaatctgtgttccacagtggatggcaaggctt

SEQ ID NO: 19814 - DNA, 201 bp, Homo sapiens
gtcaggactgaggctttacagtctctggttgacacagctgaggaaggcagaaccctcaggctggggtgtgagagtttcaagcttagccttgaccagtcttkccatctagagaaccagggtcactttcaggcccaaatgccacggggctggtgctgtcagcattatcagagcgtttcctagcaatgcccatcagcaaagagg

SEQ ID NO: 19815 - DNA, 201 bp, Homo sapiens
ggtcgaggctgcagtgagccatggtcatgccattgcactccagcctgggtgagagagcgagacgaccttgtttcaaaaaaaaaaaaaaaaaaaaaaaaaamaaaaaaaagcgcccagctcttcccaaagtctggaaaagcaggcttcctggcccctaggggctatgtcaaatctgtgttccacagtggatggcaaggcttc

SEQ ID NO: 19816 - DNA, 201 bp, Homo sapiens
cctgcttcttgttcttgagggtgtcaaatattgtagaagtgaacaacataccagcccacaatgattatgttgcagttaagtggtatggtggaattcagtgyagggcataagggagtgactgactctgggaaggttttttagtgaaggtaacattcagtcagggattgagtggaggcttttcaggtggaaaaggtaggaaag

SEQ ID NO: 19817 - DNA, 201 bp, Homo sapiens
tgagcatctgggttattctggcatgtccccaggtggggctgaccaaagcattcactcaacagagtaggtgtcctccaaggctaaggtggactgtgctattaaaaaaaaaaaaagatttttctttatattgtgtgatgtgggagagatggagaaggagaggtaaaagagagggtgtaaggtactggaactgctatgggggga

SEQ ID NO: 19818 - DNA, 201 bp, Homo sapiens
taggaaagaatgtggcatagaattgcaagaagctggatgtggctgtgtgacttggtatacaggtaggcagatgctgtgagagacagatgagctagagaggstaggttgggtcagtcatggtaggggattggcatgggcaaattcccatttcaaggtattaagcaggggagagacagggcaagatgtgttggttagaaatga

SEQ ID NO: 19819 - DNA, 201 bp, Homo sapiens
attaagcaggggagagacagggcaagatgtgttggttagaaatgacaactcttccctgctctgaagaatgaaaccagctgtgcctgggaatcacttgcccsactttacaagatctccctggcaacagaatggctgttgtacaactagccagggaatttgctgtgacagtcttccaaccttatctgacatccagagcaggga

SEQ ID NO: 19820 - DNA, 201 bp, Homo sapiens
gggaatggcagaattggaacctgagagttagagtccatgagagagaggagaagcaaaatgagaaatatggagtctgagtgggaaggaaccccacatctgtygtctgatacaggcacctactcaagggaggaattcggcatcagtgtccctcacagatggttgcctgacacagtgatttctataaataacaattatatggca

SEQ ID NO: 19821 - DNA, 201 bp, Homo sapiens
tgagttagagattaaagacaaagggcccaggggcaaaggaaataattttgtttcctaatcatacagtgacattacaagttagcatttctgtagtttccctkgctgagaactgcctagaatttagtgataatttcctgactcacaaattgtgaaacctaggcctaagcctttctcctcttcttaaatatttattgagcacct

SEQ ID NO: 19822 - DNA, 201 bp, Homo sapiens
agtgtaactgatagatttagcaaatgaaaatataagacatccagttaaatttgaattttaggtttcagataaacaatgaatattccatgcattgtacaaayattgcactaaaaattatttatctgaaattcaaacttaactgggtgtcctgcattttggctggcaaccctgaacctatgaccactgtttcagggtattttc

SEQ ID NO: 19823 - DNA, 201 bp, Homo sapiens
tattttcaggcatagacttgtacagtgaatgtgcctgtgaaaagatattatagacctggattgacaaggaggctaggaaagaaccccaagttcaaagggartgcaaggttggagaattctttgggcgactaacttggggagagatgatttggttctcattgcccagagcattgcctctgtcttctgttctgctgtgccact

SEQ ID NO: 19824 - DNA, 201 bp, Homo sapiens
aattctttgggcgactaacttggggagagatgatttggttctcattgcccagagcattgcctctgtcttctgttctgctgtgccactgtgctatggccacratgagaaagacttgtgctgcatcatcaggattgtatcaatctccattctcttcctatttgctgacacctaaaagtaaaaacattcaaggtagggttgagc

SEQ ID NO: 19825 - DNA, 201 bp, Homo sapiens
aggatgtggttagggcagtgatggaggtggacacgttatgggagcacagaatagggctattttcctttattgtctttttcctctaagaattccattgttgrccaggtatggtggctcacacctgtaatcccagcactttgggaggccgaggcaggcggatcatgaggtcaggagttcgagaccagcctggacagcatggtg

SEQ ID NO: 19826 - DNA, 201 bp, Homo sapiens
agatcgtgccattgcactccagcctggatgacagagcaagactctgtctcaaaaaaaaaaaaagaatcccattgtccctgcttactttctaacaggtgaayggggagccggctgtcattcctgcctcaaggagtattggaactgtgggagttaggaagctgccagtggccaatgtgcatcaattaaagacccagttggtag

SEQ ID NO: 19827 - DNA, 201 bp, Homo sapiens
cattcctgcctcaaggagtattggaactgtgggagttaggaagctgccagtggccaatgtgcatcaattaaagacccagttggtagccctcctgcactggrggacagaaaagaacacttggaggcccaggacagcacaaggccacaggctgcatggccctggctgcagtgtggttgggagaatttggggagcaggtagttt

SEQ ID NO: 19828 - DNA, 201 bp, Homo sapiens
ttctctttatctcgctctttctctttttctatttctgtcatatttttcagttctattttctatgttgcttctcgttcttttttctctttagtccttccctrcttattagaaattatatgaccccctccttaatgtctttccttggccttggaagatagagtcaaaaggagtgtggaagactccactgccccaagtcccccc

SEQ ID NO: 19829 - DNA, 201 bp, Homo sapiens
ttctttatgagtaggatttctttctgcttcttatttttaggtagtatgaacgtagactcagagaatcttaaagttgacaggaatctctattggttgtttarataacctttaccccatgtaggatccctctttacttcctaatgatgctctacaggtagctcccggatacttggagttttgggaagggtgccagcacatgaa

SEQ ID NO: 19830 - DNA, 201 bp, Homo sapiens
ataacctttaccccatgtaggatccctctttacttcctaatgatgctctacaggtagctcccggatacttggagttttgggaagggtgccagcacatgaakccgtccgcttggctgttggcagcactaattgtgtcagttaccgcttgcgattctgttgtcctggtctgtatgatttgtacctaatgattgtatatctgct

SEQ ID NO: 19831 - DNA, 201 bp, Homo sapiens
agatgttctcagtcctggtctcacctattcaataaacttaaagtttctgctatgagttaagtgctctgttaattttggtggggaaagcacaaacagacctrttgttaaggcacactctcaaactttgtctggaagaccttttggaatacttcacctatatctcatagttttattatttctggtttctcaatacttactcat

SEQ ID NO: 19832 - DNA, 201 bp, Homo sapiens
atgaaccatgacattttgccttcctgagaggaatctttgatgtttaaattatctggggatgtttaacaaaggaatgtgggaaatgcaaaactttttacaarggggaaagatgcccacacagggtgaagtgtacaaagcttcaacctggtaataaactctcaatttcttccttgaacacagctgcacctctcctcagacacc

SEQ ID NO: 19833 - DNA, 201 bp, Homo sapiens
tgctgtgccttctcagaggagtgcgaaatgtgtctctgagaagaacacagccatttgttctgttaggatgcttctttcagactgtaattagagtgctgtgkggggtgtagatggaggagaaagaagaatatgaaatgctcttacttccctgtggctcattcttcctgcaccacggggctttgaacccactgaaatattgtg

SEQ ID NO: 19834 - DNA, 201 bp, Homo sapiens
aggagaaagaagaatatgaaatgctcttacttccctgtggctcattcttcctgcaccacggggctttgaacccactgaaatattgtgactgaaacatacastgttatatgcagagacagagagaaagcagcatgtacacctctgagttcatgccttgatagtatctgtgtgctacaatgaggtggcgcagactggcggaga

SEQ ID NO: 19835 - DNA, 201 bp, Homo sapiens
atcttcattttcttccagaggaacaagtgatttcttaaataaaaactacacgtatgacagtatcttttctctattcctaatagaaaacatagcacaaaagygaggtcacagaggaaaaatttggagtttgatttagtgcttagttgcttgagccttattcttctgtaggagctttggaatgacactataacacttactgtg

SEQ ID NO: 19836 - DNA, 201 bp, Homo sapiens
atcttgttggctttgataatggcttaaatcactcttgtatgtatggatttgggagcagtactttggcctagtccatgtgtaaattatattttaactaatgrggactaaagtgttgaggcgtttcttgactccagggctttgttattcagtactcttttcatttcaaatggcaattttaaaatcagttaaatcttgcccctg

SEQ ID NO: 19837 - DNA, 201 bp, Homo sapiens
tagtcttttaagaaatatgtgtcatcctgtcatattatcacaatcaccaagtctctgagaaaccatacactattgagggcaaagaaaatattgtcaaaaawtgatggccaaatggttggcttattccagcaaatactacagagaacagggaagacaggtgaatttgcctccaggtgacactgtgttatagatagatgttcc

SEQ ID NO: 19838 - DNA, 201 bp, Homo sapiens
ctcagttttcttgcaggctatggtgaaatagcaggagccgcctgggtgtcttgaaatttagcctgagagaatggggtgattaattcttatgtgtcactgcrttgacaaagccattcacctgtggctgcttccgacacacctccagctgcacaggtaacagccttctgtgatgagggggatggaccagacatcctgaatgca

SEQ ID NO: 19839 - DNA, 201 bp, Homo sapiens
gaggagaagcaaaatgagaaatatggagtctgagtgggaaggaaccccacatctgttgtctgatacaggcacctactcaagggaggaattcggcatcagtrtccctcacagatggttgcctgacacagtgatttctataaataacaattatatggcactacgggaagtggatgaggctacttacaaatggagctgaccagc

SEQ ID NO: 19840 - DNA, 201 bp, Homo sapiens
agttagcatttctgtagtttcccttgctgagaactgcctagaatttagtgataatttcctgactcacaaattgtgaaacctaggcctaagcctttctcctyttcttaaatatttattgagcacctacagtataggtgcaaagcttagctctaggctctgtaaaggatacagattttaacaaacagtttctgccttcaaggg

SEQ ID NO: 19841 - DNA, 201 bp, Homo sapiens
ctgatgtagacttattgagcatgtcttccattgatgctgtcttgggttctggagatacaaagacttacaagccatggttccttgctttcaacctgtttttrttaaggaataggagtgtttcctgtggccacagaataaacgaaactaactgtcctggggcttcttcaggaaaccagtggggctaaccagacttacatagtg

SEQ ID NO: 19842 - DNA, 201 bp, Homo sapiens
tgaggagtggagtgctcagggagagctccaaggacaaggacaaacactgataaggaattgaaggatgagaggattcaataatgtggagaggtttggggagrcttcctcttgagaggataacgtgagaagagccttgggagcaagtgtggagggtctgttcagggcaatagggagaaaagtttggatgccttgtctttttac

SEQ ID NO: 19843 - DNA, 201 bp, Homo sapiens
acactgcattattgtttgcctttctatctttcactttggtttctatcacatttgatggctacttttcacatgatacattttaaatcatttatttacccatccatccatccatccatccatccatccatccatccatccatccacccatccatttattcaacaaatattcaagaaataaccattgattacatactatatatt

SEQ ID NO: 19844 - DNA, 201 bp, Homo sapiens
cagggctgtatataattaggtgctaaacagagtagacagaacagaagaactgtgcagagttgattggaggtcagaagtcctgcattctggttctacttccrtacccaataagtggagtaccttttggcagtcacttggcttttgaaccttggttcttctgtaaaatgaggggtttgtgcaagatgctgtgattccttccag

SEQ ID NO: 19845 - DNA, 201 bp, Homo sapiens
cactgcattattgtttgcctttctatctttcactttggtttctatcacatttgatggctacttttcacatgatacattttaaatcatttatttacccatccatccatccatccatccatccatccatccatccatccatccacccatccatttattcaacaaatattcaagaaataaccattgattacatactatatatta

SEQ ID NO: 19846 - DNA, 201 bp, Homo sapiens
ttagagtactcatattagactgagtgggaaatagtgatttgttagtaagaggggagaggggaacatcaggaaaagcaataaatgatggcgaccagaaggaytgattcctgacaaccataggacaaagtggagaatcagagagggactggttgaagagcggttaccttggtattatccagcatgttctttctggaataggat

SEQ ID NO: 19847 - DNA, 201 bp, Homo sapiens
actgcattattgtttgcctttctatctttcactttggtttctatcacatttgatggctacttttcacatgatacattttaaatcatttatttacccatccatccatccatccatccatccatccatccatccatccatccacccatccatttattcaacaaatattcaagaaataaccattgattacatactatatattat

SEQ ID NO: 19848 - DNA, 201 bp, Homo sapiens
ttcagtcatgcacaaaagtagagagaataaaatattaaaccctatgtaacccacatcagccccagcagttacaagaagaccttaaagtctttagaggatcyggcatctccctgttgggcttctgtgtcagagttcagaaagggagaggggagggacaggataaatatcacatgacatcaatgttggaattactaggattta

SEQ ID NO: 19849 - DNA, 201 bp, Homo sapiens
ctgcattattgtttgcctttctatctttcactttggtttctatcacatttgatggctacttttcacatgatacattttaaatcatttatttacccatccatccatccatccatccatccatccatccatccatccatccacccatccatttattcaacaaatattcaagaaataaccattgattacatactatatattatg

SEQ ID NO: 19850 - DNA, 201 bp, Homo sapiens
ttctggactgaggcactgcttcatcctcagtgacaatcactgacattcttggcagcggggagatggtggctgcatcaagtccagaggattctgaatgaccwgaatgtgtgggaagccttgcttactcataacggcccctggctaagtcagatgctgcctccagagattgtttgtgtggggagacttagtatgtttattaaa

SEQ ID NO: 19851 - DNA, 201 bp, Homo sapiens
tcttggcagcggggagatggtggctgcatcaagtccagaggattctgaatgacctgaatgtgtgggaagccttgcttactcataacggcccctggctaagycagatgctgcctccagagattgtttgtgtggggagacttagtatgtttattaaatatactcagggctccaagttacagtgaaacgccctgctcctgggcc

SEQ ID NO: 19852 - DNA, 201 bp, Homo sapiens
ccagcagttcttaatcaaaagtaatcttgtcccccagaacatttggcaatttttgattgttgcatctggagaagtactagtggcctctaatgggtagaggmcaggaatgctgctaaggcacacacaggagagcccccaccaaacagaactgtctctccacaggtgctggcagtgctgcagtggaggaagccctgcctaggc

SEQ ID NO: 19853 - DNA, 201 bp, Homo sapiens
cttcaggaaaggttgtgctaattccaacctcacccacagtgaatgagattgcactcatctttgccaactctgggtatttcagttagtaagaatgtctcttkaacttctcctaaacacagtttaattatgatatatttcgaacatttgtatagaaaacaagagacacccacgtacccactaccaagattaaatacataataa

SEQ ID NO: 19854 - DNA, 201 bp, Homo sapiens
caggggatcggcaggtgaggaagatggagagcagccagtgtgccagtctagggaagggctgggtggggagggtgttgggagatgggaggagcatcagtgcyccatgtaagaggacactgaccaaagagaagcactctcctatgatgcctgactgatagtaggtgttgcatgagtggtgtgggatggaggggctggcgtctt

SEQ ID NO: 19855 - DNA, 201 bp, Homo sapiens
agtttaggaatacacatttccaacttttattaggtacagtagttcccccttatctgcaggggataagacccccagtggatgcctcaaactgtggatagtaycaaatcttataaatgctatatttttcctacacatacatacctatgataaagtttaatttataaattagacacaggaagagatgaataataactattaata

SEQ ID NO: 19856 - DNA, 201 bp, Homo sapiens
catgaagccgtccgcttggctgttggcagcactaattgtgtcagttaccgcttgcgattctgttgtcctggtctgtatgatttgtacctaatgattgtatrtctgcttccgagggccatagggcatgcactttccatacagttctttttctgagattgaagacacgtcaaatagtgaaggaagttcaggtaccttctttaa

SEQ ID NO: 19857 - DNA, 201 bp, Homo sapiens
gtaagaattttggtggatggtgatgtcatgaaccaagccagccccttgttactttcaaatttctgaaattcagaaagtagaaaggaggcatcccagggctygaattcagttatcctggccctcactggccctggtcactcttcattttgactctttccttcccttcccccatagcacctttagtagaacccaatgaacctg

SEQ ID NO: 19858 - DNA, 201 bp, Homo sapiens
ccatggtacctcttctgcagattggccttctgctcttctttgccatcctgatgtttgctatcattggtttggagttctacagtggcaagttacatcgagcrtgcttcatgaacaattcaggtagggtcgttcttttctgtcttctccttttcccttctcccctctgttaactggggtaatttcagggcacttggaggctca

SEQ ID NO: 19859 - DNA, 201 bp, Homo sapiens
gaagaagtcccaaggaccagcttacacccagcaagcccagggatgaagtgtgacccagaaagccctggaggacactctgcagttctcaccagctgtgggargcagcaggaaggaggggagggaggcaaggttgatgagtgcagtcactcctcatttgagatgtaaaggttgtcttgaggccatgccactcaaattagccag

SEQ ID NO: 19860 - DNA, 201 bp, Homo sapiens
catgccactcaaattagccaggcacctctaggaattgcagcactggccctgcagtggctggtgtcacatggagggctttgagagtgatgcatttcaattawatgtgtagactcacctaagtgatgtgataaatgcattgaaagcctgaaaggagaagtgttgcatttgaggatacaggcgtgattgttggtcctctttagc

SEQ ID NO: 19861 - DNA, 201 bp, Homo sapiens
agctatgataacttctttttaattggcagaacaccttgcttgtcaggcttttcatggagaggagagagtagagggagagggaaactatttcctgaactcayagtaaaggcttttcccctctgtttacattcatacataagtatagattcattcactaactcattcattcaccaaataatttttaagtggctactatgtgcc

SEQ ID NO: 19862 - DNA, 201 bp, Homo sapiens
ggaggtgaaaagtggttggattctgcatatatttttaagtagagctcatgggattcttcgatggattgaatatgagtttgggagaaagcagcaagaagagyggagttgccattaactaagctggggaagaacacaggtaaagtatgttgggaggaagaggagaattgagtttggatgtgttaaatttgccatgctcatttg

SEQ ID NO: 19863 - DNA, 201 bp, Homo sapiens
gactataacatagccatggaatttgagctggataaagagcaaagaggtggcggagaaaccgtgaaaagggaggagagaacgtggattatagaccgtttttraaatgtgactcttagggccgggcgcggtggctcactcctgtaatcccagcactttgggaggccgaggcgggcggatcactaggtcaggagatcgagacca

SEQ ID NO: 19864 - DNA, 201 bp, Homo sapiens
ccagagggagtgaagaaagcttcgaaatccctgggtggtttggtttgggactttatttgtctcctggcattgcattcactcagggtgatacagggaaagamattatggcaaggtgctttctaagtcagaccgttctcctgggcctggagctctcatttgaaggcagttaaactcgtgcattcttgtgcttgtgcatgagtg

SEQ ID NO: 19865 - DNA, 201 bp, Homo sapiens
catacatcaagttaagggaacgtttataatgtaaagctggaaaattccattagggaactttattgacttttgaggaggaagggaaggggattttttcattkgtttatttttcttcttggatttattttaagtgtgggcagagcagtggataaaaaaaataaatggaaagatacccacattgcaacttttctgttctttcca

SEQ ID NO: 19866 - DNA, 201 bp, Homo sapiens
agaaatgtaggagaggaccaggacacctgtgcgtgtgtgtctttctgtgtgtgacacctgcactccaacccaggactctcaccctctccatttccactgcyctacagcacgttacttgactagctcgattcacatgagcaggtgagcgctcctggattggattctaagtagtcatctcacagcttataattgatcgtcagc

SEQ ID NO: 19867 - DNA, 201 bp, Homo sapiens
gttgcatgagtggtgtgggatggaggggctggcgtcttctgggcagcattctttgcagggagggccctggtttcccttagctgctccacagtagaggtctsggctgtgaaggttctcctggggccagaatcttgattggagtacttagcatggctgtcccgtgttcctgaaggaagagtctctggggaaaatagagtgcaa

SEQ ID NO: 19868 - DNA, 201 bp, Homo sapiens
catggctgtcccgtgttcctgaaggaagagtctctggggaaaatagagtgcaagtcttacatgaaaggagcttgcgagaactgccactctgtcacagaagytgggggggatgctgtagagagagaatgagtgattctccctctcacaggcaaccctcctctcttgcacctcctgctgagacagacacgtgcacaccacgag

SEQ ID NO: 19869 - DNA, 201 bp, Homo sapiens
aatgtaggagaggaccaggacacctgtgcgtgtgtgtctttctgtgtgtgacacctgcactccaacccaggactctcaccctctccatttccactgctctrcagcacgttacttgactagctcgattcacatgagcaggtgagcgctcctggattggattctaagtagtcatctcacagcttataattgatcgtcagcaca

SEQ ID NO: 19870 - DNA, 201 bp, Homo sapiens
acctgccagttggagtatggtgctgtgtatagcaaaggagaaagcttgcaaaaggctctcgggagtgtgtgtgaggagctcgttgaggtccatgtgcaagrgggaaaggattatgcaccacttagcatagagctagtgctctggtcacatgacaaagaaagatggcagaataacaatggattgagggttcgagggtgaccc

SEQ ID NO: 19871 - DNA, 201 bp, Homo sapiens
acaagctccaagcttgcatacagagttgccaatgaggcttttgtgccgtgcttttaaatatgaacacacagctagggatcatcagcatttgaggaaaatgmccaacacaaaagaacaaaaaacaaaatcatgaattataaaaaggtaattgagggaatatgaacaatgcagggagtagaagacaaatttaaaagctgtatc

SEQ ID NO: 19872 - DNA, 201 bp, Homo sapiens
aagcttgcatacagagttgccaatgaggcttttgtgccgtgcttttaaatatgaacacacagctagggatcatcagcatttgaggaaaatgcccaacacawaagaacaaaaaacaaaatcatgaattataaaaaggtaattgagggaatatgaacaatgcagggagtagaagacaaatttaaaagctgtatctgctattag

SEQ ID NO: 19873 - DNA, 201 bp, Homo sapiens
tttgcatgggaaggcagagaagctcaaaagggaaagaattaaaataataaaaataataaaacagtgatcatgaagcaaaggatacatctgaagaggctgtkagcccttcttgtcaccctctgtgtgttgggagtgtcaaagctgcttgctcctggctgacctgggcagagcctgcgggattgccgtcaggggttggaatgc

SEQ ID NO: 19874 - DNA, 201 bp, Homo sapiens
  misc_feature (1)...(201): n = A,T,C or G, or insertion/deletion polymorphism (see Tables 1-2)
ctgaattatcagttaacatctttctagcatgtgccagcagaggggaaggagggtggcagagaaagagcatctaggatggttctgtttcattcacagcaganaatccttgaagcagctggcacatattgtgtggatgacagagaatttggtgctattgagcttaatgatctttaatataaacatgtcaggatatccagctga

SEQ ID NO: 19875 - DNA, 201 bp, Homo sapiens
gccagccccttgttactttcaaatttctgaaattcagaaagtagaaaggaggcatcccagggcttgaattcagttatcctggccctcactggccctggtcrctcttcattttgactctttccttcccttcccccatagcacctttagtagaacccaatgaacctgaagccaagcacaggagaatttgtccttccggtgtgc

SEQ ID NO: 19876 - DNA, 201 bp, Homo sapiens
ggccacctctgtgtcctacaaataaatagggacatctgggcaggttaatatgatgtgtttcctctgcacagtctcgtggagctgtacagaggtgtacataygataaatataagtaaaaaattgacagctgagacccagactttgagtaaaagtttcttaaacatactgaaatatctttggactctagcaaatatcataaat

SEQ ID NO: 19877 - DNA, 201 bp, Homo sapiens
ctggtcactcttcattttgactctttccttcccttcccccatagcacctttagtagaacccaatgaacctgaagccaagcacaggagaatttgtccttccrgtgtgcctttccctacaccttctgcctgattgtaagcaggtggctgtacccaaggacaccagctctattttggcaggagggccaggtgtgacacgaacag

SEQ ID NO: 19878 - DNA, 201 bp, Homo sapiens
ttaattatttatagtttaattaaaaattaagctaaagaaggcaagccagtgaattcatggtttctcatcacttggaaaaggatttctccccacatccatcattactgatttacttcttcatcgaggacctgggattttgagatgtgagatcaattttaaggatgttctggctcctaggagcgaccttgacactttttatca

SEQ ID NO: 19879 - DNA, 201 bp, Homo sapiens
gctggcagatataaagacccaagtcttcgcggtggaatttcttagatggacttgcaggggctggcgttataaagcatgtcatcgtaaccccgtcctcgtctttgtttatttttttttaaagttcttttgttttcattttcccctccttcccaccccttcccccaaccaataaatcaccaaactgttacctagcgggccggt

SEQ ID NO: 19880 - DNA, 201 bp, Homo sapiens
ggatggtaaagaagagggacttctctggcagcgctgagatcaacgcaaaattacagtgtcccactctggccccaaatccaaactgtcctatgtctgcatcytcctccagtaccaaggccagttccctgcctcatatctccttgccttgaccctcacctctaaaactgaaatgttatcccaaagtggcaataagcatgcgca

SEQ ID NO: 19881 - DNA, 201 bp, Homo sapiens
ctggcagatataaagacccaagtcttcgcggtggaatttcttagatggacttgcaggggctggcgttataaagcatgtcatcgtaaccccgtcctcgtctttgtttatttttttttaaagttcttttgttttcattttcccctccttcccaccccttcccccaaccaataaatcaccaaactgttacctagcgggccggtg

SEQ ID NO: 19882 - DNA, 201 bp, Homo sapiens
gtggttgccatgaagggtgatggtctttgaggccgtggcgactcggagctccctttgacctttctaagtcatgtctttgtccagtctgccaggttgagggkcactagcttgactggtgggtgggtgttatttgccgtctaggctcttcactttggggatgtagcagagccattgctttggggtgtgaagttttgctgtcgg

SEQ ID NO: 19883 - DNA, 201 bp, Homo sapiens
agtgtttacagagggtttgcgtgtaattagcagtttatttctgtgacacagctggcctcctcagcttggaacctgactttgaaatgctcttaaagagaccyatacctaggcaatctgaggggtgctggggacttgggaagagagtgaagaaaaatgtcatgccctgtctttggtgatgatgcttgaccaaggacagccact

SEQ ID NO: 19884 - DNA, 201 bp, Homo sapiens
gtgtgagagtgctttgtgcatcaagatgtgccttacgaatttaaggtattataaaaatcctttaaagttatgaacattcatgttaggaagatttctattaytgagatttacaatacaggtttttcacgtatcatttttaaacatgttttgacagatacagtcaatggtatccctcagaagaaaggtagaacgtatattcaa

SEQ ID NO: 19885 - DNA, 201 bp, Homo sapiens
tggatgtgaggggatgggtgaagacacgtgcagaaaaggaagtgctcattgtggaggaggtgaacataattggaggaattcgctttggcctttttggctgaaaaaaatatttatgaaattgctgtacacccccgctcccccccccgaccccaagcagagttagacacctatagaattccaggcaccgatgaaaagaccttt

SEQ ID NO: 19886 - DNA, 201 bp, Homo sapiens
taacttgtccaaggacatgcagtccatttttggcagaggcagagaagaaatgggaagtgagctgacatgaattaagttcttcctattgccaggacctttaytaggtatcttacccagatttctccttgtctaatatgctccctcctcaactcccctggggttccaccttccacgagtctccctgcctctcaggaaagcttc

SEQ ID NO: 19887 - DNA, 201 bp, Homo sapiens
cctcccaaagtgctgggattacaggcgtgagccaccgcacctggcccaattcactgcttttaacatttgttgatgccaagaaagtgctactggaaggctghtataggtttaagaacacaatgattggtcattctttttctttcctacccagattggaaattccaagtttgctctgtcatcacatctggttaatgcagacac

SEQ ID NO: 19888 - DNA, 201 bp, Homo sapiens
ttctaaaacaaagcctgctgctgaggaaaactacaaagggtggtacagatttaaaaggaggcagatagcctgctgcaggcaggaccacagtcttatcaccycactacacagctataaagacacacaggttctgaggtggcatgtcctgcagcaactgtgtaaggcagggcttcttatccctgttttacagataaggtaata

SEQ ID NO: 19889 - DNA, 201 bp, Homo sapiens
ggtaagaaattggagggaggtgaagggaggatgaggagaaggaccaggtccatttggagtcatggtcaaggtcttctggagagagactgcatcattgctgmtggtaccagtgagtgaggaggaaactgaaaagagttcagcctcacaggaaggctggaaattagtgcaggagggatgggcaggtgagtaggaggctgggga

SEQ ID NO: 19890 - DNA, 201 bp, Homo sapiens
gtaagaaattggagggaggtgaagggaggatgaggagaaggaccaggtccatttggagtcatggtcaaggtcttctggagagagactgcatcattgctgawggtaccagtgagtgaggaggaaactgaaaagagttcagcctcacaggaaggctggaaattagtgcaggagggatgggcaggtgagtaggaggctggggag

SEQ ID NO: 19891 - DNA, 201 bp, Homo sapiens
agtgagtgaggaggaaactgaaaagagttcagcctcacaggaaggctggaaattagtgcaggagggatgggcaggtgagtaggaggctggggaggtcacasaggacaagatgagagagtccattaacctagagaacataccatttgtgtctgtagggggtactcctgtgttctggactaggaggagttgtgtttcactatg

SEQ ID NO: 19892 - DNA, 201 bp, Homo sapiens
cgaagaatggaaactttcccatccctgggagtaaaaccttacatcagtgatacccaatcctgcttattgatgccccaggggtgtcttgaaattcttcaaakgaaattaattgtaattcacttcaatttttaaaatccacagatatgctgcatagcacaatgcttctgggcagggtggcccaggggaggtggactgaaagtt

SEQ ID NO: 19893 - DNA, 201 bp, Homo sapiens
aaatgtcagccaaggaatactgtcatactgttccttacaagtggagtgactcccgcgttggtgacaagagggcatggatgacagagtctgagacattactrtgactggtcttacttggtgctggtcagctcggacaacttctgcagggggagcctagcagatttcatgtgctaggcacaacaagcagggctggcagccata

SEQ ID NO: 19894 - DNA, 201 bp, Homo sapiens
gtgtgcgggggaaagaggcaattgtcgtatgcttccatagaaggagatgaaggagcgaagaatggaaactttcccatccctgggagtaaaaccttacatcrgtgatacccaatcctgcttattgatgccccaggggtgtcttgaaattcttcaaaggaaattaattgtaattcacttcaatttttaaaatccacagatatg

SEQ ID NO: 19895 - DNA, 201 bp, Homo sapiens
tgtggtagcatgctgttctagttttcctatttcactggctgtcccattccagtctctgttgctggttcttgctcctctgctatacccctgatgtaggtgtkccccagggctggcttctgggccctcttctcttctctgtctatgctcactcccaggatctcacccatttttgtaggtttacataaatccacatgtaaatga

SEQ ID NO: 19896 - DNA, 201 bp, Homo sapiens
cttccccactcactgctctgtgaattttcctttccctaggagtggtcagcagaggctttggacagatgcttctgcagagatgaatggcctggcttttttgytagcctatgttggctgctccaaccctctcctggcctgagccgaagatctctcctcgagatggagccttgagtccagcagttcttaatcaaaagtaatctt

SEQ ID NO: 19897 - DNA, 201 bp, Homo sapiens
ctaaagtcaaaagatcataagtcaaaccatcataagcccaggactgtctatatttataacacaggagtttatagcagatgctactcttcccctagagagcyagttgttaaatgtttaccagcacaccactggaacaaactaatctaggttttaaaaaattctctttgcctatgctctgtgaagaatgaattacagggaggc

SEQ ID NO: 19898 - DNA, 201 bp, Homo sapiens
tctttgcaggaacatggatggagctggaggccattatcctcagcaaaccaacacaggaacagacgaccaaatactgcatgttctcacttataggtgggggmtaaatgatgagaacacatggacatatagagaggaacaacacactggagtcttttggagggtgaagggtgggggaaggaagaggaccaagaaaaaagcagc

SEQ ID NO: 19899 - DNA, 201 bp, Homo sapiens
tttatcaggacacaatctgatcaacccattgtaagtgaaaaatatcatcagtcaaaactgcatttaacaccatctaaacccttcctaaagtcaaaagatcrtaagtcaaaccatcataagcccaggactgtctatatttataacacaggagtttatagcagatgctactcttcccctagagagctagttgttaaatgttta

SEQ ID NO: 19900 - DNA, 201 bp, Homo sapiens
tggcagatataaagacccaagtcttcgcggtggaatttcttagatggacttgcaggggctggcgttataaagcatgtcatcgtaaccccgtcctcgtctttgtttatttttttttaaagttcttttgttttcattttcccctccttcccaccccttcccccaaccaataaatcaccaaactgttacctagcgggccggtgc

SEQ ID NO: 19901 - DNA, 201 bp, Homo sapiens
atatatttgtacagctgtacaatgtgtgttttaagctaagcattattgccaaagagtctaagttaaattttttctaagtttataaggtaaagttacagtaygtgaagattaatttattgaaataaaaatgtttttaataaattcagtgtagcttaagtgtccagtgttgataaagtctacagtgccatacagtaatgtcct

SEQ ID NO: 19902 - DNA, 201 bp, Homo sapiens
ggtgaggaagctggggtcctgagagcctgggtgactgctggtgctttatgtgaaggtcagtggactgtggtgagtgacaaggtaggaggaaccagtcctgsaagtcccacccacttctgtctcatgtgccctgcagctatgctgacttagtaggggtgatcacattcaaacaacagtctcaccggcattcacaccgcattc

SEQ ID NO: 19903 - DNA, 201 bp, Homo sapiens
ggcagatataaagacccaagtcttcgcggtggaatttcttagatggacttgcaggggctggcgttataaagcatgtcatcgtaaccccgtcctcgtctttrtttatttttttttaaagttcttttgttttcattttcccctccttcccaccccttcccccaaccaataaatcaccaaactgttacctagcgggccggtgcc

SEQ ID NO: 19904 - DNA, 201 bp, Homo sapiens
aatgtcagtgccctcctggggtatccagagttaattagatttgactgcttgggtgggattttttaaatgctactatttgtctctttggggccctctagctkcttcttctctttccattcttctctgctgctgcctcacttgccacctccattctccctgagagacaagtagtatttgggttttgaaaaacagcattgagaa

SEQ ID NO: 19905 - DNA, 201 bp, Homo sapiens
gggtgactttcaatgattgagaaaagtctttgttggttctagggaaagattgttgtgaaaagggaaggtgagcatatttaagtgcattgagcttcatatcraatctatggacactcagagtaatcctttgtcatacctcaggtattttatcttataagtacgtctatggatatcttcgctttgggagatttttgaactgct

SEQ ID NO: 19906 - DNA, 201 bp, Homo sapiens
gggtggggcttgggaatgctatgcccagctaggctccagccacgctccagccacgtgaggcttcagagagaggccctgcctggcacctgtgccaagcatgttttttttttttttttttttgcctgtgggtggttgatttgaatcactgttgcaactctgcataatcttgaggctatatttttgtgtgtgtgctgcattttg

SEQ ID NO: 19907 - DNA, 201 bp, Homo sapiens
tgtctgcaggcttgtcaagtatctctctccttgtgtttacaactttcgttatcatatcccatatatttgccccataatgtccaccattcaaataaccttawtcctgtcccagtctctttctgcccttcttgaaattgaaccatgacttagtgaggaggcttctgtgaagcctattgcttaataaacttgagctatggtggt

SEQ ID NO: 19908 - DNA, 201 bp, Homo sapiens
gtataaagaaaaaaccccctgaaatttagaataatgctattgatgggagttttccatttattcacatcttcagcacatttttattgagtggccattgtgakgttcactctcagcaaggcccatccctcagtcaccagtagtcaaggggtgaaaccagctcacagcttccaggaatcggtgctcactgctagggtgaaatgg

SEQ ID NO: 19909 - DNA, 201 bp, Homo sapiens
ctccctcccagcatcagtaggagaaaccttcagccctgttgccataggtgctaggtcagagttgcttcccaggtgtcacacagggactcaggctgaggaayactccattgtctgccaatgctaccttttcaacaagtacccgtgcagtcgccctggaagaagggaaaggctgcagagggagcactgtcagttaaatgcttt

SEQ ID NO: 19910 - DNA, 201 bp, Homo sapiens
ctcctcagaaaccagggctgacatggcattccttccaccacccagccagagccttctcagaccctggcccaactcccaggagcaaagcccctcaccgagtsgggggagtgacctctagctgaattctcaaacaaagctgtggtgtcccctgagccctcctgccgaggcgtgtgcctgccaccatgtatgttttctacaagc

SEQ ID NO: 19911 - DNA, 201 bp, Homo sapiens
ttcttttcccgtttgtccattttgttttgtttttcttctcctgttttctgtattttgttcgtttttgctctctgggaatgcctattctcctctcctatctktctgcatccttctccccacttccttctcctttccctgccaccccactgccccgctaacccaccccatcccaactcaccaccctccatgagcagtggccgc

SEQ ID NO: 19912 - DNA, 201 bp, Homo sapiens
ggtggggcttgggaatgctatgcccagctaggctccagccacgctccagccacgtgaggcttcagagagaggccctgcctggcacctgtgccaagcatgttttttttttttttttttttgcctgtgggtggttgatttgaatcactgttgcaactctgcataatcttgaggctatatttttgtgtgtgtgctgcattttgt

SEQ ID NO: 19913 - DNA, 201 bp, Homo sapiens
tcttaggtaactgaaacatccttgtagctcctcagccatgctctaacttagtataggtaaatcttctaacactctgatacctgtatacctatatacctatacacacacacacacacacacacacatatacatctatacatatgtacatatctgtgtatatatacacccatatatgcatacatacacacacattttcacaca

SEQ ID NO: 19914 - DNA, 201 bp, Homo sapiens
agagccctgagaattgaggaattcggagacttaatttagctccaccactgatagactaaatattctaatggaaagtgaatttatgaaactgtgtgattcartctgtccatatgccccataggtacatgtggctttgtaataaggcctctttcagcctcattttctcatacataaaatgaggataatagtagctaccttatg

SEQ ID NO: 19915 - DNA, 201 bp, Homo sapiens
tgagacaatacaaggaatggtttttaatactgttcaacatggttttttatgtgatattttgtgtttctacaactgtgtggcttcttgtgagtgagttaccygacaagcagtgttaagtggtgtgtttccttttagaggaggcagagtggtggcctgtgggatggcatatatgggcaagaaggaagcctacagcaaaacagc

SEQ ID NO: 19916 - DNA, 201 bp, Homo sapiens
cttaggtaactgaaacatccttgtagctcctcagccatgctctaacttagtataggtaaatcttctaacactctgatacctgtatacctatatacctatacacacacacacacacacacacacatatacatctatacatatgtacatatctgtgtatatatacacccatatatgcatacatacacacacattttcacacat

SEQ ID NO: 19917 - DNA, 201 bp, Homo sapiens
atgggcaagaaggaagcctacagcaaaacagctatcagtgctcatatgcaaagaaatatcttcaatcagataaggaaatcatgcagaaattcctttaaacrtggaattgttaggagaaaggaaaattcctttaaacaagaaatttttaggagagaggaaaactcataacaaatgttttcacccatgacataggaagaatgg

SEQ ID NO: 19918 - DNA, 201 bp, Homo sapiens
gaatcacctggagggcttgttaaaatacagattactaccccccactcccagagtttctggttcagtaggtctgaagtagggctggagaatttttgttggtyacaatttcccaggtgatattcatgctgctggtcttggacatcatgctttgagaaccattgctgtacatggttttgttatctgcctggcaatgcctttcta

SEQ ID NO: 19919 - DNA, 201 bp, Homo sapiens
caagcccagtggatcccgtcaggttaagagtatctggaagtactagacagtggtttaataacaagcctactgtgccagttctgcattcttttcccttggakgcctctaaacaactgggcagactttgtctccatcctcttttctcaccaccatttaaacctcttcctacattgccatcaaccaagaggttttcaactcctc

SEQ ID NO: 19920 - DNA, 201 bp, Homo sapiens
taagaccatattcttactgcgagtagggaaaatttttaaaaagtccatggctgcttaatatttaaacaaactgttcactgtgtaaactagggtgtttttcygccaaatggggaaactgagcagaaataggtttacaatctagtgttgctcttccatatggctgaatgtgacaaatgatgtcatttgtcatagacatgctag

SEQ ID NO: 19921 - DNA, 201 bp, Homo sapiens
gataggcattcttgttttctgtctttcatagttagaaggattaaggtgtggagaggttaactcatttccctgagatcgcacagtaagagctggaggcctgratcagaactcgtgctcttaatcactgaagctaaatagtctttccataagactttttttcttccttctcaaagttattgggtttacacttttaaaaataaa

SEQ ID NO: 19922 - DNA, 201 bp, Homo sapiens
gtcctgacttaatagcaattgaaacaaatgtaacagattaaacttattttttaaaagtcagaggccctgtgactttatttaattttttgatcttatgtttmaatgactaagctaagtaaaatgacactagaaaattgaaaatagaggaggtggcaaaaggtgttctagacaaatgccaaccaaaagtaagtgaacataaca

SEQ ID NO: 19923 - DNA, 201 bp, Homo sapiens
ggaggtggcaaaaggtgttctagacaaatgccaaccaaaagtaagtgaacataacattaaaaaaattcaaggtgaaaatatcaaaggaaacaatagtgacyatttcactgtgataaaaagaaaataattgaaggacatttaaaacttatgcaccgtcagaataaatgtctgttaaaaacgtaaaggtaactattaggtaag

SEQ ID NO: 19924 - DNA, 201 bp, Homo sapiens
tgaaggacatttaaaacttatgcaccgtcagaataaatgtctgttaaaaacgtaaaggtaactattaggtaaggagatttccaactggttttgaacaaaaygcaacaaaaatttaggggtcttcataaaaaagttcagtatcattttgggcacttaggttgatttacaaagcaggtcctcagaggcttaaacatttataaa

SEQ ID NO: 19925 - DNA, 201 bp, Homo sapiens
cccagtggccaccctctgtaggtgggagcacttgtggtgacatgcctacatttagagtggtcatattctcttctgagggctgggggccgtggtttcttttycttttctttttttttttttttttttttgagatggagttttgctcttgttgcccaggctggagtgcagtggcacgatctcggctcactgcaccctccacct

SEQ ID NO: 19926 - DNA, 201 bp, Homo sapiens
gtaaattggaatgcaaatctgtgccttcctgggacccatagtctagtggaagagagtgacaagaagcaattgcaatacatcaccgcactaatgctctgttkaatgtattctgggagtatggaagaaggagaaggtgactgtgtttgggaaaaaaaaatcacagagaggtgatatttatttaagctggatgttgaaggtggg

SEQ ID NO: 19927 - DNA, 201 bp, Homo sapiens
tccctctgagcccactgcctggtgctgactcagcccaagtgcttacctgctcaccagtcaggagttgaacatatagatgaagttgaacgaatgtctgaggycaggaataggaaaaatgtctcagctcaatgtggtttgcgcatgacaaaaagagtaactggtgatatttctaagaccttggtacattcccactatgggaca

SEQ ID NO: 19928 - DNA, 201 bp, Homo sapiens
tgcatgctgtaacaccaaccctgccatccctctggctggtatctattcagctaagtgactattccctgactgtgcttcctccccatttccttctattttcygttactcgttgactaggctcaccctaaacttcactcacccagttgacattagtatctcctccactacatagcttctcaccaagggcttgaaggcaggggt

SEQ ID NO: 19929 - DNA, 201 bp, Homo sapiens
cttgctggcaggccacggaggcagaagaagatatgggtgacttcaggctggtgcttcggggactcctggtgttacagaccaccacctggctccccattccyacccctctgcatttcccacagtttcctatgcccaccagaaggcaaaaacagaggaggaaataagtgtaatatttgcctttgttacggccatttcagaaaa

SEQ ID NO: 19930 - DNA, 201 bp, Homo sapiens
ggggtttagaatatgctccccaaaatatgtcaccttggcgtactcaatgttttaagctaaaggaatttgaaaaacaacgtgtgcaggaaagactctctggycttcccctgaaagagctcatagaacgctcatgtgagaggtgccctcccatccctggaggaaaggagcatcgtgatccctgaagacagagggacactgaca

SEQ ID NO: 19931 - DNA, 201 bp, Homo sapiens
tcccctgaaagagctcatagaacgctcatgtgagaggtgccctcccatccctggaggaaaggagcatcgtgatccctgaagacagagggacactgacaggkatatgaacaaatggacctcgcaaagtctcccctagtttactgtacttagcccacaccattttgtcttattgtatttttccataattttccactcttcatc

SEQ ID NO: 19932 - DNA, 201 bp, Homo sapiens
gacaagaaaatacaggatagtaaagagtggaagattaacctggggtgatgtcacagactgtgactgggtggatggtccaggaaggctctgcaaaggtagcrtgtgagctgagatctgaaagccaggaagcaaccactatgggaggatggggaagaacattcctagtacagggaacaacattcccagtacagggaacaacta

SEQ ID NO: 19933 - DNA, 201 bp, Homo sapiens
gcagcaaaacagaagtaaattgatgctcatctcccagattagttgagaacggcctaattagctaatgaacagttccagtcctatgttctgaaaggctctgyttctgggcaagccgcagtgcttagcagcagctgctaaaccatgtggacatgctaacaccaagcagaggagcacatgttatgttttgacctgcaaagactc

SEQ ID NO: 19934 - DNA, 201 bp, Homo sapiens
ttaacctggggtgatgtcacagactgtgactgggtggatggtccaggaaggctctgcaaaggtagcatgtgagctgagatctgaaagccaggaagcaaccrctatgggaggatggggaagaacattcctagtacagggaacaacattcccagtacagggaacaactagcttaatgccctaaggcagaagcaagattggtat

SEQ ID NO: 19935 - DNA, 201 bp, Homo sapiens
gtttggtgtggtgggaggagctacgggaggtgggcaggagccacctggtcagggaacacttcggagctcagggtgaggactgtggacttcattgcaaggtrtgagacatgcactggaggcttccgtgcagcggagggatgcctactcagtggtgtgctggagcgggctcatgggagcttctgagagcctcttggcacgtct

SEQ ID NO: 19936 - DNA, 201 bp, Homo sapiens
gtttctgggacttttggctgcttgttcaggttccagttgtcactgcagtgactgaccaactccatgcatgtaaaacccgacagcacttcacctcatgaagktgtacctcccacctcttaccctggagcttccctattgacaccaactcacgagatgcacaggactctcctgggcaactggaaggtggagaggaaattaact

SEQ ID NO: 19937 - DNA, 201 bp, Homo sapiens
ccctggaaatggctgagtttccctgtggcttggagcagagggaaaaagtggaaatgatacctgtgttaagtaacatcaagcacccaggtccactggcatgyctgttaataaaaaaattttttaatgttttcattcatgtatcgtttcaactgaatcacatgtaccctaaaacttaaagtataataaaaataaataaataaa

SEQ ID NO: 19938 - DNA, 201 bp, Homo sapiens
accaaggaccttcatcacctgttgaacatagagagacttcagctggggagaactgaagacctttacagaaacctcaggacatttttattcaaacccatccrtggagttccctcaggaggaaggagcttgggttcagctcctagttgaatcaagtaactctccgccttcatctgtttaattcatttacacttagagtagtat

SEQ ID NO: 19939 - DNA, 201 bp, Homo sapiens
tgcagctgcagcctgagttttccccaggctgctctatttgtgcctgtagcttgatttttcaggctgtctttcattttgaaagaattttaccaaagacaagytttagctgtctgcccaactagtttttccttttctcctccctcaactggatcataacttatgactctgaggctgagtcctgggatagttggatgtagaggg

SEQ ID NO: 19940 - DNA, 201 bp, Homo sapiens
agcccactgtgtacatgcccgaaaagaggaggaaacctttctgtgggagcccactgattacaccaagaacaaaggctgctatgttgggccttacttgcttrtctgtgcagctgcagcctgagttttccccaggctgctctatttgtgcctgtagcttgatttttcaggctgtctttcattttgaaagaattttaccaaaga

SEQ ID NO: 19941 - DNA, 201 bp, Homo sapiens
cagtggctcacgcctgtaatcccagcactttgggaggccgaggcgggcggatcacgaggtcaggagatcgagaccatcctggctaacacggtgaaaccccstctctactaaaaatacaaaaaattagccgggcgtggtggcgggcgcctgtagacccagctactcgggaggctgaggcaggagaatggcatcaacttggga

SEQ ID NO: 19942 - DNA, 201 bp, Homo sapiens
cttaggcaagcacaaagcacagcttctcttgttcgggttactgtggttatgttttgggtaggtcccccacctccctgtgcaagttcccatggagcccactrtgtacatgcccgaaaagaggaggaaacctttctgtgggagcccactgattacaccaagaacaaaggctgctatgttgggccttacttgcttgtctgtgca

SEQ ID NO: 19943 - DNA, 201 bp, Homo sapiens
gcactttgccttggctgagcagcaaggttgggccctgagggtgggaagggaggtagacagtgatgggcatgggatcctttgctgtctggggctaaactccsaacctccaaatcaactttcccaataaagcttaatatctattagggtaagcatatttttggcttttctctgggctgaaaggtgacctcatcttatgggaaa

SEQ ID NO: 19944 - DNA, 201 bp, Homo sapiens
tttgtgtaattccccttatctgtgcagctgcgggcatgtccttaggcaagcacaaagcacagcttctcttgttcgggttactgtggttatgttttgggtargtcccccacctccctgtgcaagttcccatggagcccactgtgtacatgcccgaaaagaggaggaaacctttctgtgggagcccactgattacaccaagaa

SEQ ID NO: 19945 - DNA, 201 bp, Homo sapiens
tcaggctgtggcttcagagggtggaagccccaagtcttggcagcttccacatggtgttgagtctgaggtgcacagaagtcaagaattgaggtttgggaacytccacctagatttcagaagttgtatggaaatgcctggattcccaggcagaagtttgctgcaggggcagggccctcatggagaacctctgctagggcagtg

SEQ ID NO: 19946 - DNA, 201 bp, Homo sapiens
aaatgaaaccactgccaacacagaattgccaatcttgcttccaatttctctgttagtttcagaacatttagggttgaagaggtttttcttgatgtctaacycaaattcctccttcctaaagcaaagactttacaggaaccttggcaaggtttccctatgggtagcaaagctctctgaaacatggactctgaagattaatag

SEQ ID NO: 19947 - DNA, 201 bp, Homo sapiens
gaaactcccctcatctctgtagctgtttgtgtaattccccttatctgtgcagctgcgggcatgtccttaggcaagcacaaagcacagcttctcttgttcgkgttactgtggttatgttttgggtaggtcccccacctccctgtgcaagttcccatggagcccactgtgtacatgcccgaaaagaggaggaaacctttctgt

SEQ ID NO: 19948 - DNA, 201 bp, Homo sapiens
tccaggtggtggtgatggttggtgtgtgctgctcttgggccccagtggtgggtttgtgattctggttctgctgcaggacagtgacactcaccaagctgtgytgggtgtagttgtctcagggaggtgcctgctttcaaaccaaagttcctttgatggggaggactgaccccaggaagactgattgcgtatcaatattactct

SEQ ID NO: 19949 - DNA, 201 bp, Homo sapiens
tacctacctcacagggttgcctttattttttgctgtgttctgtgcctatcatctggttggctgggggctttgggcaagtcattttcttcctctacaaccarggatggggaagcagcttctctctgacctcatcacttcctactctcttgcctacttctcttcagccacactttctataactgtgaaaggggaaagagaagc

SEQ ID NO: 19950 - DNA, 201 bp, Homo sapiens
cagcaggaaacagagagatggagttattaattgtcagtccatgagcccaccctctcaaggtcctaattagcatgctgacagcttcggttttatccagagcyagggcaaggctctggggacactgtggctcagctaggggcatccggcacagagtggagagccctggtgcctttctgggtggggtggaggggcgcttgcaag

SEQ ID NO: 19951 - DNA, 201 bp, Homo sapiens
catccagcatcatgtctgctgcatagtatatactaattaggagaatttgatgaacaaatggagaagttttcctcccaggagcatgcttacaaaggaaacatttttttttttttttttgccttgcctaggtagcacatagcccacctttaagtttttttttttttttttttgagacggaattaagtttttaaatgattttta

SEQ ID NO: 19952 - DNA, 201 bp, Homo sapiens
tattccagcaaccctatcaatggatgttcccagttgctttgcagttaccagctgtgctgtagtaagcctcccctacatgcctttaggatgtgcactttcayttctgtagggtcaagtcctagaagtgggactgtggacaagtctttcccacgctatgccctcactctccggaggactggcacttctctcaacacccctcct

SEQ ID NO: 19953 - DNA, 201 bp, Homo sapiens
tgattagatcacgttggtcaattttggcttttgttgccattgcttttggtgttttagtcgtgaagtctttgctcatgcctgtgtcctgaatggtattgccyaggttttcttatggggtttttatggtttggggtcttacgtttaagtctttcatccatcttgagttaatttttgtataaggtgtaaggaaggggtccagtt

SEQ ID NO: 19954 - DNA, 201 bp, Homo sapiens
ctgccctgagaggtagctctttgagaacaattgagtactcctgggaaggaggaagcagctcaaataaaaagatctttagatccctttcttttagaattctytattggagctaagagaccagggaattttatttgattattctgataatagttttcccaagcttttcagggtgtagggctgagagtacagagaggtttctag

SEQ ID NO: 19955 - DNA, 201 bp, Homo sapiens
gctaacaataacaattctacatctagaaaactctaaagacttcacgaaaagtttcctggaactgatgaacaacttcagtgaagtttcaggatacaaaatcmatataaaattcagtagcatttctatacatcagtagtgttcaaactgagagccaaatcaagaacacaatcccctttacaatggccacaaaaaataaatacc

SEQ ID NO: 19956 - DNA, 201 bp, Homo sapiens
taaaattcagtagcatttctatacatcagtagtgttcaaactgagagccaaatcaagaacacaatcccctttacaatggccacaaaaaataaatacctagsaatacatctgccaaggagatgaaagatctctaccaacaagaaaaactataaaacactgctgaaagaaatcatagatgacacaaaaaactggaaaaatatt

SEQ ID NO: 19957 - DNA, 201 bp, Homo sapiens
gtttcaaaggcaggatgcaggttgaaaacatcagtttctgtctcttctagtgcttttttttttttttttttaatttcaggactagccacatgtaagttacwaggtttacaaaagccagccaaggctaaagggtgttgccctgctggggtgggaattgctagtggcatgactgtccctcattacctctggatttgacattgc

SEQ ID NO: 19958 - DNA, 201 bp, Homo sapiens
tctggatttgacattgcttttcaggagtggccggagtggatacccttcgatgagtccactctctccccaggatatattccagttggcttgtatggaccccrccgatgacggacagttccaagaacggcagtctctggtgaatgcatgagttatatgacctcaaaactacttccttggtttcctgatccctctcactaattt

SEQ ID NO: 19959 - DNA, 201 bp, Homo sapiens
actccaattcaccttacttccctgtatgcaagagccgtatgtgaggggacctacaggttatcctccctcagaggagccaggtttggggctggaggagcaayctaaaattaaggatgacagaattgggtaaggagaagtatcgggaatgaaacacgacttggatttgtgtcactgtacaatctcttatgggaatctagtcag

SEQ ID NO: 19960 - DNA, 201 bp, Homo sapiens
ccccagcccctcattcatttcttctttcctagacatgacagagaaactggcaggacttacagtgggtgctggactccctcagattcagtctgcagctctatttttttttaaacgtcttgctctgttgcccaggctggagtgcagtggcatgatcacagctcactgtaacctcgaattcctgggctcaaacagtccttccac

SEQ ID NO: 19961 - DNA, 201 bp, Homo sapiens
tacacatgggcaggcccagcacagacatccaggaagggccaggctgtgcttttgcctgtgtctcataaagcacagtcctcttctcactggtgcttctgctyctcatccccacaggagaagacagaaccttatttcattgggatcttttgctttgaagctgggatcaaaattgtggccctggggttcatcttccataagggc

SEQ ID NO: 19962 - DNA, 201 bp, Homo sapiens
tgattttagaggtggttccataggaaagagaagcttatatatttgtttttctacttcagtttaaaattgggataattatctagatagaccctcattcaaamacacacacacacacacacacacacacacacacacacacacacacacacacacacccttatattagcaagtcctcacagagaatatctcagtcagctgttt

SEQ ID NO: 19963 - DNA, 201 bp, Homo sapiens
tttaggattgtattagagacccactgtaaggactgaactttaaccaccagttccacttcaacctaaacagtgctacctggagttatttcctgtgtttgaatttttttttttttgagacagagtttcactctgcagcacaggctagagtgcagtggtgtgatctcggctcactgcaagctctgcctcccgggttcacaccat

SEQ ID NO: 19964 - DNA, 201 bp, Homo sapiens
tcttttgctttgaagctgggatcaaaattgtggccctggggttcatcttccataagggctcttacctccgcaatggctggaatgtcatggacttcatcgtsgtcctcagtgggtaagtccattttctctctctgtctgtgtgtgtgtatgaagggggttggtatcatgaggtggctgggggcagggaacctggggtggaaa

SEQ ID NO: 19965 - DNA, 201 bp, Homo sapiens
tacttcagtttaaaattgggataattatctagatagaccctcattcaaacacacacacacacacacacacacacacacacacacacacacacacacacacacacccttatattagcaagtcctcacagagaatatctcagtcagctgtttactttctacatagcatggatatctaaatgtatacattgtgctaacacttca

SEQ ID NO: 19966 - DNA, 201 bp, Homo sapiens
cttaattcccttctgctggtgccaccttccccccaaaaagttatgcagccatatttatgatagagttcctgagccatattgttaaccaagatcctatattstgtgtagcataaatagaaacagaatagattgcattgtttgacatatgtgtctctagtggcaccttgcaaacttacctgcttacaaaataggtaatttgct

SEQ ID NO: 19967 - DNA, 201 bp, Homo sapiens
cgttctcctgggcctggagctctcatttgaaggcagttaaactcgtgcattcttgtgcttgtgcatgagtgtatgtggaagagggaggtggggtgaaaatycccaggtatgttttcaaagcagaggtggatatggcataaatgcgaactctatagatttacaagaattgagaattaaaggaactgtttacatttccattct

SEQ ID NO: 19968 - DNA, 201 bp, Homo sapiens
cttcagtttaaaattgggataattatctagatagaccctcattcaaacacacacacacacacacacacacacacacacacacacacacacacacacacacacccttatattagcaagtcctcacagagaatatctcagtcagctgtttactttctacatagcatggatatctaaatgtatacattgtgctaacacttcaag

SEQ ID NO: 19969 - DNA, 201 bp, Homo sapiens
ctccagacagactccaggtagggaatgcatgctgtctctttctctgtgtctgtctccccatctcctagaggacagagtgccagcgacctctggacaggggyagggctccagccaaggtgcccctgagccagggtcaacatagaatttcctgccccgtgaagggctggcaccagctagcatccccttggctccacatgagtc

SEQ ID NO: 19970 - DNA, 201 bp, Homo sapiens
tcctgcccacttccatcccacatcccctcttcagatgagtgcagccagctctttaacgtgttagcttcttcctccctgctcttctgttgtccttttcttagtctccctaatccttccctgttttcattttacattctgttctgaaatacaagacttggggagtttgaggtagatgccacagagggtagtacgtggtgttgt

SEQ ID NO: 19971 - DNA, 201 bp, Homo sapiens
agctagacagccattctcatcctggaaacgctggttttaagggagaggccagtcttcttgtgtttgctgcacccatcctgacttggaaggaaggtctttgktgactccatgaatggcacccaggggtccagtcttcaagttccattgctttctctggcctgtggctcatgactaattccaccccaaccttgtctcagactg

SEQ ID NO: 19972 - DNA, 201 bp, Homo sapiens
ttttgagatcctcagaggcctagggttagcgtataccaagaatcctggtgagaggcgttgccatgccttggggtgaattcttccccactagctctctcacycagcctacaagtccttctctcatagatcccagagcaatgggcaccgtccaggaggtacaggagaggactttatgatgcaggaaagaaggaagaagtgggt

SEQ ID NO: 19973 - DNA, 201 bp, Homo sapiens
cagagggtagtacgtggtgttgtggttgtggtgtgtatgagagactcattctgaccaagaccttcttagaactttgtctattagactctgacctccagtccttcttctccaataagcaaattcaagtttggggtgggatctccctactgggaatctgatcaggtcaaagtttgactagctagtactgcaaataaaggagga

SEQ ID NO: 19974 - DNA, 201 bp, Homo sapiens
cctgcctgaattgccacactgatgcttctggtgccacctcttagaaactagagggctagggagctgggtgatgcagtttgtagggcctcacatctcagggmacagagaagggtggaaagtaggtgagggaggggcaggtaagtggagaataaccagtgtggatgggtattatttgggaagacagggaggagcgaggaacga

SEQ ID NO: 19975 - DNA, 201 bp, Homo sapiens
agagggtagtacgtggtgttgtggttgtggtgtgtatgagagactcattctgaccaagaccttcttagaactttgtctattagactctgacctccagtccttcttctccaataagcaaattcaagtttggggtgggatctccctactgggaatctgatcaggtcaaagtttgactagctagtactgcaaataaaggaggag

SEQ ID NO: 19976 - DNA, 201 bp, Homo sapiens
atgaccaaaccatgattgtcaggcttggaagactgggctttatcctgcagacaaggggggctacagcagttgtttccacagaggagatccattatgaaaastgtctggagaaatggtttgggcagaggtatgtgagtagagggaggcaaggaatgaccagaacactgttgtgaccaccggtgagaatggagagcgctgggt

SEQ ID NO: 19977 - DNA, 201 bp, Homo sapiens
attattactgcaactcatgaatgaccgtcagaggtttctgagcctacagggctggggcaggggtgtctcctgaccatttcaatcttctgccacagcctggrccacacagacagctttagcatcagaagagatggccacacccagagctgggcccccagtatccacaaaggaaagttcagcttaggaagaagaaatggggag

SEQ ID NO: 19978 - DNA, 201 bp, Homo sapiens
cttggtatgcagggcttctcatgagccactctgcacattgcgccagctttccttgaccactgtaatcactgtctctccagctgcttcagtggctgctgatscctgaaggcaccatcctcttccaggcctccgtgcctttgcacttgctgcttttccacctagaatgagtctggctttaagattgtactcagaggtcacttc

SEQ ID NO: 19979 - DNA, 201 bp, Homo sapiens
tgtgcatctttctttggccatttctggaaagatgtccataacatctctttcacgctgcagagtattcctcagcatgactgaaccacagtttattccagcarccctatcaatggatgttcccagttgctttgcagttaccagctgtgctgtagtaagcctcccctacatgcctttaggatgtgcactttcatttctgtaggg

SEQ ID NO: 19980 - DNA, 201 bp, Homo sapiens
gccatgtaataggctgcaaaaagtagcagctctgcttcccatctcacttggggcatggggagaggaggattgggtttagggaggaagggtacaggtgtgargggcacaggtatgaggtgcataggtatgagagactcaagtgtggggggcacaggtatgggggcataagtatgagggacacaggtgtgaagggcacaggta

SEQ ID NO: 19981 - DNA, 201 bp, Homo sapiens
agccaaaggcgttttcctcttggatgtgaggggatgggtgaagacacgtgcagaaaaggaagtgctcattgtggaggaggtgaacataattggaggaattygctttggcctttttggctgaaaaaaatatttatgaaattgctgtacacccccgctcccccccccgaccccaagcagagttagacacctatagaattccag

SEQ ID NO: 19982 - DNA, 201 bp, Homo sapiens
gattgtgagagtagcctaatagagtagttttgtttggttttcttacttgacccaggggtgttattttcttggcctaagtgttcctgaatcccgctgaacadgtaaattcagcccataaatccatgtcacacacaatcctgagttttgatttctcagggttttgctttttctcattcactcagagacagaagcttccttgtt

SEQ ID NO: 19983 - DNA, 201 bp, Homo sapiens
agggaggaagggtacaggtgtgaagggcacaggtatgaggtgcataggtatgagagactcaagtgtggggggcacaggtatgggggcataagtatgagggrcacaggtgtgaagggcacaggtatgagggacacaggtatgagggtcagggcatgagggagacaggtgtgaggggccaggtgtgatgggcacaggtatgag

SEQ ID NO: 19984 - DNA, 201 bp, Homo sapiens
tagcgccagctgctcaatttgttttccctctttttcagaagagatattttttcttcttttatggtgcccccaagtggttgtttctgtgtattgcagccgcrgtctcactgggatgctttccgctgtgtagctggaggggctggggcagcctggtggtcagcactcacatcacaagaaaggaaagcgaagccaggaggagaa

SEQ ID NO: 19985 - DNA, 201 bp, Homo sapiens
cttagtgcttcagccagagggtgaggagggagggggagtggaggaggctttccagtgagtcatccctcctgcatgttaggagttttggttaaaagatttasagagagagagagtgagagagagagagtgagagagagagagcgtgagagaaagaaagagagcaagaaagcgagagagagagcacgagagcacacaagtgag

SEQ ID NO: 19986 - DNA, 201 bp, Homo sapiens
acagtgctgggagcaagggctgggggagatctgttgtcccagttcttcccttctaaggcaggccttgggggaggactctcccccaagactctgcagcctgktgctcaagccggatcggcccgttctgtgcttccttttgtggcaccatcagagtctcctccctgtttggaggctcaggtgaatcagtcccctctctcccac

SEQ ID NO: 19987 - DNA, 201 bp, Homo sapiens
acttttctttgtaattattctttatttgtttgatccatgtccatttttcttttttttacagctccagaatttgcaatatgaaaatagagattatttaaacaaaggaaagtagcataactggaaactttgaattattctattaatacttgactacatatggaagaatattattgaaaaatatgatccagtgatggggtggtt

SEQ ID NO: 19988 - DNA, 201 bp, Homo sapiens
ggaagaatatttttggggcagtgtgaagcaggcgctgtgagcagggctttgaggcaggaatgggcatgacacgtttgtttatgtacctcatactatggtaygtgaggagatagtgttggaaagataggttgaattctgattgccttgaattgtcaggctaaggtgtctggccattttataggcagtggggagccaccgaag

SEQ ID NO: 19989 - DNA, 201 bp, Homo sapiens
tattgtgtactaagttttataactttagcaagtgggcatgtcacaatgttttactaatactttaatatagttctctccagcttaaaacatttttcatacayatgatctcatctgagcctcacaatgacctcatgaattagctgttattatttataatttacaggagagaaaaatgagctccgaagttagaggtggtactag

SEQ ID NO: 19990 - DNA, 201 bp, Homo sapiens
atcctcctggatattgagggcatggtgccaggaacacttggcctctgatcaaattcaatttgaggatggtaagcatagcatttccataggcttagtgtcaytgtatagtttcttctcttgataaacaatttagaattaccctattgctgtcctgaagggcagcatgggttttagaaagagccgcagattggaagtcagatg

SEQ ID NO: 19991 - DNA, 201 bp, Homo sapiens
gtatgccgccagcctgctgaggcagaaccacaaaggaaaggggtgaggtgacagcatgagagtgaagttcatgaagctttctggcctgcaaggttatacartctagtataatctagtgtaaaaagctacatgatttatgtcatcacccatcttgttcattatagtatcctcagtgcctaaaacagtgcctggcacctggaa

SEQ ID NO: 19992 - DNA, 201 bp, Homo sapiens
ctctgccccacttcagggctgcccaggatctgcatgcactttgtagagatggaaatttttcctcccttctgtctcctgcctttcagcttctcctgacttaygttctttagacaggatccctttggctctaggacaggggcagcctggtcctttcccagggcttggatttactgtagtgggaaatcaggcagggttctctgt

SEQ ID NO: 19993 - DNA, 201 bp, Homo sapiens
ccctgctcacgtgtgtgtacactgctcaggtgtgtgtgcattttgctcgggtgtgtgtgccctgctcagctgtgtgtgccctgcacagatgtgtgaacatygctcaggtgtgtgtgccctgctcaggtgtgtgtacactgctcaggtgtgtgtgcattttgctcgggtgtgtgtgccctgctcagctgtgtgtgccctgca

SEQ ID NO: 19994 - DNA, 201 bp, Homo sapiens
catttttcttggaagctacatctgcatagggagataattttattttcttatggcactttcctctgcagtggataccatactctttttaaaaatgctaatgygatttaaaatgtgatgttacattctatacgattcctcgttttcattttcttttttgctcatctaatagatcttctctggcagttggctgttctgagtgcc

SEQ ID NO: 19995 - DNA, 201 bp, Homo sapiens
acggacacacaaacacacacacatacatacaagcacagatattttgcactggagtgcaagcttcttgaaagcagggcctttgtcttaccttcagggtccaraacagtgcctagtgtgcagttgactcacaataagtgtttgctgaaagaatgatgaagtaaacatattgaggggaattgatatccattctaatcagctaag

SEQ ID NO: 19996 - DNA, 201 bp, Homo sapiens
tgtgtgtacactgctcaggtgtgtgtgcattttgctcgggtgtgtgtgccctgctcagctgtgtgtgccctgcacagatgtgtgaacattgctcaggtgtrtgtgccctgctcaggtgtgtgtacactgctcaggtgtgtgtgcattttgctcgggtgtgtgtgccctgctcagctgtgtgtgccctgcacagatgtgtga

SEQ ID NO: 19997 - DNA, 201 bp, Homo sapiens
gagggtagtacgtggtgttgtggttgtggtgtgtatgagagactcattctgaccaagaccttcttagaactttgtctattagactctgacctccagtccttcttctccaataagcaaattcaagtttggggtgggatctccctactgggaatctgatcaggtcaaagtttgactagctagtactgcaaataaaggaggagg

SEQ ID NO: 19998 - DNA, 201 bp, Homo sapiens
cctgttggctttgcttttgatatgaagtgtgggtaatgtttcatgtggaaaccaggccatgacttgttgtggggaccatttataattgggatgaagcctgraaaatgagttggagtgaaggaatttgacagaaatgaaatgacttgaggatagagacaaaaatatcctcaatgtgatagttttgtctgttggtttgcatgt

SEQ ID NO: 19999 - DNA, 201 bp, Homo sapiens
tgtacactgctcaggtgtgtgtgcattttgctcgggtgtgtgtgccctgctcagctgtgtgtgccctgcacagatgtgtgaacattgctcaggtgtgtgtrccctgctcaggtgtgtgtacactgctcaggtgtgtgtgcattttgctcgggtgtgtgtgccctgctcagctgtgtgtgccctgcacagatgtgtgaacat
